United States Patent 9,107,886 (MODIFIED POLYNUCLEOTIDES ENCODING BASIC HELIX-LOOP-HELIX FAMILY MEMBER E41) - sequence listing, part 3

SEQ ID NO: 2618 - DNA, 567 bp, Artificial Sequence
  Description of Artificial Sequence: Synthetic coding sequence
atggcattaacctttgccctgctcgttgcccttcttgtgctctcctgtaaatctagttgcagcgtgggctgtgaccttccgcagacgcattccctgggctctcggaggacgctgatgctactcgctcaaatgcgccggatctctctgttcagttgtcttaaagaccgtcacgacttcggcttcccacaggaggaatttgggaaccagtttcagaaggccgagaccattcctgttttgcatgagatgatacagcagatttttaatctgttttcaactaaggactcatcagcagcatgggatgaaacactcctcgacaaattctacacggagctttaccagcagctaaacgatctcgaagcttgcgtgattcagggcgtgggcgtgacggaaacgcctcttatgaaagaggacagcattctcgctgtcagaaaatactttcagaggattacactttatctcaaagagaagaagtactccccatgcgcctgggaggtcgttcgcgcagagattatgagatccttcagcttgagcacaaacctccaggagtccctcaggtccaaagagtag

SEQ ID NO: 2619 - DNA, 570 bp, Artificial Sequence
  Description of Artificial Sequence: Synthetic coding sequence
atggctctgagcttcagtttactgatggccgtgcttgtcctgagttataaaagtatatgctctcttggatgcgatctgccacaaacccatagcctcgggaaccgccgagccctgatcctcttagcgcaaatgggacgcatctctccattcagctgtctcaaggacagacacgacttcggattcccccaggaggagttcgatggcaaccaatttcagaaagcccaggccatctccgtattacatgaaatgattcaacaaacgttcaatctcttcagtaccaaggattccagcgccacctgggagcaatccttgctggagaagttttccaccgaacttaatcaacagctaaacgacctggaggcctgcgtcatccaggaggtgggagttgaggaaaccccacttatgaatgtggattctatcctggcggtcaaaaagtactttcaaagaataaccttgtacctgaccgagaaaaaatattcgccttgtgcttgggaggtggtccgcgcagagatcatgcgctccttcagcctgagcaaaatatttcaggagcgcctccggcggaaagaatag

SEQ ID NO: 2620 - DNA, 570 bp, Artificial Sequence
  Description of Artificial Sequence: Synthetic coding sequence
atggccctaagcttctcgctcctcatggccgtgctggttctatcttacaagagtatttgttctctggggtgtgacctgccccagacacatagcttaggcaacaggcgagctttgatcctcctagcacagatggggcggatctctcatttcagctgtctgaaggacagacacgacttcggatttccagaggaagagtttgatggtcatcagtttcaaaaagcacaggcgataagtgtactccacgaaatgatccagcaaaccttcaatttattttcaaccgaggattcgagcgctgcctgggaacagagcttgctggagaaattctccacagagctttatcagcagttgaacgacctcgaggcctgcgtgatccaggaagtgggcgtggaagaaacgcctcttatgaacgaggattctatccttgccgttcgcaagtattttcagcgcatcaccttatacttgacggaaaagaagtatagcccttgcgcctgggaggtcgtgagggccgagattatgagatcgcttagctttagcaccaacctacagaaaaggctgcgacggaaggactag

SEQ ID NO: 2621 - DNA, 570 bp, Artificial Sequence
  Description of Artificial Sequence: Synthetic coding sequence
atggcgctgccattcgtgcttcttatggcactggtggtcctgaactgtaagtcaatctgctcactaggatgcgatctgccacagactcattccctcagcaaccgcagaacccttatgattatggcacagatgggccgtatcagcccattcagctgtcttaaagaccggcacgactttggtttcccccaggaagaattcgacggcaaccaattccagaaggcacaagcaatttccgtacttcatgaaatgatccaacagacattcaatcttttctctaccaaggattcctctgccacctgggacgagactcttctggacaagttctatacggagctgtaccagcagcttaacgatctcgaagcttgtatgatgcaggaggtcggtgtggaggacacccctctgatgaacgtggactccatcctgaccgtaaggaagtacttccagcgcatcaccttgtatctcaccgagaagaaatattcaccatgtgcttgggaggtagtcagggcagagatcatgagatctttctccctcagcgcgaacctgcaggaaaggttgagaaggaaggagtag

SEQ ID NO: 2622 - DNA, 570 bp, Artificial Sequence
  Description of Artificial Sequence: Synthetic coding sequence
atggcattacctttcgcattgctcatggcgttggtcgtgctgtcttgtaagtcatcctgcagcctggattgtgacctcccgcaaacccatagcctgggacatagaaggacaatgatgctgctcgcccagatgaggcgaatttcactattttcctgcctcaaggatagacatgactttagatttccacaggaggaattcgacgggaatcaatttcagaaagctgaagccatttcagtcctgcacgaagtgattcagcaaactttcaatctattctctacaaaggactcgtcagttgcttgggacgagagattgctggacaagctgtatactgagctgtaccagcagcttaacgacctggaggcttgtgtgatgcaggaggtctgggtgggagggacacccttaatgaacgaagactcaatccttgcagtcaggaagtatttccaacggattactctgtaccttaccgaaaagaagtactcgccatgtgcatgggaagtggtgagagccgagatcatgaggtcttttagcagctcccgaaacctgcaagagcgactgcggaggaaagagtag

SEQ ID NO: 2623 - DNA, 570 bp, Artificial Sequence
  Description of Artificial Sequence: Synthetic coding sequence
atggcacggagcttcagcctattaatggtggttctcgttctctcctacaagagtatctgcagcttagggtgcgatctgcctcaaacacattctcttaggaatagacgcgccctgattctcttggcacagatggggcggataagtcctttcagttgccttaaggatcgccatgagttcagattccctgaggaagagttcgacggacatcagtttcaaaagacccaggctatctccgtgttacacgagatgatccagcaaacttttaacttgttttcaactgaagactcgtctgctgcctgggagcaaagcctgctcgaaaagttttccaccgagctgtatcagcaattgaacgacctggaagcatgcgtgatccaggaagtcggcgttgaggagacacccctcatgaatgaggattttatcttggctgttaggaagtatttccaacggataacgttatatctgatggagaagaagtacagcccctgtgcctgggaagtggtgagagcagagatcatgaggtccttttctttttcaaccaacctgaagaaagggctgcgccgaaaagattag

SEQ ID NO: 2624 - DNA, 570 bp, Artificial Sequence
  Description of Artificial Sequence: Synthetic coding sequence
atggcactgacattctaccttctcgttgccctggtggtcctctcctacaagtccttttcctccctgggatgtgacctgccacagacgcacagcctgggcaaccgaagggccctgattctgctcgctcagatgaggcgcatttctccattctcctgcctgaaagatagacatgattttgagtttccccaggaggagtttgacgacaagcagttccagaaggcccaggcaatctctgtcctgcacgaaatgattcaacagacattcaatctcttctcgacaaaggattctagcgccgccctcgacgagaccttgcttgacgagttttatattgagctggaccaacagttgaacgatttggaatcttgtgtcatgcaggaggtgggagtcatcgagagtcctctgatgtacgaggacagcattttggctgtgcgaaagtatttccagcgtatcaccctgtatctgacagagaagaaatattccagttgtgcctgggaggtggttcgggcagaaattatgcgaagcttctccctgtcaattaacctgcaaaagagactgaaatcgaaggaatag

SEQ ID NO: 2625 - DNA, 564 bp, Artificial Sequence
  Description of Artificial Sequence: Synthetic coding sequence
atgaccaataaatgtcttctccagattgctctgctgctttgtttctctaccaccgcgctctcgatgtcctacaatctactcggctttctgcagcggtcttcaaactttcagtgccagaaattgctgtggcaactcaatggcaggctcgaatattgtctaaaagaccgcatgaatttcgatatacccgaggagattaagcagctccagcagtttcaaaaggaagatgctgctctgactatctacgaaatgctgcagaacatattcgctatattccgccaggatagctcctctactggctggaacgagaccatcgtcgaaaacctcctggctaacgtgtatcaccagatcaaccatctaaaaacagtgctagaggaaaaattagaaaaggaagacttcactcgagggaagctgatgtcctccctgcacctcaagaggtattacgggcggattcttcactaccttaaggctaaggagtactcccactgtgcctggactattgtcagagtggaaatcttgcgaaatttttattttatcaataggttgaccggatatctcaggaattag

SEQ ID NO: 2626 - DNA, 537 bp, Artificial Sequence
  Description of Artificial Sequence: Synthetic coding sequence
atgcactcctcagcattactctgttgtcttgtactgttaaccggcgttagggcttcacccggccaggggacacaatccgagaactcctgcacgcatttccctgggaacctccccaatatgcttagggatcttagagacgcattctcccgcgtaaaaactttttttcaaatgaaagaccagctggacaacctgcttctaaaggagagcctcctggaggactttaagggttacctcgggtgtcaggcgctgtcagagatgatccaattctacttagaggaagtgatgcctcaggccgaaaaccaagatcctgacattaaggcacatgtgaacagcctgggggagaacctgaaaactctgcgcctcaggcttagacgctgccacaggtttctgccctgcgagaacaaaagtaaggcggtcgaacaagtgaaaaacgcattcaacaagctacaggagaagggcatttataaggccatgagcgagtttgacatcttcattaattacattgaggcctacatgacaatgaagattcgcaactag

SEQ ID NO: 2627 - DNA, 489 bp, Artificial Sequence
  Description of Artificial Sequence: Synthetic coding sequence
atgagatcctcccccgggaatatggaaaggatagttatctgtctcatggttattttccttggtactttagtacacaaaagcagctcacaggggcaagaccgccacatgattagaatgcgtcagctgatagatatagttgatcagctgaagaactacgtgaacgatctggtgcccgaatttctgccggcccctgaggatgtggaaacaaactgcgagtggtccgccttctcatgctttcaaaaggctcagctgaaatccgccaataccggcaataacgaacgtattattaacgtgtccattaagaaacttaagagaaagccaccttcaaccaatgcgggcaggagacagaaacataggctaacgtgcccctcatgcgactcatacgagaagaaacctccgaaggagttccttgaacgctttaagagcctgttgcagaagatgattcaccagcacctctcctctcgcacccacggctctgaagacagctag

SEQ ID NO: 2628 - DNA, 534 bp, Artificial Sequence
  Description of Artificial Sequence: Synthetic coding sequence
atgttccacgtcagctttcgatatatttttggactgcccccacttattcttgtgttattgcctgtggcatcttcagactgcgatatcgaggggaaagatgggaagcagtacgaatcagtcttgatggtgtccattgatcaactcctcgactccatgaaagaaattggttctaattgtctaaacaatgagttcaactttttcaagcgccacatttgtgacgccaataaggagggaatgtttttgtttcgggccgctcgtaagctgaggcagttcctgaagatgaactccacaggcgattttgatttacacctgctaaaggtgtcggagggcaccactatattgctgaattgcaccgggcaagtgaaagggagaaagccagccgcgctgggggaggctcaacctactaagtcactcgaggaaaacaaatctctgaaggagcagaagaagctcaatgatttatgcttccttaagagattattgcaggagatcaagacttgctggaacaagattctcatggggactaaagagcactag

SEQ ID NO: 2629 - DNA, 216 bp, Artificial Sequence
  Description of Artificial Sequence: Synthetic coding sequence
atgttccatgtgtcctttcggtacatttttgggttaccaccactgatccttgtgctgttgccagtggccagtagtgactgcgacatcgagggcaaggatggcaaacagtatgagagcgttctcatggtcagcatagaccagttactgaaccaaccctataagaaaaaagagaaaaggaccgagagaaagcagcagtcagccatgagtaataattag

SEQ ID NO: 2630 - DNA, 393 bp, Artificial Sequence
  Description of Artificial Sequence: Synthetic coding sequence
gtgtcctttaggtacatctttggccttccccctctgatccttgttctgctgccggtggcgtcttcagactgcgatattgaaggcaaggacggcaagcaatacgaatcagtgctgatggtgagcatcgatcagctgctggactctatgaaggaaattgggtccaattgcttaaataacgagtttaacttctttaagaggcacatctgtgacgctaacaaggtaaagggcagaaaacctgctgccttgggcgaggcccaaccaaccaagtctcttgaggagaataagtctctgaaggaacaaaagaaactgaatgatttatgttttctgaaacggctcctgcaagagatcaagacctgttggaacaaaatcctcatgggtaccaaagaacactag

SEQ ID NO: 2631 - DNA, 216 bp, Artificial Sequence
  Description of Artificial Sequence: Synthetic coding sequence
atgttccacgtttcattccgctacatttttggactgccccctctgattctggtgctcttgccagtggcatcatcggattgtgacatcgaaggaaaagatggcaagcagtacgaatccgtattaatggtctcaatcgatcagctgctcaaccaaccatacaagaagaaagagaagcgaacagagcgcaagcaacagtccgccatgtctaacaactag

SEQ ID NO: 2632 - DNA, 114 bp, Artificial Sequence
  Description of Artificial Sequence: Synthetic coding sequence
atgttccatgtctctttccgctatatctttggacttccccccctgatactggttctgctgcctgtcgcgtcctctgactgcgacatagaaggccaacacgaaaggaattggtag

SEQ ID NO: 2633 - DNA, 402 bp, Artificial Sequence
  Description of Artificial Sequence: Synthetic coding sequence
atgtttcacgtaagcttcaggtatatcttcggactgccacctttaatattggtgctgctcccagtcgcaagctcagattgcgatatcgagggaaaggatgggaagcagtacgaaagcgtgctgatggtctccatcgatcagcttctggattctatgaaggagattggtagcaactgtctgaacaatgagtttaactttttcaagcggcatatatgcgatgccaacaaggtgaagggtaggaagcctgctgctctgggggaagctcagccgaccaaatctctggaggagaacaagtcgctgaaagaacagaagaagctgaacgacctttgtttcctcaagaggctattgcaggagattaagacatgttggaacaagattctcatgggcacgaaggagcattag

SEQ ID NO: 2634 - DNA, 114 bp, Artificial Sequence
  Description of Artificial Sequence: Synthetic coding sequence
atgtttcatgtgtcctttcggtatatcttcggcctgccacctctgatactagtgctgctacccgtggcctctagtgattgtgacatagaagggcaacatgaacggaactggtag

SEQ ID NO: 2635 - DNA, 195 bp, Artificial Sequence
  Description of Artificial Sequence: Synthetic coding sequence
atgaaagagataggctccaattgtctgaacaacgagtttaacttctttaaaagacatatctgcgacgctaacaaggaagagaacaaatcactgaaggagcagaaaaagctgaatgatctctgttttctgaaacgattgctccaggaaatcaaaacatgttggaataaaatccttatggggacaaaggagcattag

SEQ ID NO: 2636 - DNA, 2643 bp, Artificial Sequence
  Description of Artificial Sequence: Synthetic coding sequence
atggccgagctttaccgagtgctggaggccgggaagattggcatatttgagagccctacggggactggaaaatctctgagtcttatctgtggagcactgtcgtggctacgggatttcgagcagaagaaaagagaggaagaggctcgtctgctggaaaccggcacaggtcctctccacgacgagaaagacgagtcgttgtgcctctcatcatcttgtgagggggctgccggtacacctcgccccgccggcgaaccagcttgggttacgcagttcgtacaaaagaaagaagagcgggatctggtggacagactgaaagctgagcaggctaggagaaaacaacgggaggagcgcctgcagcagctgcaacatagggtccagctgaaatatgccgcaaagaggctgcgacaggaggaagaagagcgggagaatttactccggctcagccgagaaatgctagagacaggacctgaggccgaaagactggagcagctcgagagcggcgaagaggagctagtcttggccgagtacgaatccgatgaagaaaaaaaggtggccagtcgtgtcgacgaagatgaagatgatctcgaggaagagcacatcaccaaaatttattactgctcccggacccactcccagctggctcaatttgtccacgaggtgaaaaaaagcccattcgggaaggatgtgcgccttgtgtccctcggatccaggcagaacctctgcgtgaatgaggatgtcaagtccttgggaagcgttcagctgattaacgaccgctgcgtcgatatgcagaggtcaaggcatgagaagaagaagggcgccgaggaggaaaaaccgaagcggcgccgccaagaaaaacaagctgcatgcccattctacaatcatgaacagatgggcctacttcgggatgaagccctggccgaggtgaaagacatggagcagctcctggccctgggaaaggaggctagggcctgcccctattatggttccaggcttgctataccggcggctcagcttgtggtactgccctatcagatgttgctgcatgcagccactcgtcaggctgctggtattcggcttcaggatcaggtcgtgatcatagatgaggctcacaacttgatagataccatcactggtatgcacagcgtggaagtgagcggttcccagttatgtcaggctcacagtcaactgttgcaatatgtggagagatatggcaaacggctgaaggctaaaaatctgatgtacctgaaacaaattctctatttgctggagaagtttgtcgctgttctcgggggcaatattaaacagaaccccaacacacagagcttgagtcagaccggaacagagctcaagactataaatgactttctgtttcagtctcaaattgacaacataaatttgtttaaggttcaacggtattgcgaaaaaagcatgatttccagaaaattattcggatttacagagaggtatggcgcggtgtttagcagccgagaacaacccaagctggccgggttccagcaattcctgcaaagcctgcagcctagaacaacggaagcactggcagcaccggctgacgaaagtcaggcgtctactctgaggcctgcctcccctctgatgcatatccagggcttcctggccgccttgaccaccgccaatcaagacggtcgggtcattctgtctagacaggggtccctgagccagtcaaccctgaaattcctgcttctaaaccccgctgtgcacttcgctcaggtggtgaaagagtgtagagcagtggttatagctggcggtacaatgcagcccgtttccgattttcgacagcaattactggcttgcgctggtgtcgaggctgagagagtcgtagaattttcttgtggacacgtgattccccctgataatatactcccccttgtgatttgctccgggatatctaatcagcctttagagtttacttttcagaagagagagctgcctcagatgatggacgaggtaggaaggattctgtgcaacttatgtggggtggtaccaggaggtgtggtgtgtttttttccgtcatacgaataccttaggcaggtacacgcacactgggaaaagggcggactgctgggccggctggccgctagaaagaaaatatttcaagagcccaagagcgcacaccaggtggaacaggtgctgttagcatactctcgctgcatccaggcgtgcgggcaggaacgcggccaagtcacaggtgctttgttactctctgtggtcggtggcaagatgtctgagggaattaatttcagtgataatctgggccgctgtgtcgtaatggtcggcatgcccttcccaaatatccggtctgcagaactgcaggagaagatggcttatctcgatcaaacactacctcgagctcccggccaggcccctcctggtaaggcccttgtagagaacctgtgtatgaaggctgttaaccagagcatcggcagagccatacgccaccagaaggattttgcctcagtggtgctgcttgaccagagatacgcccggcctcccgtgctggctaagctacccgcttggattagggcgagggtggaagtgaaagccaccttcggaccagcaatcgccgctgtacagaagtttcaccgcgagaagagcgcctccagttag

SEQ ID NO: 2637 - DNA, 738 bp, Artificial Sequence
  Description of Artificial Sequence: Synthetic coding sequence
atgaagaagacccagacttggattctaacgtgtatttacctgcagctcctcctcttcaaccccttggtgaagactgaggggatttgcaggaacagggtaacaaacaatgtaaaggacgttaccaagctggttgccaaccttcctaaggattatatgatcacacttaagtacgtccctggaatggacgttctgccaagtcattgttggatctcagaaatggtggttcagctttccgacagcctaaccgaccttctcgataaattttccaacatctcggaaggcctgtcgaattacagtattatagacaaactggtgaatattgtcgacgacctagtggagtgcgttaaagagaattccagcaaagacctgaaaaagagtttcaagtctccagaacctcgcctgttcacgccagaagagttttttcgtatcttcaatcggtccatagatgcattcaaggacttcgtggtcgcatcggagacatctgattgcgtggttagtagcaccctgtcccctgagaagggtaaagcgaaaaatcctccgggggacagcagcctgcactgggcagccatggctctccccgcactctttagtctgatcatagggttcgcttttggagcgctgtactggaaaaagcggcagccctctctcactagagctgtcgaaaatatccaaatcaatgaagaagacaacgaaataagcatgctgcaggagaaagaacgggagtttcaggaggtctag

SEQ ID NO: 2638 - DNA, 93 bp, Artificial Sequence
  Description of Artificial Sequence: Synthetic coding sequence
ggaatggacgtcctcgggagacctaaaatcccactggagactccagcctacacgggacagccatggcactgccagcattgcttcctgctctag

SEQ ID NO: 2639 - DNA, 3039 bp, Artificial Sequence
  Description of Artificial Sequence: Synthetic coding sequence
atgcctgcctctgcaccgccgcgccggcctagaccaccgcccccatccctgagcctgttgcttgtgctactgggtttgggcggtcggcgtctccgcgccgagccgggcgacggtgcccaaacctgggccaggttttcccggcctcctgccccggaggcagctggcctgttccagggtacattccctgatggttttctctgggcagtcggctctgctgcatatcagacagagggcgggtggcaacagcacggcaagggtgcaagcatttgggatacattcacacaccaccctttggcacccccaggcgactccaggaacgccagcctgcccctgggtgctccaagcccccttcagcctgcgactggagacgttgcctctgacagctataataacgtctttcgagatacggaggcactcagagagctgggcgttacccactaccggttcagtatatcttgggcccgggtcctccccaacggaagcgccggggtgcctaatcgtgagggcctgagatactaccggaggctcctagaaagacttcgagaattgggggtccagcccgttgtcaccttgtatcactgggatctgccacagcgcttgcaggacgcttacgggggttgggccaatagagccctggctgatcattttagagattatgcggaactctgcttcagacacttcggaggccaggtgaaatattggatcacgatcgataatccatacgtggtggcctggcatggatatgctaccgggagactggcgccgggaatccgcgggtctccccggctcggatatttagtcgcacacaatctgctgctggcccacgccaaagtgtggcacctctacaatacctcctttaggccgacgcagggaggccaggtcagcatcgcactgagctctcattggataaatccacggaggatgaccgaccactccatcaaggagtgccaaaagagtctggattttgtgcttggatggttcgcaaaaccagtctttatcgacggcgattaccctgaaagtatgaaaaacaacctgagctctattctgcccgatttcactgagagtgaaaagaaatttataaagggaactgcggatttttttgctctatgtttcggacctaccctctcgttccaactgctggatcctcatatgaagttccggcagctagagtccccgaacctgagacaactcttgagttggatagacctggagtttaaccatccccagattttcatcgttgaaaatggctggttcgtatctggtacgacgaaacgtgatgacgccaagtatatgtactacctgaaaaaatttattatggagacccttaaagcgatcaagttggatggcgtcgacgttatcggatacacagcatggtccctcatggatggttttgagtggcacagaggttacagtattcgacgagggctcttctacgtcgactttctgagtcaggataagatgcttctgccgaaatctagcgctctgttctaccagaagcttatcgaaaagaatggcttccctcctctgcccgagaatcagcccctggagggtacattcccatgcgacttcgcctggggcgtggtggataactatattcaggtcgacactacgctgagtcagtttaccgacctgaacgtctacctgtgggatgtgcaccatagcaagcggttgatcaaggtggatggggtagtgacaaaaaaacgaaagtcttattgcgtcgatttcgctgcgattcagcctcagatcgcgcttttacaggagatgcatgttacacactttcgatttagcttagactgggccttgattctgcccctgggcaaccaatctcaggttaatcataccatcctgcagtattaccggtgcatggcttcagagttggttagggtcaatattactcccgtggtggctctctggcagcccatggcccccaaccagggtctgcctagactcctggcccgacaaggcgcctgggaaaatccgtacaccgcactggcattcgccgaatatgcacgtttgtgttttcaggagctggggcatcatgttaagttatggatcaccatgaatgagccatataccaggaacatgacctattccgccggacacaacctcctgaaggcacatgccctggcctggcatgtgtataatgagaagtttaggcacgcccagaatggtaaaatctctatcgcgctgcaggccgactggatcgaacctgcctgtccattcagccagaaggacaaagaagtcgccgaaagagtgttggaattcgatattggctggcttgctgagccgatttttgggagcggtgattacccctgggtaatgcgggactggctgaatcaaaggaacaactttttacttccttactttaccgaggatgaaaagaagctgatccagggtaccttcgatttccttgccctcagtcactacaccacgatcctggtggattcggaaaaagaggatccaatcaaatataatgattacctggaggtgcaggagatgacagatatcacttggctcaactcaccttcacaggtcgccgttgtcccttggggtttgcgtaaagtcctgaattggctaaaattcaagtatggcgatcttcccatgtacattatctctaatggcatagatgatggtcttcacgcagaagacgaccagctcagagtttattatatgcagaactacataaatgaagctcttaaagctcacatcctggatgggatcaacttgtgtggctacttcgcctacagctttaacgataggacggccccccgtttcgggttgtaccgctatgctgccgatcagttcgagcccaaggcaagcatgaagcactaccgtaagatcatagattccaatgggtttccaggcccggaaacactggagcggttctgtccagaggagttcacggtatgcacagagtgttctttcttccacacgaggaaatccttgcttgctttcattgcttttttgttttttgcttcaattatctctttaagtcttatattttactattccaagaaaggacgccggtcttataaatag

SEQ ID NO: 2640 - DNA, 729 bp, Artificial Sequence
  Description of Artificial Sequence: Synthetic coding sequence
atgactgaccactccattaaggaatgtcagaaatctctggactttgtactggggtggtttgctaagcccgtgttcatcgacggtgactacccagagagcatgaagaataacctaagcagcattcttcccgacttcaccgagtctgagaagaagtttatcaaaggcaccgccgattttttcgccctctgcttcggccccacactctcttttcagttattggacccccatatgaagttccgccagctagagtctccaaacctccgccagttactctcctggattgacctggaatttaatcacccacagatcttcatcgtggagaacgggtggttcgttagtgggaccactaagcgtgacgacgcaaaatacatgtattacctgaagaagttcattatggagaccctgaaagctataaagctcgacggggtggatgtcataggttacaccgcctggagccttatggacggcttcgagtggcaccggggttacagcatccgacgaggcctgttctatgtggatttcctgtctcaggataaaatgttgctgcctaaaagtagtgccttattctaccagaaacttatcgaaaagaacggctttccacccctacctgaaaaccaacccctggaaggcacgttcccctgtgacttcgcatggggcgtggtggataattatatccaggtgtcacagctcactaagccgattagctcgctgactaaaccctaccactag

SEQ ID NO: 2641 - DNA, 1440 bp, Artificial Sequence
  Description of Artificial Sequence: Synthetic coding sequence
atgcgacagcctccaggggagtcagatatggctgtttccgacgccctgctgccttctttttctacattcgcttcagggccggctgggagggaaaaaacactcagacaggccggggcccccaataatagatggagggaggaacttagccacatgaagagactccctcctgttctgccggggcgtccatatgaccttgcagccgcgaccgtggccacagacctggaatccgggggagccggtgctgcctgcggaggatccaatttagcaccactgccccgccgggagacggaagagtttaacgacctcctcgatttggactttatcctcagcaattccctcacacatcctcccgagagcgtcgcggccaccgtctcatcctcagcctccgcctcatcttccagcagccccagcagcagcggtcctgcgtctgccccatccacctgctccttcacctaccccatccgcgctgggaacgatccaggcgttgcgccgggaggcaccggcgggggcctgctgtacggacgcgaaagcgccccgcccccaaccgcaccgttcaatcttgccgatattaatgacgtgtctcccagtggcggctttgtcgctgagctactgaggcccgaactggatcctgtctatattccccctcagcagccccaaccaccaggtggaggtctcatgggcaaatttgttctaaaggcctctctgtctgcccctggaagcgaatacgggtccccatccgtgattagtgtgagcaaaggttcccctgatggatcccatccagttgtagtggccccatacaatggaggcccaccccgtacgtgcccaaaaataaagcaggaggctgtatcatcttgtactcacctgggtgcggggcccccattgagcaatgggcaccggcccgcagctcacgatttccctcttgggagacaactcccttccaggacgacgccgactctgggactcgaggaagttctttcatctagagattgccatccggccctcccactaccaccaggttttcacccccatccaggacctaactacccatcctttttacccgaccaaatgcaaccccaggtaccaccactgcactatcaggaacttatgccgccgggcagctgcatgccagaagagcctaagcccaagaggggtagacgtagttggccgcgtaaacggacggccacccacacttgcgactacgccggatgtggcaagacctacacaaagagttcgcatctcaaggctcatctacgtacgcacacaggggaaaagccatatcactgcgactgggacgggtgcggatggaagttcgctcgaagtgacgagctcacccggcattatcgtaaacacaccgggcatcgacccttccagtgccaaaagtgtgatcgtgcctttagccgtagcgatcacctcgcactccacatgaagcggcatttttag

SEQ ID NO: 2642 - DNA, 699 bp, Artificial Sequence
  Description of Artificial Sequence: Synthetic coding sequence
atggcagtctccgatgctctattgccgagcttctccacctttgctagcgggccggcaggtcgcgaaaagaccctgaggcaagccggcgccccaaataacaggtggagggaggaactcagtcatatgaaacgtctgccccccgttcttccaggcaggccgtacgatctagcagccgctactgtcgcaaccgatctggaatccggtggagccggcgcggcctgtggcgggagcaatctcgcgcctttgccaagacgcgagaccgaagagtttaacgatctcctcgacctagactttatcctgagcaacagcctgacacacccacccgagagcgtggccgctaccgtgtctagctccgcgtccgcctcatctagcagttctcccagtagttcaggccctgcctcagcgccgtccacctgctccttcacctacccaatccgggctggtaatgaccccggcgtggcccctggtggaaccggcggtggtctcctgtatggacgggaaagcgcccctccccctactgccccctttaatctcgcagatatcaacgatgtttcaccctccgggggttttgtcgctgagttgcttcgtcccgagcttgaccccgtctatatcccacctcagcaaccgcaaccacccgggggcggcctgatgggaaagttcgttctgaaggcgtctctatctgctccagggagtgagtag

SEQ ID NO: 2643 - DNA, 69 bp, Artificial Sequence
  Description of Artificial Sequence: Synthetic coding sequence
atgcgacagccacccggggagagcgacatggcagtgagtgacgccctgctccccagcttctcaacatag

SEQ ID NO: 2644 - DNA, 117 bp, Artificial Sequence
  Description of Artificial Sequence: Synthetic coding sequence
atgcggcagcctcccggggaatccgatatggccgtgtccgatgcgcttttgccgtccttcagcacatttgcctctggtccggccggacgggagaaaacgcttcggcaagcgggatag

SEQ ID NO: 2645 - DNA, 1323 bp, Artificial Sequence
  Description of Artificial Sequence: Synthetic coding sequence
atgggtcccccagggtcaccatggcagtgggtgaccctgttactcgggctgctgctgccaccagccgcccctttctggctgctgaacgtgctgtttcccccgcatacaactccgaaggcagagctgtccaaccatactcgcccagtgatacttgtgcctggatgcctcggaaaccagctcgaggctaagctcgacaagcctgatgttgttaactggatgtgctacagaaaaaccgaggacttttttaccatctggctggatctcaatatgtttcttcccctgggcgttgactgttggattgacaacaccagagtggtgtataacagatcttccggactagtctcaaatgctcctggggtacaaattcgggtgcctgggtttggaaagacatacagcgtggaatacctcgacagtagcaagctggccggctacctacacacacttgtgcagaacctcgtgaataatgggtacgttcgagacgagaccgtaagagccgccccatatgactggaggcttgaacctgggcagcaggaagagtattatcggaagctggctggccttgtcgaggaaatgcatgcagcttatgggaagcccgtctttcttataggccatagtctgggctgtctgcacctgctgtacttcctgttaaggcagccccaggcatggaaggaccgctttattgatggcttcatctcgttaggcgccccgtgggggggaagcattaagccgatgctggtcctcgccagtggcgataaccagggaatacccatcatgtcctctataaagcttaaggaggagcagcggatcactactacgagcccttggatgttcccttcaaggatggcctggcctgaagatcatgtgtttatcagtacacccagctttaactacacgggtcgcgactttcaacggttttttgccgatcttcatttcgaggagggatggtacatgtggcttcaatcccgagatcttctcgccggattgcccgcaccaggggtggaggtctattgcttgtacggcgtcggattacccactcctcgtacatacatttacgatcacggctttccatatacagaccccgtcggagttctgtatgaggatggcgacgatacggtcgccacccgttctaccgagttgtgtgggctgtggcaaggaagacagccccaaccagttcatctattgccactccatggtatacagcacctcaacatggtgttctcaaatttgacgctcgaacacatcaacgctattctccttggagcttatcgccagggaccaccagcctcaccgacagccagccccgaacctccaccgcctgagtag

SEQ ID NO: 2646 - DNA, 753 bp, Artificial Sequence
  Description of Artificial Sequence: Synthetic coding sequence
atggccgacaacttttcacttcacgatgctcttagcggtagtggcaatccaaatcctcaaggttggccaggagcttgggggaaccagccagctggcgctggtggttatccaggagcttcttatcccggcgcttacccaggacaagctccacctggggcctatcctggccaagccccacctggcgcttaccctggtgcacctggagcctaccctggggctcctgctccaggcgtatatcctggccccccttcaggacccggtgcctacccatcttctgggcagccctcggcgaccggagcctaccccgcaacggggccatatggggcacctgcaggccccctgatcgtgccctataatctcccactgccaggaggtgtggtgcccagaatgctgatcacgattcttggcaccgttaaaccaaatgcaaacagaatcgcgttagacttccagaggggcaacgacgtcgcgtttcattttaaccctcggtttaacgagaacaacagaagggtgattgtttgcaacactaagctggataacaactggggacgcgaagagagacaatccgtctttccattcgagtcgggaaagcccttcaagatacaggtactcgtggagccagaccatttcaaagtggccgtcaacgatgcacaccttttgcaatacaaccacagagtgaagaagctgaacgaaatctccaagctggggatcagcggggatatagacctgactagcgcctcctatacaatgatatag

SEQ ID NO: 2647 - DNA, 630 bp, Artificial Sequence
  Description of Artificial Sequence: Synthetic coding sequence
atgggcagcgttagtaatcagcaattcgcaggcgggtgtgccaaggctgccgaagaggctccggaggaagctcctgaagacgccgcccgcgccgctgacgaacctcaactactccatggtgcgggaatttgcaagtggttcaacgtgcggatgggctttggtttccttagcatgacagcaagggccggggtagcgcttgatcccccggtggacgttttcgtgcaccaatctaaactccatatggaaggattccgtagccttaaagaaggtgaggctgttgaattcacctttaaaaagagtgcgaaaggtctcgaatcaattcgggtcaccgggcctggaggagtgttctgcatcggctccgagcgccggcccaaggggaagtccatgcagaagcgtcggtccaaaggcgaccggtgttataactgtggcggtctagatcaccacgccaaggaatgcaaacttccaccacagcccaaaaaatgtcacttttgtcaatccatttcccacatggtggccagttgtccattgaaagcacagcaggggccatcagcccagggaaaacccacatacttccgagaagaagaagaggaaattcattcgccgacgttactgcccgaagcgcagaactag

SEQ ID NO: 2648 - DNA, 630 bp, Artificial Sequence
  Description of Artificial Sequence: Synthetic coding sequence
atgggttccgtgagtaatcagcagttcgctggcgggtgcgccaaggcggctgaagaagctccagaggaggcacctgaagacgccgcccgagcagctgacgagccacagctccttcacggagcggggatttgcaagtggttcaatgtgaggatgggctttggcttcctgtccatgaccgccagagccggcgtagcgctggacccacctgtcgacgtgtttgttcaccagagcaagctacatatggagggctttaggtcgctcaaggaaggcgaggccgtagaatttacctttaagaagtccgctaagggtctagagagtattcgcgtgacagggcccggcggcgttttctgtatcggcagtgaacgtcggcccaagggcaagtctatgcagaaacgacgatccaagggggatagatgctacaattgtgggggcttggatcaccacgccaaagaatgtaaactgcctcctcaaccaaaaaagtgtcacttctgccagtccatcagtcacatggtcgcaagctgtcccctcaaagcccagcaggggccaagcgcacagggtaaacctacctacttccgcgaagaagaggaagagattcacagcccgactttgctgcccgaggcccagaactag

SEQ ID NO: 2649 - DNA, 660 bp, Artificial Sequence
  Description of Artificial Sequence: Synthetic coding sequence
atgaaaatgaggttcctagggctcgttgtgtgtctagttctctggacattacattcagaaggttccggcggaaaactaaccgccgtggacccagagactaatatgaacgtcagcgagattattagttattggggctttcccagtgaagaatacctggtagaaacagaggacggttatatcttgtgtctcaacagaatcccccacggccgcaagaaccatagtgacaagggtcctaagcccgtggtctttctccaacacgggctgcttgcagattcctcaaattgggtaaccaatctcgccaattctagtctaggttttatcctggctgacgccgggtttgacgtttggatgggcaacagcagaggaaatacatggtctcggaagcacaagaccctgtcggtctctcaagacgagttctgggccttctcttacgatgagatggctaagtacgatctgcccgcaagcatcaattttatattgaacaaaacaggccaggaacaggtctactacgttggccattcccagggtactacaattgggttcattgcctttagtcaaataccggaactggccaagagaattaagatgttcttcgcccttgggcctgtcgcctccgtcgcattttgtacaagccccatggccaaattaggtcgcctgtag

SEQ ID NO: 2650 - DNA, 1200 bp, Artificial Sequence
  Description of Artificial Sequence: Synthetic coding sequence
atgaaaatgcgcttcctgggcctagtggtgtgcctggtcttatggacgcttcactcggagggctcagggggcaagctcacggccgtggatccagagactaatatgaatgtgtccgaaattatctcatactggggattcccttccgaggaatatctggtggaaaccgaggatggctacattctgtgcctgaacaggatccctcacggaaggaagaatcactcggacaaggggccgaagccagtggttttccttcagcacgggctgttagccgatagtagcaactgggtaactaatctagcaaactcctccttgggatttatcctggccgacgccgggtttgatgtttggatggggaactctcgagggaatacatggtccaggaaacacaaaaccctttctgtgtcccaggacgagttctgggccttctcctacgatgaaatggccaaatacgacctcccagcatcaataaacttcattttaaataagacagggcaggagcaagtgtactacgtcggccattctcagggcactacaattgggttcattgcattcagtcagatacccgaacttgccaagcgaatcaaaatgttcttcgccttggggcctgtcgccagcgttgccttctgcacatcacctatggccaagcttgggcggctgcccgatcatttaatcaaggacctgtttggcgataaagaattcctcccccaatctgcatttctgaagtggcttgggacccatgtatgcacccacgtgattctgaaagagctgtgcggcaacctctgttttttgttatgcggttttaacgagcgcaatttgaacatgtcccgcgtggatgtttacaccactcactcaccagccgggacatcggtgcagaacatgctccactggtcccaggccgtcaaattccagaagttccaagcctttgactggggctccagtgccaagaattatttccactacaaccagtcataccctccgacatacaatgtcaaggatatgctcgttcctacagccgtatggtcgggagggcacgattggctggctgacgtctatgatgtaaacatcctgttaacacagatcacgaatctcgtttttcatgaaagcattcctgagtgggaacatctcgatttcatctggggcctggacgcaccatggcgcctttacaataagatcatcaatctgatgaggaaataccagtag

SEQ ID NO: 2651 - DNA, 1074 bp, Artificial Sequence
  Description of Artificial Sequence: Synthetic coding sequence
atgaagcttagaaccctggccgtgagcgctaccgtcgtaaaggatggtgtgtcaggcgtctgcagctttaggtgctcagacgtttctggggtcctcccttcaggcccaaagccagtggtgttcctgcaacacggcttgctcgccgacagtagcaattgggtgaccaatctcgctaacagcagtctcggctttatacttgccgatgccgggtttgatgtgtggatggggaacagccgaggaaacacctggtctagaaagcacaagaccctcagcgtgtcccaggacgaattctgggccttttcctacgatgaaatggcaaaatacgaccttcccgcctctattaatttcatcttgaataagacaggtcaggaacaggtatattacgtgggccactctcaggggactacaattgggttcattgccttttcacagataccagagctcgccaaacggattaagatgttctttgccctgggccctgttgcatccgtcgccttttgtaccagccccatggccaagcttggacgattgcctgaccatcttatcaaagatctttttggagacaaggagtttctcccccagtctgccttcctgaagtggctgggcacacacgtgtgcacacacgtgatcttaaaggagctgtgcggaaacctgtgtttcctgctctgcggctttaacgaacggaacttgaacatgtcgcgcgtagatgtatacaccacacactcacccgctggaacctccgtgcaaaacatgctacactggtcccaggcggtgaagttccagaaattccaggctttcgattggggctcttcagcaaaaaactactttcactacaaccagagctatcctcccacctacaacgtcaaggatatgctagttccaaccgccgtgtggtctggtggtcacgattggctggcggatgtgtatgatgtgaatatcctccttacacagataacaaatctggtattccatgagagtattcctgaatgggagcatttggacttcatctggggtctggacgcaccttggcgcttgtacaataaaatcatcaatcttatgcgtaaatatcagtag

SEQ ID NO: 2652 - DNA, 1200 bp, Artificial Sequence
  Description of Artificial Sequence: Synthetic coding sequence
atgaagatgcgattcctcggtctcgttgtgtgcctggttctgtggactcttcactctgagggcagcgggggaaagctcaccgcggtagacccagagactaacatgaacgtcagcgaaattatcagttattgggggtttcctagcgaggagtatctggtagaaaccgaggacggttacatcttgtgtttgaatcgcatacctcatggccgaaagaaccacagtgacaagggacctaaacctgtggtctttctgcagcatggcctgctggccgatagtagtaactgggtgaccaacttggccaacagctctctggggttcatcctggctgatgccggattcgatgtctggatgggaaattcccgaggcaatacttggagccgtaagcacaaaaccctttctgtcagccaggatgagttctgggccttctcatatgacgagatggccaaatatgaccttcccgcttcaattaacttcattttaaacaaaacaggtcaggaacaggtgtactatgtgggacattcccaagggaccacaatagggtttattgcattttcgcagataccggaacttgcgaaacgcattaagatgttcttcgcccttggccccgtcgcttccgtggccttctgcaccagcccaatggctaagctcgggcgcctccccgaccatctgattaaggatctgtttggggataaggagttcctgccacagtcagccttcctgaagtggcttgggacacatgtctgtacccacgtgatcctgaaagaactgtgtggcaatctgtgtttcttgttatgcggattcaacgaacggaaccttaatatgtctagagttgacgtatatacaactcacagccctgccggcacgtctgttcagaatatgctccactggagccaagctgtcaaatttcagaaattccaggcctttgattggggtagttctgctaagaattacttccattacaatcagtcttacccacctacctacaatgtaaaagatatgttggtcccaaccgcggtgtggagcggtggccacgactggctggcggacgtatacgacgttaatattctgctcactcagatcaccaatctggtgttccacgagtcaatacctgaatgggagcatctcgatttcatctgggggctggatgcaccatggaggctgtacaataaaattattaatttgatgaggaaataccagtag

SEQ ID NO: 2653 - DNA, 1032 bp, Artificial Sequence
  Description of Artificial Sequence: Synthetic coding sequence
atggcgtgtctcgaatttgtcccttttgatgtgcagatgtgcctggagttcctacccagcggtcctaagcctgtggtgtttctacaacatggcttactggccgactcttccaactgggttactaacctggcgaattcctctctgggtttcattctcgcggacgcgggatttgacgtttggatgggcaatagtcgaggcaacacctggtcaagaaagcacaagactctgtccgtgtcccaagatgaattttgggcattttcctatgacgagatggccaagtacgacttacccgccagcatcaatttcatcctcaacaagacaggacaggaacaagtttattacgtgggccacagccagggcacaactatcggattcattgcgttctctcaaataccggagctcgcaaagagaataaagatgttcttcgccctggggcccgtcgcctcggtagcattctgcacctcacccatggccaagttgggccgcttgccagaccatctgattaaagacctattcggcgacaaggaatttctaccccagagcgcctttctcaagtggttaggcacccatgtgtgtacacatgttattctgaaggagctgtgtggaaacttatgcttcctactctgtgggttcaacgaacgcaaccttaatatgagtcgagtggatgtctacaccacacattcaccagcaggcactagcgtgcaaaatatgttacactggtcccaggcagttaagttccagaagttccaggcattcgattgggggtccagtgcaaagaactatttccattacaatcagagttaccctccaacttataacgtcaaggacatgttggttcccactgctgtgtggtctggaggacatgattggctcgctgatgtatatgatgtcaatatacttctcactcagattacaaatctcgtttttcacgaatcgattccagagtgggagcaccttgacttcatttggggtcttgacgctccttggagactctataacaagatcataaatcttatgcgtaaatatcagtag

SEQ ID NO: 2654 - DNA, 1206 bp, Artificial Sequence
  Description of Artificial Sequence: Synthetic coding sequence
atggcatgcctggagttcgtgccctttgacgtgcagatgtgtcttgaatttctgccttcaggcgaattcgtcgttttgctcacatccggcgtacagctgcaaaccttcactgtatcagtgaccgaccttaaggggggcgcatctggcgttgtccggtcctctcggtgggtaagggggtttaccgattttcggtccaaggcagtggatctgtgtgggcctaaaccagtggtgttcttgcagcacgggttgctggcggattcctctaattgggtgacgaatttagccaacagctccttgggcttcatcttagctgatgctggatttgacgtctggatgggtaatagtagaggaaacacttggtcaaggaaacacaagactctctcagtcagccaggatgagttctgggcttttagggtgcccttcctggattattcatacgatgagatggctaaatacgatctgccagcttcaatcaacttcattctgaacaaaacaggccaagagcaggtgtactacgttggacatagtcagggaaccactatcggatttatcgccttcagtcagattcctgaactagcaaaacgcattaagatgtttttcgcccttgggccagtcgccagtgtcgccttttgtactagccccatggcaaagctcggccgtctgcccgaccatcttatcaaagatctgtttggcgacaaagagttcctgccccagagcgcttttttgaaatggttaggcacccacgtctgcacgcacgtcatcttgaaagaactgtgcggcaacctttgttttctgctgtgtgggtttaatgagcggaacctaaatatgagtcgtgtagacgtctacaccactcattcccctgctggcaccagcgttcagaacatgctgcactggtctcaggctgtaaaattccagaagttccaggcctttgactgggggtcatccgccaagaactatttccattacaaccaatcctacccccctacctataacgtgaaagatatgttggtaccaacagcggtatggtctggtggacatgactggttagccgatgtctacgacgttaacatcctgctcacgcagattacaaacttagtcttccacgagtcgatacctgagtgggaacacctcgatttcatttggggacttgatgccccctggcggctgtataataaaattataaatctgatgcgtaaatatcagtag

SEQ ID NO: 2655 - DNA, 873 bp, Artificial Sequence
  Description of Artificial Sequence: Synthetic coding sequence
atgaaaatgaggttcctgggtctggtggtctgcctggtcctatggacgctgcactctgagggctccggtggcaaactaacagctgttgacccagaaacgaatatgaacgtctccgagattatctcttattggggatttccctctgaagagtaccttgtggaaacagaagatggctatattctgtgcctgaatcgaattccccatggccgcaagaatcatagcgacaagggaccaaagccagtcgtgttccttcagcacggtctcctggccgactccagcaactgggtgaccaatttggcaaactcaagccttgggtttatactggccgatgctggatttgacgtctggatggggaattcacgcggtaatacttggtcccggaagcacaaaactctctcagttagccaggacgagttctgggccttcagctacgacgagatggccaaatacgatttgcccgcctcgattaattttattctgaacaagactggccaggagcaggtatattatgtcggacattctcaaggtacgaccattggcttcatcgcattctcacagattccggagctggccaagagaatcaaaatgttcttcgccctgggcccagtcgcttcagtcgcattctgtacgagtccaatggcaaaactggggaggcttcctgaccatctgattaaggatctgtttggggataaagaatttctgccacagtctgcttttctcaaatggctgggcacacacgtgtgcacccacgtgatcttgaaggaactgtgcggcaatttgtgtttcctgttgtgtgggttcaatgagcgcaatctcaacatgagccgcgtcgacgtctatacaactcactcaccggccggcacctcggtgtag

SEQ ID NO: 2656 - DNA, 1200 bp, Artificial Sequence
  Description of Artificial Sequence: Synthetic coding sequence
atgaagatgcgctttctgggacttgtggtgtgtttagtgttatggactctgcacagcgagggcagtggcggcaaactgaccgccgtggatcccgagacgaatatgaacgtttcagaaattatcagctattgggggttcccatccgaagagtacctagtcgagactgaagatggatatatcctttgtctgaatagaattccacacgggcgaaagaaccattctgacaagggcccaaagcccgtggtcttcctgcagcacggtcttctcgctgactcttccaactgggtgaccaacttggccaattcttcgctcggatttatcctggctgatgcgggcttcgatgtttggatgggcaattcccgcggtaacacttggtcaaggaaacacaaaaccttgagcgtgagtcaggatgaattttgggcattctcttacgacgaaatggctaagtatgacttgccagccagcatcaatttcatactcaacaagacagggcaagaacaggtgtattacgtgggtcattcccagggtacaacaattggctttatcgctttttcccagatccctgagcttgccaagagaatcaagatgttcttcgcgctgggccctgtggcctccgttgcattctgtactagcccaatggccaaactgggtaggttgcccgaccacctgattaaagacctcttcggcgataaggaattccttccgcagagcgcattcctgaaatggctgggtacccacgtgtgtacgcacgttattctcaaagaattgtgcggcaatctgtgctttctgctctgcggattcaatgagaggaacctaaacatgagcagagtggatgtatacactacccattcaccagctgggacttccgtccagaacatgctacattggagccaggctgtcaaatttcagaaatttcaagctttcgactggggctccagcgctaagaactattttcactataatcaaagttaccctccaacgtacaacgtgaaagacatgctcgtgcctacagctgtttggtcagggggacatgattggctggccgacgtatacgatgttaatattctgctgactcagataaccaatctggtgtttcacgagagcatcccggaatgggaacatttggattttatctggggccttgacgccccttggagactctataataaaatcatcaacctaatgcgtaagtatcaatag

SEQ ID NO: 2657 - DNA, 87 bp, Artificial Sequence
  Description of Artificial Sequence: Synthetic coding sequence
ctgtgcttcctcttgtgcggttttaatgaaaggaaccttaatatggccgtgaagttccagaagttccaggccttcgactgggggtag

SEQ ID NO: 2658 - DNA, 1200 bp, Artificial Sequence
  Description of Artificial Sequence: Synthetic coding sequence
atgaaaatgaggttcctcggcttggtggtgtgccttgtgctgtggaccctacactcagagggatcgggcgggaaattgactgctgtagatcccgaaaccaatatgaatgtttcggaaattattagttactggggcttcccgtccgaggagtatttggtggaaaccgaggacggctatattctttgccttaataggataccccacggcagaaaaaatcacagtgataaggggccaaagcccgtggtgttcctgcagcacgggttactggccgatagctcaaattgggtcaccaacttagcaaacagctccctgggatttattctcgcagacgccggttttgatgtgtggatgggaaactccagagggaatacatggtctcgcaagcataagactttgagtgtgtcccaagacgaattctgggccttttcttacgacgaaatggctaagtacgacctgcccgcctcaatcaacttcattttgaataaaacaggacaggagcaggtctactatgtgggacattcacagggcaccactataggtttcatcgccttttcacagatcccggagcttgccaaacggatcaagatgttctttgcccttggtcccgttgcatctgtggcgttttgcacatccccaatggcaaaactgggtagactgccagaccatctgattaaagacctgtttggtgataaggagtttctgccccagtccgccttcctgaaatggcttgggacacacgtgtgtacgcacgttatattgaaagagctgtgcggaaacctgtgctttttgttgtgcggtttcaacgaaaggaatctcaatatgtcacgtgttgacgtgtatactacgcactcacccgctggcacatccgtacaaaatatgttgcattggtcgcaggcagttaagttccagaaattccaagccttcgactgggggtctagtgcaaagaattactttcactacaatcagagctacccacctacttataacgtcaaagatatgcttgtgccaacagcggtttggagtggcgggcacgactggctggcagacgtgtatgacgttaacatactgctgacccagattacaaatctggtattccacgagtctatcccagaatgggaacatctggactttatctggggcctggatgccccatggagactgtataacaagataatcaatctaatgaggaagtaccaatag

SEQ ID NO: 2659 - DNA, 411 bp, Artificial Sequence
  Description of Artificial Sequence: Synthetic coding sequence
atgaagatgagatttctcggcttggtcgtttgcctggtgttgtggaccttacatagcgaaggtagcggtggtaagctgaccgccgtggacccagagacaaatatgaatgtaagtgagatcatcagttattggggctttccatcggaggaatacctggtggagaccgaagatgggtatatcttgtgtctcaatcggatcccgcatgggaggaaaaaccatagcgataagggtcctaagccagtggtgtttttacagcatggactgcttgccgattccagcaattgggtaacaaacttggcgaattctagccttggattcattctcgcagacgccggattcgacgtatggatgggaaatagtcgcggcaatacctggagccgcaagcatgtaacactagagcctgggtgctag

SEQ ID NO: 2660 - DNA, 1428 bp, Artificial Sequence
  Description of Artificial Sequence: Synthetic coding sequence
atggagtccaaagcactgctcgttctcaccctagcagtgtggctgcagagcctgactgcctcgcggggaggagttgctgcggccgaccagcgccgggactttatcgacatcgagtctaaattcgccctgcgcaccccagaggatactgccgaagacacctgtcatctaatcccaggggttgccgagagcgtagccacatgccatttcaaccactcttccaaaacattcatggtcatccacggttggacagtgactggtatgtacgagagctgggtgccaaagctcgtggcagctctgtacaagagagaaccggattctaacgtgatcgtcgtggattggctgagcagagcccaggaacactatccagtgtctgccgggtatacaaaactcgtcggccaggatgtggccaggttcattaactggatggaggaagaattcaattaccctttggacaacgttcatctgcttgggtactcactgggtgcacatgccgccggtatcgccggttctttgactaacaaaaaggtgaacaggatcactgggttagacccggcaggccctaactttgagtacgccgaagcaccaagccggctctccccagatgatgctgatttcgttgatgtcctacacactttcacacgcgggtcccccggccgttctatcggaattcagaagccagttggccatgttgatatctaccctaatgggggtacttttcagccaggctgtaacatcggggaggccattagagttatagcagagaggggcctcggagacgtcgaccagttggtgaagtgcagtcatgaacgctcgatccatctgttcatcgattccctgctgaatgaggagaacccgagcaaggcatatagatgttcctccaaagaggcctttgagaaggggctctgcttgtcctgtaggaagaaccgatgcaacaacttgggttacgagataaacaaggtacgtgctaagaggtcttctaaaatgtatctgaagacgcggagtcagatgccctacaaggtctttcattaccaagtcaaaatacatttctctgggactgaatcagagacgcatacgaaccaagcctttgaaatcagcttgtatggtactgtggctgagagtgagaatatcccgtttacccttccagaagtttcaaccaataaaacttatagctttctgatctacactgaggtagacattggagaactgctgatgttgaaattgaagtggaaaagcgacagctacttctcctggagcgactggtggtcctcgcccggcttcgccattcagaagatcagggttaaggccggggagacgcagaagaaagttattttctgttctagggagaaggtttctcaccttcaaaagggaaaagcccccgcagttttcgtgaaatgccatgataaaagcttgaacaaaaagtccggatag

SEQ ID NO: 2661 - DNA, 348 bp, Artificial Sequence
  Description of Artificial Sequence: Synthetic coding sequence
atggtcattcatgggtggactgtgacaggtatgtatgaatcttgggtccccaaattagtcgcggctctttataagcgggagcctgatagcaacgtgatagttgtcgactggttgagtcgagcccaggagcactatcctgtgagcgcaggatataccaaattggtcggccaagacgtcgcgagatttatcaactggatggaagaggaatttaactatccccttgataacgtgcacctcctggggtactccttgggcgctcatgctgccggcatcgctggcagcttaaccaataagaaggtcaaccggattactggcctggatcccgccggcccaaacttcgagtactag

SEQ ID NO: 2662 - DNA, 321 bp, Artificial Sequence
  Description of Artificial Sequence: Synthetic coding sequence
atggaatctaaggcactactggtgctaactctcgcagtgtggctgcagagtctgaccgcctcacgagggggagttgccgccgctgaccagcggagggacttcattgacatcgaatctaaatttgcattgagaactccggaagatacagctgaggatacatgccacttaattccgggtgttgccgagtccgtcgccacttgccacttcaaccattcctccaaaaccttcatggtgatccatggatggacagttacggggatgtacgagtcttgggtgcctaaactggtcgctgccttgtacaagagagagcccgacagctag

SEQ ID NO: 2663 - DNA, 393 bp, Artificial Sequence
  Description of Artificial Sequence: Synthetic coding sequence
atggagagcaaagccttgttagtgctcacactggcggtttggctccagagcctgacggcctcaagagggggcgttgcagccgccgatcagaggcgcgatttcatcgacattgaatctaaatttgcactccgaacgcccgaggatacggccgaggacacatgtcacttgattcccggcgtcgctgagagcgtggctacttgtcactttaatcatagcagtaaaactttcatggtgattcatgggtggaccgtgaccggcatgtatgagtcatgggtacctaaactggtggcggcactgtacaaacgggagccagattctaacgtcatcgtcgtcgattggttgtcccgtgcacaggaacactacccagtgagtgcaggatacaccaagctgtag

SEQ ID NO: 2664 - DNA, 1386 bp, Artificial Sequence
  Description of Artificial Sequence: Synthetic coding sequence
atggagtcaaaagctctgcttgtgctgactctggctgcagcagatcagcgcagagactttattgatattgagtccaagttcgctcttcgtactcccgaagacactgccgaagacacctgccacctgatcccgggcgtcgccgagtctgtggccacctgccatttcaatcactcatcaaaaaccttcatggtaatccacggctggacggtcaccgggatgtatgagtcctgggtgcccaaactggtggccgcattgtataagagagagccagatagcaatgtcatagtggtggactggctttcgcgtgctcaggagcactatccggtttccgctgggtacacaaaactcgtcggccaggatgtcgcacggtttatcaattggatggaagaagaatttaattacccactggacaatgtccatctcctagggtattcgctcggagcccacgctgcaggtatcgctggctcactgacgaacaaaaaggtgaaccgcatcaccgggctcgacccggcgggtccaaactttgaatatgccgaggctcccagtaggcttagtccagacgacgccgatttcgtggacgtcctgcataccttcacaaggggcagtccggggaggtcgattggcattcagaagcccgtgggccacgtggacatatatccaaatggtgggacctttcagcccggatgcaatatcggagaggcgattagggtcatcgccgaacggggtcttggcgacgttgatcagctagttaaatgcagtcacgagcgcagtattcatttatttatagattctctcctcaacgaagagaatccctcgaaggcctatcggtgtagctctaaggaagcttttgagaagggactgtgccttagttgcaggaagaaccgatgcaataatctgggctatgaaatcaataaggtgcgagcaaagagaagctcaaaaatgtacctgaagacccgcagccagatgccatacaaagttttccactaccaagtgaagattcatttctctggcacggagagcgagacacacactaaccaggccttcgagatatcgttatatggcacagtcgcagaatctgagaatatcccatttacgcttcccgaagtatctacaaacaagacatactcattcctgatatacaccgaagtggacattggagagctactgatgttgaaattgaagtggaagagtgactcctatttctcttggagcgattggtggtcgtctcccggcttcgctatccagaaaatacgcgtaaaggcaggtgaaacccagaaaaaggtcattttctgctcaagagaaaaggtcagccacctacagaagggcaaggcccctgcagttttcgtgaagtgtcatgataagtctcttaacaagaagtcggggtag

SEQ ID NO: 2665 - DNA, 828 bp, Artificial Sequence
  Description of Artificial Sequence: Synthetic coding sequence
atggtgatccacgggtggactgtcacaggcatgtacgaaagctgggtgccgaagctggttgctgcattgtataaaagagagcccgattctaatgtgatcgtggttgattggctcagtagagcccaggaacactatcctgtatccgctggatacacgaagctggtcgggcaagatgtagcacgatttatcaactggatggaagaggaattcaattatccacttgataatgttcacttactgggatactctctgggcgcacacgcagcaggtatcgctggtagcctcaccaataagaaagttaaccgaattacaggattggatcctgcagggcccaattttgagtacgccgaggctcctagcaggctctctccagatgacgctgactttgtcgatgttctgcacactttcacccgcggttcgcccggcagatccataggcatccaaaagccagtgggtcacgttgacatttaccctaacggcgggacatttcaacctgggtgcaacataggcgaggcgatcagagtcattgctgagaggggactgggtgacgtcgatcagctcgttaagtgctcacacgagaggtccatccatctgtttatcgattcgcttctcaacgaagagaatcccagcaaggcgtacagatgcagctcaaaagaggcatttgaaaaagggctatgcctgagctgtcgaaagaaccggtgtaataatttgggctacgaaatcaataaagtgagggctaagaggagctccaagatgtatgaggacagtttttccgatgccctacagtccctgccgcttcccagcaaagacagcttcttctgggattag

SEQ ID NO: 2666 - DNA, 2079 bp, Artificial Sequence
  Description of Artificial Sequence: Synthetic coding sequence
atggggccatggggctggaagctgcgatggaccgtagccttgctactggctgcggccggcaccgccgtgggcgatcgctgtgagcgcaatgaattccagtgtcaggacggtaaatgcattagctacaaatgggtatgcgacgggagtgccgagtgtcaagatggatcagatgaaagccaggagacgtgcctgagcgtgacgtgtaaatcaggcgacttctcttgcggcggcagagttaatcgctgtatcccacagttttggcggtgcgacggtcaggtggattgcgataacggatccgatgagcagggctgtctgactttatgcgaaggacctaacaaatttaaatgtcattccggcgagtgcattaccctagacaaggtgtgtaatatggccagagattgcagggattggtctgacgaaccaataaaggagtgtggcaccaacgaatgtctggacaataatgggggttgttcacacgtgtgcaatgatctgaaaataggatacgagtgcctctgcccggatggcttccagctcgtggcacagaggagatgtgaggatatagatgagtgtcaggacccggatacctgttcccagctttgtgtcaacctggagggagggtacaagtgccagtgcgaggaggggtttcagctggacccccacacaaaagcgtgcaaagctgttggcagcatagcataccttttctttacaaacaggcacgaggtgagaaagatgacattagaccgcagcgaatacacctcacttatacccaatctaaggaacgtcgtcgccctggacacagaggtggctagtaacagaatttattggtcggatctgtctcaacgcatgatctgttcgacacagctggaccgcgctcatggcgttagctcatacgatactgtgatctcgcgggacattcaggcacctgatggcctcgccgtagactggatccatagtaatatttactggactgattctgtgttaggcaccgtttctgtggctgacaccaagggcgtcaagaggaagactctgtttagggagaatgggagcaaacccagagctattgtggtagatcccgttcatggattcatgtattggactgattgggggacgcccgcaaaaatcaagaagggcggactgaatggagtggatatttacagcctggtgactgagaatatccaatggccaaacggaatcaccctggaccttttgtccgggcgactttactgggtagacagtaaactccacagcatctcttctatcgatgtaaacggagggaatcgtaaaacgattctggaagacgagaagcgattggctcaccccttttcactggcagtcttcgaggacaaggtgttttggacggacatcatcaatgaggctattttcagcgccaatcgccttaccggttccgatgtaaatcttctagccgagaatcttttgtcaccagaagatatggtgctcttccataatttaactcagccaaggggcgtgaactggtgtgagaggaccaccctgtcaaacggcggatgccagtacctgtgcctcccagcccctcagatcaaccctcatagccccaagtttacttgtgcctgtcccgacggaatgctcttagctcgggacatgaggagttgcttgaccgaggcggaggcagccgttgccacccaggaaacttcgaccgtacgtcttaaagtcagttctaccgccgtccggacacagcacacaaccacccggcccgtacccgatactagtcggttgcccggggctacgcctggacttactaccgtggagattgtgaccatgtctcaccaggcgctgggcgacgtggccgggcggggaaatgaaaagaaaccatccagtgtcagggcactgtctatcgtgttaccaatagtgctgttggttttcttgtgtttgggagtgttcttgctttggaagaattggagactcaagaatataaattctataaatttcgataaccccgtctatcagaaaaccaccgaagacgaggtgcatatttgccacaaccaagacggctatagctacccaagccgccagatggtaagcctggaagacgatgtagcttag

SEQ ID NO: 2667 - DNA, 2460 bp, Artificial Sequence
  Description of Artificial Sequence: Synthetic coding sequence
atggggccctggggttggaagctgcgttggactgtggctttgctgctagctgctgccggaacagccgttggggatcggtgcgagcgcaacgaattccagtgtcaggacgggaaatgtatcagctacaaatgggtctgtgatggctccgctgagtgtcaggatggcagtgatgagtcacaagaaacctgctcaccgaagacgtgttctcaggatgaattcaggtgccacgacggcaagtgtatctcccgccagttcgtgtgcgatagtgaccgggactgcctagacggatccgacgaggcatcctgtccagtccttacttgcggcccagcgtcattccagtgtaactctagcacctgcattcctcagctgtgggcatgtgataatgaccccgactgcgaggatggttctgacgagtggcctcagcggtgcagaggactctatgtgttccagggagattcctctccgtgctctgcctttgaattccactgcctgagtggggaatgtatccactcttcatggcgttgtgacggaggacctgattgcaaggataagtcggacgaggaaaattgtgcggtggctacctgtcgcccagacgagtttcagtgcagtgatggcaactgtatccacgggagcagacagtgtgacagggaatacgattgtaaggacatgtctgatgaggtggggtgcgtcaatgtgaccctgtgtgagggtcccaataaatttaaatgccacagtggtgagtgcatcacgctggacaaggtgtgcaatatggccagggattgtcgggattggtccgatgagccgattaaggaatgtggaaccaatgagtgtctcgataacaacggaggatgcagccatgtgtgcaacgacctgaaaattggatatgaatgcctgtgtcccgacggatttcagctggtagcccagcggaggtgcgaggatattgacgagtgtcaggatccagatacctgcagccagctttgtgtgaatcttgagggcggttataagtgccagtgtgaagaagggttccagcttgacccacacacaaaagcttgcaaggcggttggcagcatcgcgtatctgtttttcacaaacaggcatgaggtgcggaaaatgactctggataggagtgaatacactagccttattcccaacctcagaaacgtggtagcactggataccgaggtggcgtctaaccgaatttactggagcgacttgagccagcggatgatctgcagtactcagcttgatagggcccatggtgttagctcttacgacacagtgatatccagggatatccaagctccagatggcctggcagtggactggattcactctaacatctactggacagatagcgtgctcggaacggtctcagtggctgacaccaaaggtgttaagcgcaagaccctatttagggaaaacggaagcaaaccaagggccatagtcgtggatcccgtccacgggttcatgtactggaccgactggggaactcctgccaaaatcaagaagggcgggctcaacggggttgatatttattctctcgttacagagaatatacaatggcccaatggaatcacccttgacctcctttctgggcgactgtactgggtggactccaagctccacagtatttcgtccatagacgttaatggggggaatcgaaaaacgatcctggaggacgagaagcgactggctcacccgttcagcctagccgtgtttgaggacaaggtgttttggacagacataattaacgaggcaatcttcagtgctaatcgcttaaccggatcagatgtaaatctgctcgccgagaacctcttgtcccctgaggacatggtactcttccacaatctgacgcaaccacgcggtgtgaactggtgcgaacgcaccacgttgagcaatggggggtgccagtacctgtgtctccccgccccccagattaacccgcattccccgaaatttacttgcgcctgcccagacggaatgcttcttgcccgggacatgcgctcttgcctcaccgaagccgaggctgccgtcgctactcaagagacctcgactgtgcgtctcaaggtgtcgtcaaccgccgtccgaactcagcacactacgacccgccctgttcccgataccagtcgtctgccaggggctacgcctgggctgactacggtggagattgtgacaatgagccatcaggctctaggagatgttgccggcaggggaaacgaaaagaagccatcatcagttcgcgcactttcaatcgtattgccaatagtcttgctggtgtttctttgcctcggagtgttcttgctctggaagaattggagattaaagaacataaacagcattaattttgataatccagtctatcagaagacaaccgaggatgaggtgcatatatgccataatcaggacggctattcatacccatcacgtcagatggtgagcctcgaggatgacgtggcgtag

SEQ ID NO: 2668 - DNA, 2049 bp, Artificial Sequence
  Description of Artificial Sequence: Synthetic coding sequence
atgggaccgtggggatggaagcttcggtggactgtcgctctactgctggccgccgctggcactgccgtcggtgatagatgtgagaggaatgaattccaatgtcaggatggtaagtgcattagttataagtgggtctgtgatggcagtgcggagtgtcaggatggctctgacgagagccaggaaacttgtctcagcgttacctgcaagagcggcgacttctcgtgcggcggtcgagttaaccgctgcatcccccagttctggcgttgcgatggacaggtcgattgtgacaacgggagcgatgagcagggctgccctgtggcgacgtgtcgacctgacgaattccaatgcagcgacggaaactgtatccatggaagcaggcagtgcgatcgcgagtacgactgtaaagacatgagtgacgaagtgggctgcgtcaacgtgacactttgtgaaggcccaaacaagttcaaatgccactctggcgagtgtataactttggataaagtctgtaacatggcccgcgactgcagagattggtctgatgagcctattaaagaatgcgggaccaacgagtgcttggataataatgggggatgtagccatgtgtgcaatgacttgaaaatcggttacgagtgtctctgccctgacgggttccagctggtggcacaacgacggtgcgaagatatcgatgagtgtcaggacccagacacatgtagccagctttgtgtcaatctggaaggtggttacaagtgtcagtgcgaagagggctttcaactcgaccctcacaccaaggcttgcaaggctgtcggctcaatcgcctaccttttttttactaatcggcacgaggttcgtaagatgactttggaccgctctgaatacacgagcctgatccctaatttaagaaatgtggttgcactggatacagaggttgcttcaaacaggatatactggtcagatctgagccagaggatgatctgctcaactcagcttgatagagcccacggagtctcatcttacgatacagtaattagcagagacatccaagcccctgatggcctcgccgtggactggatccactcaaatatatactggaccgactctgtgctggggaccgtgagcgtggcagacacgaaaggtgtgaaacgtaagacgctctttagggagaatgggtcgaagccccgcgcaattgtcgtggaccccgtccatggtttcatgtactggaccgattggggaacacccgcaaaaataaagaaggggggccttaacggggtagatatttatagcctcgttacagagaacattcagtggccaaatgggattaccctcgatttacttagcggccgcctctactgggtggacagcaaactccacagcatttcgtccatcgacgtgaacgggggcaaccgcaagacaatactcgaggatgaaaagagactggcccatccattctccctggccgtgtttgaagataaggtgttctggactgacattatcaacgaggcgattttcagtgcaaacaggctgaccggatccgatgtgaacctgctggctgagaatttgctatctccagaggatatggtgctgtttcacaacctgacccagccaagagaggctgaggccgcagttgccacacaggaaacctctaccgttaggctgaaagtcagctccactgcagtgagaacacagcacacaacgacaagaccagtacccgatacatcacgcctgcccggggctacacctggactcaccactgtcgaaatcgtgaccatgtctcaccaggcgttaggtgacgtagctgggagaggcaacgaaaagaagccaagttctgtgcgcgctctgtccatcgtactccctattgtcctgttggtgtttttgtgtcttggcgtgtttttgttgtggaagaactggcgacttaaaaatattaattccataaactttgacaaccccgtgtatcagaagaccactgaggatgaagtgcatatctgtcataatcaagacggctacagttaccccagcaggcaaatggtgtctctggaggatgacgtagcatag

SEQ ID NO: 2669 - DNA, 2577 bp, Artificial Sequence
  Description of Artificial Sequence: Synthetic coding sequence
atgggcccctgggggtggaagctgcggtggaccgtggcattgctgctggctgccgcggggactgccgtgggagatagatgcgaaagaaatgaatttcaatgccaggatggaaagtgtattagctataagtgggtctgtgacggctctgccgaatgtcaggacgggagtgatgagagtcaggagacatgcctgtcagtcacctgcaaaagtggtgacttctcatgcggtggcagggtgaaccgatgtattccacagttctggcggtgcgatggtcaagtggactgcgataacgggtctgacgaacagggctgtccgccgaagacatgtagccaagatgagttcagatgtcatgacgggaagtgcatttcaaggcagttcgtgtgtgattctgatcgggattgtctagacggaagtgacgaagcctcatgcccagtcctgacatgcggccctgcttcctttcagtgcaatagctcaacctgcatacctcagctgtgggcttgcgacaatgatcccgattgtgaggatggaagtgatgaatggccccagcgctgtaggggcctgtatgtgtttcagggcgatagttccccctgctctgccttcgaattccattgcttatcaggggaatgcattcatagcagctggagatgtgacggcggtccagattgcaaagataaatccgatgaagagaactgtgccgtggcaacttgcaggcctgacgagttccagtgctcagacgggaattgtattcacgggtcccgccagtgcgatcgggagtacgattgcaaggacatgtcagacgaagtcggttgtgttaatgtgaccctctgtgaaggaccgaataaatttaagtgccattctggtgagtgtataaccctcgacaaagtctgcaatatggcccgggactgtcgggactggagcgacgagccaatcaaggagtgcggaacaaacgagtgcctcgataacaacggaggctgctcccacgtgtgcaatgacctgaagatagggtacgaatgcttatgcccggacgggttccagctcgtggctcaacgccggtgtgaagatatcgacgaatgccaggatcccgatacatgtagccagctgtgtgtgaaccttgagggcggttataagtgtcagtgtgaagagggattccagttagatccccatactaaggcgtgcaaggctgtaggaagcatcgcgtacctctttttcaccaaccgtcacgaggttaggaagatgacactggatcgaagcgagtatacctctctgatccctaacctgaggaatgttgtcgctctagacactgaggtggcttcgaaccgaatctattggtccgacctctcccaacgcatgatctgttctacccagctggacagagcacatggtgtctcgtcatacgacacggtgatttcgagagatatccaggctcctgatggactggccgtagattggatccactccaacatctattggacggactccgtgctgggaactgtctcagtggcagacactaagggagtcaagcgcaagactcttttcagagagaatggttctaaaccccgggccatcgtggttgaccccgtgcacggtttcatgtactggactgattggggcacacctgccaagataaaaaaaggcggccttaacggggttgacatttatagccttgtgacggaaaacattcaatggcccaacgggatcacactcgaccttctgtccggtcggctgtattgggttgatagtaaacttcactccattagcagcatcgacgttaatgggggaaacagaaagaccatactggaagatgagaagcggctcgctcacccattcagcctggcagtattcgaggacaaagtgttctggaccgatataataaatgaggccatcttctctgccaatcgccttaccgggtcagatgtgaatttgctggcggaaaacctactcagccccgaggacatggttctgttccacaacctgactcagcctaggggcgtgaactggtgcgaaagaaccacactcagcaatggggggtgccagtacttatgtcttcccgcaccgcagataaacccccatagcccaaagttcacctgtgcctgcccggatgggatgctactggctcgagacatgagaagttgtctcacggaagccgaggccgccgttgccactcaggaaacttctacagtccgactgaaagtgtcgtctacagcagtgcgtactcagcatactaccacaaggcctgtgcctgatacatctcggctccctggggctacccccggtctgacaactgtggaaattgtgactatgtcacatcaggctctcggtgatgttgccgggagaggcaatgaaaagaagcctagcagtgtgcgggcgttatccattgtactcccgattgtcctgttggttttcctctgtctgggagtgttcctgctgtggaaaaactggaggctcaagaacattaatagcatcaactttgacaaccccgtttaccagaaaaccacagaggacgaagtacacatctgtcacaaccaggatggctattcttatccctcaatggtgtccttggaggacgatgtggcgtag

SEQ ID NO: 2670 - DNA, 2583 bp, Artificial Sequence
  Description of Artificial Sequence: Synthetic coding sequence
atgggtccttggggctggaagctcaggtggaccgtggcgcttctgctcgcagccgctgggacagcggttggagatcgatgtgagcgtaacgagtttcagtgtcaagacggtaaatgtatctcatacaaatgggtttgtgacggatcagccgaatgccaggacgggagcgatgaatcgcaggaaacatgtttgtccgtgacttgtaagtctggcgatttttcctgcggaggaagagtgaaccgctgtatcccccaattttggaggtgtgatgggcaggtggactgtgataatggatctgatgagcagggatgcccaccaaagacttgcagccaggatgaattccgctgtcacgatggcaagtgtatctccaggcagttcgtgtgcgattccgatagggattgcctcgatggctctgatgaagcatcttgtcctgtcctaacttgcggaccagcttcatttcaatgcaactcttcaacgtgtatccctcagctgtgggcctgcgacaatgacccagattgtgaggatggctctgacgagtggccccagcggtgcaggggtctgtatgtttttcagggcgatagcagcccatgttccgcgtttgagtttcactgccttagtggggagtgcattcattcctcctggcgctgcgatggggggcccgattgcaaggacaaatccgatgaagagaattgtgccgttgccacctgtagacccgatgaatttcaatgctcggatgggaattgcatccatgggtcacgccagtgtgacagggagtacgactgtaaagatatgtcagacgaagtgggatgtgtgaacgtgactttgtgcgagggtccaaacaaattcaaatgccactccggagagtgtataactctcgacaaagtctgcaatatggccagagactgccgggattggtctgacgagcctattaaagagtgtggcactaacgagtgtctcgataacaatggggggtgttcccatgtttgtaacgacctcaagataggctacgaatgcctttgtcccgacggatttcagctggttgcacagaggcgatgcgaagacatcgatgagtgtcaggaccctgatacatgtagtcagctgtgtgtcaacctcgaaggtggatataagtgtcagtgcgaggaaggcttccagctggatcctcacactaaggcttgtaaggccgttggcagtatcgcctacctattcttcacaaaccgacatgaggttagaaagatgactcttgatagatccgaatatacctctctgattcccaacttgaggaacgttgtcgccctggatacggaggtggccagtaataggatatactggtcagacctgtcacagcgcatgatctgcagtacccaactggaccgggcccacggtgtctcctcttatgatacagttatctcccgtgacatacaggcccccgatggcctggcggtcgactggattcatagtaacatctactggactgacagcgttttaggcacagtgtccgtagcagatacaaagggtgtgaaaaggaagacactcttcagagagaacgggagcaaaccacgagctattgttgtcgaccccgtgcacgggtttatgtactggactgattggggaactcctgctaagatcaagaaaggaggacttaatggtgttgacatctatagtcttgtgactgagaacatccagtggccaaatgggatcacactcgaccttctctctggccggctgtactgggtggacagtaaactacacagcatcagcagcatagacgtgaacgggggcaatcgcaaaaccatcctcgaggatgaaaaaagactggcccacccttttagtcttgctgtttttgaagataaggtgttttggactgatataatcaatgaggcgatattttccgctaatcggcttacggggtctgatgttaacctgttagctgaaaatttactcagtccagaagacatggttctctttcacaacctgactcaacctaggggggtcaactggtgcgaaaggaccaccctctctaatggcggatgtcagtatctctgtctgcctgcgccccagattaatccccatagtccgaagttcacatgtgcgtgtcctgatggaatgctccttgcccgggacatgcgttcatgcctgacagaagctgaggccgctgtggcaacccaagagacttctactgtccggctcaaagtcagctcaacggccgttcgcacccagcacacaaccactagacccgtgcccgacactagtcggttaccgggcgctaccccggggctgactacggtcgaaatagtaacaatgagccatcaggcactgggcgacgtcgcaggaagaggcaacgaaaaaaagccctctagcgtcagggccctgtcaatcgtgctgcccatcgtgctgctcgtgtttctgtgcctcggcgtttttttattgtggaagaactggcggttgaaaaacattaattctatcaacttcgacaaccccgtgtatcagaagacaacagaggatgaggtgcacatttgtcacaatcaggacgggtatagttacccaagtcggcagatggtgtccttggaagatgacgttgcttag

SEQ ID NO: 2671 - DNA, 2220 bp, Artificial Sequence
  Description of Artificial Sequence: Synthetic coding sequence
atgggcccttggggctggaaactgcggtggactgtagctctgctgctcgctgccgccggtactgcagtgggagacaggtgtgagcggaacgatttccaatgcaactcctccacatgcatcccacagctctgggcctgtgacaacgaccccgattgcgaagacggtagcgacgaatggccccagcggtgtagggggctgtacgtgtttcaaggtgatagttcaccgtgttccgcctttgaattccactgcctctctggagagtgcattcattcttcttggaggtgcgatggcggccctgattgtaaggataaaagcgatgaagaaaactgtgccgttgctacatgcaggcccgatgaattccaatgcagcgatggcaactgtattcacggctcaaggcagtgcgaccgggagtatgactgcaaggacatgtcagacgaggttgggtgcgtgaacgtaacactttgcgaaggcccgaacaagttcaagtgccactcaggggagtgtattactctggataaggtgtgtaacatggctcgagattgccgggattggtcagacgagcccatcaaggagtgcgggacaaacgaatgcctagacaacaatgggggttgttcccacgtgtgtaacgatttaaagattggctacgagtgcctctgccccgatgggtttcaactcgtcgcacagcgccggtgcgaggacattgatgaatgtcaggacccggacacatgctcacagttatgtgtaaatctggaagggggctacaagtgccagtgtgaggagggcttccagttggaccctcacacaaaggcctgcaaagcggtcgggtccatcgcttatttgtttttcacaaaccgacacgaagtacgaaaaatgaccctcgacagatcggagtacacgagcttgatacctaacctcaggaacgtggtagcactggatacagaagtcgcttccaataggatttattggagcgacctatctcagaggatgatatgctcaacccagttggatcgtgcccacggagtgagttcttatgatacagtgatctcacgggatatccaggcccctgatggcctggccgtcgattggatccacagcaatatttactggacagactcggttctcggaaccgtttcagtggccgacaccaaaggcgtaaaaaggaagacactgttccgtgagaatggctctaaaccaagagcgattgtggtggaccccgtacatggatttatgtactggaccgactggggcactcccgctaaaatcaaaaaggggggactgaacggagtagatatatacagcctggtgacagagaacattcagtggcctaacggcattactctagacctgctgagcggacgactttactgggtggatagcaagcttcactccatcagctctattgatgtaaacgggggcaacagaaagacaattctggaggacgagaaacgactggcccatccttttagcctcgccgtattcgaggacaaggtgttctggaccgatatcataaacgaagcaatcttttctgccaacaggctgacaggctccgatgtcaatctgctggccgagaacctgttgtccccagaagacatggtgttgtttcacaatttaactcagccccggggagtgaattggtgcgaaagaaccacgctgagcaatggggggtgccagtacctctgcctccctgccccacagatcaacccccactctccgaaattcacttgcgcttgcccagacggaatgttgctggcccgggatatgcgtagttgtctcaccgaagcagaggcggccgtcgctacccaggaaacatccacagtgcggctgaaggtgtcgtctaccgccgtgaggacccagcatactacaacacgacctgtccctgatacttctagactcccaggggccactcccgggctaaccacagtcgaaatcgtgacaatgtcacatcaggccctcggagacgtggccggccggggtaatgagaagaaaccatcttccgttcgggctttgtccatcgtcctccctatcgtcttactggtttttctgtgtctgggggtgtttttactatggaagaactggaggctgaagaacataaactctattaactttgataacccggtgtaccagaagactaccgaggacgaagttcatatctgccacaatcaggacggctacagctacccctctcggcagatggttagcttagaagatgatgtagcctag

SEQ ID NO: 2672 - DNA, 2838 bp, Artificial Sequence
  Description of Artificial Sequence: Synthetic coding sequence
tagggcaggccaggcgttcccccgcgcttcctgtcccagcgtaggcgacaagtccctgggccccgtagcagattacgagacatccacgaatctcctagcgtgatcctgggacctccaggtgaggtgccaggctttagatgtgctctctggcgccatctcagaccccatttagtacttgggggcgcgctggctcccccagcccccattaaattcaccgagggtcctcctgctaccttaaaggcttccgtcccctacgaagtggaaacactgccccaaaacctgcccgcgcctccatggtctgctgccgagattttctcacacgtgggcgaccgatgtgagcgtaatgagttccaatgtcaagatgggaaatgtatttcttacaagtgggtgtgtgatggtagcgccgagtgccaagatggatcagacgaatctcaagagacttgtctgtcagtaacatgtaaatccggggacttctcttgcggaggacgcgtaaaccgttgcattccacaattttggcggtgtgatggtcaggtagattgtgacaacggatctgatgaacagggctgcccaccaaaaacttgttcccaagacgaattcagatgccatgacggcaagtgcatcagtagacagttcgtgtgcgattcggatagagattgcctagacggcagtgacgaagcctcatgcccagtgctgacttgtgggcctgcctcctttcaatgcaactcctccacctgcattccccagctctgggcctgtgacaatgatccagactgcgaggacggcagcgacgagtggccccaacggtgtaggggcctgtatgtctttcaaggcgattcctctccatgctcagcctttgagtttcactgcctgagtggagaatgtatacacagctcgtggagatgtgacggtggtccagactgtaaggataaatctgatgaggaaaattgcgcagtggctacgtgtcggccagacgagtttcagtgcagcgatggtaactgtatacacggctcacgccagtgcgacagggaatacgattgtaaggatatgtccgacgaagtgggctgcgtcaatgttacgctgtgcgagggaccgaacaaatttaagtgccatagcggtgaatgcattacacttgacaaagtgtgtaacatggcccgcgactgccgggactggagcgatgagcccattaaagaatgcgggacgaacgagtgtctagacaataacggaggatgttctcatgtctgtaacgatctgaagatcgggtatgagtgtctttgccctgacggctttcaattggttgctcagaggcgctgtgaggatatcgacgagtgccaagatcctgatacatgttcacagttatgcgtcaacctcgagggggggtataagtgtcagtgcgaggaagggtttcagttggacccacacaccaaggcctgcaaggccgtggggtcgattgcctacctgttttttaccaaccgtcatgaggttcgcaagatgacattggataggtcagaatatacgagcctcatcccaaacctacgtaatgtcgtagctctggacacggaggttgcctccaatagaatctactggtcagatctttcacaaagaatgatatgttcaacacagttggaccgcgcccatggcgtgtctagctacgacacggtaatttcccgagacattcaggctcctgatggccttgccgttgactggatccattcaaatatctattggactgacagtgtgctgggaacggtttctgtagctgatactaagggagtgaagaggaagacactcttcagggaaaacggatctaagccccgtgcaatagttgtggatccagtgcatgggttcatgtactggactgactggggcacccccgcaaaaatcaagaaaggaggcctcaatggcgttgacatatactcactggtgacggagaatatccaatggcccaacggaattactctggatctgctaagtggtcgcctgtattgggtggactcgaagctgcacagcatttcctccattgatgtgaacgggggaaatcgaaaaacaatcctagaagacgagaagcgactcgcccatccatttagcttggcagttttcgaggacaaggtcttctggaccgatataattaacgaggcgatcttcagtgccaataggctgaccggctctgacgttaatctcttggccgagaatctgcttagcccagaggacatggtgttgtttcacaacctgacccagccccgaggcgtcaattggtgcgaacgaactacactgtccaacggcggatgtcagtatttatgtttgcccgccccacagatcaatccccatagtcccaaattcacttgtgcctgtccagacgggatgttgcttgctcgagatatgcgttcctgtctgacggaagctgaagccgcagtggcaacccaagaaacctcaactgtgaggcttaaggtctccagcaccgccgtgcgtacccagcacacaaccaccagacccgtgcccgatacctccaggctcccgggcgcaacacctggcttaaccaccgtagaaatcgtgacaatgtctcaccaggctttgggcgatgttgccgggcgggggaatgagaagaaaccctcatcagttagagcactctctatagttcttcctatcgtgctactcgtgtttctctgcctcggcgtgtttctcctatggaagaactggagattaaagaatataaacagcatcaattttgataatcccgtgtatcagaagacaaccgaggacgaagtgcacatctgtcacaaccaagacggctattcctatccatctagacaaatggtgagtctcgaggacgacgtggcgtag

SEQ ID NO: 2673 - DNA, 1770 bp, Artificial Sequence
  Description of Artificial Sequence: Synthetic coding sequence
atgtcccgccgcctgctccctagagccgagaagcggcgtaggaggctcgagcagcggcagcagccagatgaacagcgccggagatcaggagcaatggtcaaaatggcggccgccggaggtgggggcggtgggggccggtactacgggggcggcagtgaggggggaagggctccaaagagactaaaaaccgacaacgctggagatcagcacggagggggtggcggggggggaggaggcgccggggctgccggtggcggcggagggggggagaattacgatgatccacacaagacccccgcctctcccgtggttcacatcagaggtctgatcgacggcgttgtggaggctgacctggtagaagccctccaggagtttgggcctattagttacgtcgttgtgatgccaaagaagagacaggccctggtcgagttcgaggacgtcttaggagcatgcaacgccgtgaattacgcagcagataatcaaatttacattgctggtcatccagctttcgtcaattactcgaccagtcagaaaatctctagaccaggcgatagcgacgattcaaggagcgtcaacagcgttctgctgttcaccatcctgaatccaatctatagcataactaccgatgtgctctacacaatttgtaatccatgcgggccggtgcagagaattgtcatatttcggaaaaacggagtccaggccatggtagaattcgattctgtccagagtgctcagcgcgccaaggcttcattaaacggagctgatatctactcaggatgctgtacacttaaaatagagtacgcaaagcctactcggctgaatgtatttaaaaacgatcaggatacctgggactatactaatccaaacctttcgggccaaggcgatcctggttcaaatccaaacaagaggcagagacaacccccactcctgggggaccatccagccgagtatggaggccctcacggcgggtaccacagtcactaccacgacgagggttatggccctcccccgccacactacgagggaagacggatgggacctccagtggggggccaccgacgcggcccaagcagatacgggccacaatatggccaccctcccccccctccacctcccccagagtacggaccgcatgcagactcccccgtgctgatggtatacggcctggaccaatcaaaaatgaactgcgacagagtatttaatgtgttctgtttgtatggaaacgtcgagaaggtcaagttcatgaaatcaaaaccgggggcggcaatggtcgaaatggccgacggctatgccgtggatcgcgccattacacatttgaacaataattttatgtttgggcagaaactgaacgtctgtgtgagcaaacagcctgccatcatgcccggacagtcatacgggttagaagacggatcatgtagctacaaggacttctccgagagcagaaataatagattcagtacaccagaacaggctgctaagaacagaatccagcatccctcaaacgtgctgcatttctttaatgctccactagaggtgaccgaagaaaacttctttgaaatatgtgacgaattaggggtcaaaagaccttcttccgtcaaggttttttcaggaaagtctgagcggtcttcttcaggcttactggagtgggagtctaagtctgacgcccttgaaacgttgggatttcttaaccactaccagatgaagaatccaaacgggccatacccctatacacttaagctttgctttagtactgcccagcatgccagttag

SEQ ID NO: 2674 - DNA, 540 bp, Artificial Sequence
  Description of Artificial Sequence: Synthetic coding sequence
atgggacgccctggacttggtgccgccgtttctgatcttggggaggccgtttctctgagtcagggacttttgctgctcctcctgctgtctatgggaggtgcttgggcctctcgggagcccctgaggccatggtgtcatcctattaacgcaatattggcggtggagaaagagggatgccctgtgtgtataaccgttaatacaaccatttgtgctggatactgcccgaccatgatgcgggttcttcaggccgttcttccacccctgccgcaagtagtttgtacataccgtgacgtgcgctttgagtcaattcgacttccgggctgccctaggggcgttgatccagtcgttagcttccctgtggctctgtcctgccgatgtggcccatgccgcagaagcacatcggactgcgggggcccaaaagatcaccccctaacctgtgaccacccccagcaggcttccagctcctctaaagaccctcctagaagcctacccagcccgagccgccttctagagcccgatactcctattctgccgcagtag

SEQ ID NO: 2675 - DNA, 294 bp, Artificial Sequence
  Description of Artificial Sequence: Synthetic coding sequence
atgcagctgggcactggacttttgctcgcagctgtcctgtcgctgcaactagcagccgctgaggccatttggtgtcaccagtgcacagggtttggcggatgtagccacggatcgcggtgtctgagagacagcacacattgcgtaaccactgccacccgcgtgttgagtaacacagaagacctccccttagtgaccaaaatgtgtcacatcggctgcccagatatcccctccctgggccttggcccctacgtctccattgcctgctgccagacgtcgctgtgcaatcatgattag

SEQ ID NO: 2676 - DNA, 2058 bp, Artificial Sequence
  Description of Artificial Sequence: Synthetic coding sequence
atgccagcttatacgcacgcctctcctatacacaatacacacaaaccttacgagtgcaaggagtgcgggaagtacttctcttgtgggagcaatctcatccaacaccagagcattcacaccggtgagaagccgtataagtgcaaggagtgtggcaaagccttccagctgcatatccagctcaccagacatcagaagtttcatacgggtgaaaagacatttgaatgtaaagaatgcgggaaagccttcaacttgcctacccaattgaatagacacaaaaacatccacaccgttaaaaaactgtttgaatgtaaggaatgcggcaaatccttcaaccggtcatcaaatctcacccagcaccaatccatccatgctggggtgaagccctaccagtgtaaggaatgcggcaaggcctttaaccggggcagcaacctgattcagcatcagaaaattcactcaaatgaaaaacctttcgtctgcagagaatgtgaaatggcctttcgctaccattaccagctgatcgagcattgccggatccacaccggcgagaaacctttcgaatgcaaggaatgcaggaaggccttcaccctcctcactaagctggtgaggcatcagaaaatccatatgggagaaaagccatttgaatgccgagagtgtgggaaggcttttagcctgctgaaccaactgaatcgccacaagaacatacacaccggagaaaagccttttgaatgtaaggaatgcggaaagagctttaacagatctagcaatctgatacaacaccagtccatccacgctgatgtcaagccctacgagtgtaaggaatgcggaaagggctttaataggggcgcaaatctaattcaacaccaaaaaatacattcaaacgaaaagccatttgtgtgcagagagtgtgaaatggcattcagataccattatcagttgattcagcattgtcagatccacaccggtggaaaaccatttgagtgcaaagagtgcggcaaggcattctcactgttgacacaacttgcgaggcacaagaacattcatactggcgagaagccctttgaatgtaaggattgtggaaaagcttttaatcgggggagcaaccttgtacaacaccagagcatccacaccggtgagaagccctacgaatgtaaggagtgcggcaaggcttttcgtctccatctgcagctgtctcagcacgaaaagacacacactggggagaagccatttgagtgtaaagaatgtggaaaattctttcgcaggggttccaatcttaaccaacatagatctatccacactggaaagaagccttttgagtgtaaagagtgtggcaaggcatttcgacttcatatgcacctgatccgccaccagaagttccacaccggcgagaagccattcgagtgtaaagagtgtggtaaagctttttctctgcacactcaactgaaccatcacaaaaacattcacacgggcgagaaacccttcaagtgcaaagagtgtggcaaatctttcaatagggtgtcgaacctggtccagcaccagtcgatccacgccggggtgaaaccctatgagtgcaaggaatgcgggaaaggattctcacgggtgtccaacctgattcagcaccagaagactcacagcagtgctaagccatttgtgtgtaaggaatgcaggaagacctttagatatcattaccagctcacagaacactaccgtatccacacaggggaaaagcctttcgaatgtaaggaatgcggtaaggctttcggactgttaactcagctggcacaacaccagattattcacaccggggagaagccttttaagtgcaaagaatgcggaaaggcgtttaatcgtggttcgaatttggtacagccccaaagtatacacacaggtgagaagccctatgagtgcaaggaatgtggcaaggccttccggctgcacttgcagctgagtctccaccagaagctcgtccaagtgagaaacccactgaacgttaggaacgtcgggcagccttctgacattagttctaacctgttgaacatccgcaagttcattctcggctag

SEQ ID NO: 2677 - DNA, 564 bp, Artificial Sequence
  Description of Artificial Sequence: Synthetic coding sequence
tgacgcggaggcggggactcatacggcgtcttgctctcaaacgcgctggccagacttaggggcttcaaggatcacttcaccttctgccagcagttaaatataagcatatgtcccctctcacagacagccgctaggttccaggttattgtgtataatcctctggggcgcaaggtgaactggatggtcaggctgccagtatctgaaggggtgttcgtggtcaaggacccaaatggacgaaccgtcccaagcgacgttgtgatcttcccctcaagcgacagccaggcgcatccccccgaactccttttttccgcaagcttaccggccctgggcttctctacatactcagtggctcaggtgccacggtggaagcctcaagccagggcccctcagcctatcccacggagaagttggtcacctgccctcaccattgagaacgagcacattagagcgaccttcgaccccgacactgggctgctcatggaaattatgaatatgaaccagcagctcctcctgcccgtacgtcaaaccttcttttggtataacgccagtattggagacaactag

SEQ ID NO: 2678 - DNA, 3036 bp, Artificial Sequence
  Description of Artificial Sequence: Synthetic coding sequence
atgggggcctacgccagagcaagtggcgtctgtgcacggggctgtctggacagcgccgggccatggactatgtctcgggccctccggccccccttgcccccactatgcttcttcctgcttctcctggcagcagctggagcccgcgctggggggtacgaaacctgtcccacagttcaacccaacatgctgaatgtccacctacttcctcatacccatgacgatgtcggctggctaaagacagtggatcaatacttctacggaattaagaacgatatccagcacgcaggtgtacagtatatccttgacagcgttattagtgctctgcttgctgatccgaccaggcgattcatttatgtagaaattgcttttttctcacgctggtggcaccagcagacaaatgctacgcaggaggttgtcagggatctcgtccgccagggcagactcgagtttgccaatggtggctgggtaatgaacgatgaggctgccacccactatggggctattgtggatcagatgacgcttggccttagatttctcgaagataccttcggcaatgacggtcgcccacgcgtcgcctggcatattgatccttttggacactctagagaacaagcctctctgttcgctcagatgggttttgatgggtttttcttcggcagactggactaccaggacaagtgggtgagaatgcagaagctggaaatggaacaggtttggcgagccagcacctcgctgaagcctcctactgcagacctctttaccggtgttctccctaacggctataacccaccccgcaacctgtgttgggatgtcctctgcgtagaccaaccattggtcgaagatcccagaagccccgaatacaatgctaaggaactggtcgactactttctcaacgtcgcgacagcccaaggccggtattaccggaccaatcacactgttatgactatgggctctgactttcagtacgagaacgcaaacatgtggtttaagaatttggacaagctcataaggttggtcaacgcacagcaggcaaaggggtccagcgtgcacgtcttatatagtacgcccgcatgctacctttgggagctcaataaggccaatctaacttggagtgtgaaacatgacgacttcttcccatacgccgatgggccccaccagttttggaccggatattttagctcccgacctgctcttaaaagatatgagagactgtcctacaatttccttcaagtttgcaatcagctggaagcactggtcggtctggccgcgaacgttgggccctatgggtcaggtgattccgcccccctgaacgaggcaatggccgtactgcagcaccatgatgccgtcagtggtacttcacgccagcatgtggcaaacgattacgcccggcagctggctgcagggtggggcccttgcgaggtgcttctgagcaatgcactggctaggctgcgggggttcaaggaccattttacattctgccagcagttgaacatatctatctgccccctgagtcagacggcagcacggtttcaggtcatcgtctataacccgctgggcagaaaagtcaactggatggtccggctgcctgtctcagaaggcgtcttcgtagtcaaagaccccaacggtagaacggtcccttccgatgtggtgatcttcccaagtagtgactcccaggcacacccccctgaactgttatttagtgcctctctgccagctttggggttcagcacctattctgtggcccaggtacctcgctggaagccacaggcccgggccccgcagcctattccgcgccgcagctggtctcccgcactcactatcgagaacgagcacatacgtgcaacctttgatcccgacaccggtcttcttatggaaataatgaatatgaaccaacaactgctcttgcctgtgcggcagacattcttctggtataatgccagtatcggtgacaatgaatcagatcaggcctctggcgcctatatatttcgaccaaatcaacagaaaccactcccggtaagccgatgggcccagattcatcttgtgaagacccccctggtgcaagaagtgcaccaaaatttcagcgcctggtgctctcaggtggtgagactgtaccctggacagcggcacctagaattggagtggagcgtcggacctatcccggtaggagacacctggggtaaggaggttatcagtagattcgatacaccattggaaacaaaggggaggttctacactgattctaacggtagggagatcctagagagacggcgagattaccgaccaacgtggaaactcaatcagactgagcccgtggctggaaactactaccctgtgaacactaggatctatatcacagacggcaatatgcagctgaccgtcctaactgatcgctcacagggcggatcttcactccgcgacggtagcctggagctcatggttcacaggaggctgctcaaggacgacgggcgaggcgtgtccgagccgttgatggagaatggtagtggcgcctgggtgcgtggtcgtcacctggtcctgctcgatacggctcaggccgctgcggctgggcacagactcttagccgagcaggaagtactggccccccaagtcgtcctggcccccgggggcggggccgcctacaatctcggggcccccccacggacccagtttagcggtctgagaagagatctgcccccatccgtacacctgctgacgctggctagctggggaccagaaatggtgctgttgcgacttgagcaccagttcgccgtcggggaagacagcggcaggaatctaagtgctcctgttacccttaatctgcgcgacctgtttagtacttttaccattacccgtctgcaagaaactacgctagtggctaatcagctgcgcgaagcagcatcaaggctgaaatggaccacaaacaccgggcctactcctcatcaaactccctatcagttggaccccgctaacataaccctcgaacccatggaaattcggaccttccttgcctcagtacagtggaaggaggtagatgggtag

SEQ ID NO: 2679 - DNA, 2853 bp, Artificial Sequence
  Description of Artificial Sequence: Synthetic coding sequence
atgctgaatgtgcaccttctccctcacacccacgatgatgtcggttggctcaagaccgtggaccaatacttctacggtatcaagaatgatatccaacacgctggcgtgcaatatatcctggattctgtgatttctgctctgcttgcagacccaactcggcggttcatctatgtggaaattgcgttcttctctagatggtggcatcaacagacaaacgccacacaggaagtggttagagacttagtcagacagggcaggctggagttcgcaaacgggggatgggtcatgaatgatgaggctgcgactcactatggagccattgtggaccagatgacactcgggctccgcttcctcgaagacacttttggcaacgatggtagaccccgagttgcttggcacattgatccttttgggcattctcgggaacaggcaagtctttttgcgcagatggggtttgacgggtttttcttcggacgcctcgattaccaggacaaatgggtgcgaatgcagaaactcgagatggaacaagtttggagagcatcaacctccctaaaaccaccaacagccgacttgtttaccggtgtgttgcccaacggctacaatccccccaggaatctatgctgggacgtgctatgcgtcgaccaaccgctggtggaggaccctcgcagccctgaatacaatgccaaagaactagtcgattatttcctgaacgtcgctacagcccagggaaggtactaccgcaccaatcacaccgtgatgaccatgggaagcgacttccagtatgaaaacgccaacatgtggtttaaaaatcttgacaaactgatccggctggtgaacgcgcaacaggcaaaggggagcagtgtgcatgtgctgtatagcacccccgcgtgttacctgtgggaactgaataaagctaatctgacatggtctgtgaaacatgacgacttctttccttatgctgacggcccccatcaattttggacaggatacttctcatcacgtccggcacttaaacgctacgaacggctgagctacaattttctgcaggtttgtaatcagctggaggctctggtcggcctcgctgcgaacgttggcccctacggatctggtgacagtgcgccgctaaacgaggcaatggcagtcctgcagcatcatgatgctgtgtctggtacatcacgacaacacgtcgctaacgactacgctaggcaactggccgcggggtggggaccctgcgaagtcctgctgtctaatgcactggctaggctacggggattcaaagatcattttactttttgccaacaactgaatatctctatttgccctctctcacagacagcagcacgattccaggtgatagtgtataatccactgggccgaaaagtgaattggatggtgcgcctgccagttagtgaaggggtgttcgtggtgaaggacccgaatggaaggactgtgccatcagacgtcgtgatattccctagcagtgattcgcaggcacatccccccgagctgctcttctctgcaagtttacccgccctggggttctcaacatactccgtagctcaggttccccggtggaaaccacaggcccgagctccacagccaattcctagaaggtcttggagtccagccctcaccatagaaaatgagcatataagagcgacatttgatccagataccggtctgctcatggagatcatgaacatgaaccagcagctgctgctccctgttcgccaaacgtttttttggtacaacgcatcgattggggataacgagtctgaccaggcctctggggcttacatttttcgaccaaaccaacaaaagcctctccctgtgagccggtgggctcagatccacctagtcaaaacccccctggtgcaagaggtccaccaaaacttcagcgcttggtgtagccaggtcgttcgtctgtatccgggtcaaaggcatcttgaactggagtggtccgtcggccctattcctgtgggcgacacctggggtaaggaagtgatttccaggtttgacacgcctctcgagaccaaaggtcgcttctataccgattccaacggtagagaaattctcgaacgcagaagggactatcgcccaacttggaaactgaaccagactgaacctgtagctggcaattactaccccgtcaatactagaatctatataactgatggcaacatgcagctgactgtgctgaccgataggtcacagggaggaagtagcttgcgagatggcagcctcgagctcatggtgcatcgccgcctactcaaggacgacggacgcggagtctccgagccactcatggagaatggtagcggtgcttgggtgcgtggacgacaccttgtccttctcgacaccgcacaggccgcggcagcaggccatagattactcgctgaacaagaggtgctggctcctcaggttgtcttggcccccggtggcggagctgcatacaatctgggagctcccccaagaacccagttctcaggcctccgcagggacttgcccccaagcgtgcatttgctgacactcgctagttgggggccggagatggttctgttacgattagagcaccagtttgccgttggcgaggacagcgggcgtaacctgtccgccccagtcacactgaacttaagggatctgttcagcacgttcacaattactcgtctgcaagaaaccaccttagtggccaatcagttaagggaggcagcctccaggcttaaatggaccacgaatacaggacctacccctcatcagactccatatcagctggaccccgctaatatcactctagagcccatggaaattcgcacttttttagccagtgtgcagtggaaggaagtcgacggatag

SEQ ID NO: 2680 - DNA, 882 bp, Artificial Sequence
  Description of Artificial Sequence: Synthetic coding sequence
atgggcttccctgctgctgccctcctctgcgccctttgctgtggactgctcgcacctgccgcccgggccgggtacagtgaagagcgctgctcatggagaggttctggcctaacccaggaacccggcagcgtggggcagctagccctagcatgcgccgagggcgctgtcgaatggctgtatcctgcgggggctctccgcctgactctcggggggcccgaccccagagcaaggcccggaatcgcatgcttgagaccagtaaggccttttgcaggcgcccaagtcttcgctgaaagggcggggggggcgctcgagcttctccttgcggaagggcctggtcccgcaggcggccgctgcgtcagatggggccctcgagagcggagagcacttttccttcaggccacccctcatcaagacattagccgccgcgtagctgcttttaggttcgagctgagagaggatggtaggccagagctgcccccgcaggctcacggcttgggcgtggatggggcttgccggccctgtagtgacgctgagctcctcctcgccgcgtgtacttccgattttgtgatccatggcattatccatggggtgacgcacgacgtcgaattgcaggagtctgttatcaccgttgttgctgcccgcgttcttcgtcagacaccacctctctttcaggccgggcgctctggcgaccaggggctgacgagtattcgcacccctttgaggtgcggtgtgcacccaggtcccggcacatttctgtttatgggatggagtaggttcggtgaagctagactcggctgtgcgccccgtttccaggaattccggagggcctatgaagctgcccgggccgcccatctgcacccctgcgaggtagctctccattag

SEQ ID NO: 2681 - DNA, 708 bp, Artificial Sequence
  Description of Artificial Sequence: Synthetic coding sequence
atggaacaggacgaccctgtagaagccttgaccgaattgcgagaaaggaggttaggtgctctggagctgctgcaggcagccgccggatctggccttgcggcctacgccgtctgggcgttactcctgcaacctggattccggcgcgtacctctgcgcctgcaagtaccttacgttggtgcctcggctcggcaagtcgaacatgttctaagtctccttcgaggccgaccgggaaagacagtcgatttaggctctggggatggaagaatcgtactggctgctcaccggtgcggattgaggcctgcggttgggtacgaactgaacccatggctggtggccctggcgagacttcacgcctggcgggctggctgcgccggctctgtatgctaccggcggaaagacctgtggaaggtgagcctgagagactgtcggaacgtttccgtgttcctggcaccctccgtgctgcccttactggaagacaagttgcgcaccgaacttcctgccggagcccgagtggtgagtggcaggtttcctttacctacctggcagcccgttacagcagttggcgaaggactggatcgcgtgtgggcctacgatgtccccgagggagggcaggccggagaagcagcctcatccagaattcccatacaagcggcccctggacctagcagtgcccctatcccaggtgggctcatttctcaggccagctag

SEQ ID NO: 2682 - DNA, 2253 bp, Artificial Sequence
  Description of Artificial Sequence: Synthetic coding sequence
atgctgagggcgaagaaccagctatttctcctttccccccattatctcagacaggttaaggaatcgagtggctctagattgattcaacagaggctgcttcatcagcagcagcccttacaccctgaatgggctgcattggcaaagaaacagttaaagggtaagaatcccgaggacctgatctggcacaccccagagggaatcagcatcaagcctctgtattctaaacgggatacgatggacctgcctgaagaactgcccggagtcaaaccttttaccagaggaccataccctaccatgtatacattccgcccttggactattaggcagtacgccggttttagtacagtcgaggagagcaataagttctacaaggacaacattaaggcgggtcagcagggccttagtgttgcctttgacctagccactcatagaggatatgacagtgacaacccacgggtgcggggcgacgtgggtatggccggcgtcgctatcgacaccgtggaagacaccaagattctcttcgacgggatccccttagaaaaaatgagtgtgagtatgacaatgaacggagctgttattccagtgctggccaattttattgttaccggagaagagcagggagtacccaaagagaagcttaccggcactattcagaacgatatccttaaggaatttatggtacgcaacacatacatattccccccagagccctctatgaaaataattgccgatatttttgaatacacagcgaaacacatgcctaagttcaattctataagcatttccggctaccacatgcaagaagctggcgcagatgccatccttgagcttgcctacactctcgccgatggactggagtactctaggacaggccttcaagccggcctcaccatcgatgaatttgcacctagactttcttttttttgggggatcggtatgaatttctacatggaaatcgccaagatgagagctggcagacgcctatgggctcacctaatcgaaaagatgtttcagccgaaaaattccaaaagtttgttactgcgggcacactgccagacctcaggctggtccctcaccgaacaagacccatacaacaatatcgtaagaaccgctatcgaagcaatggccgccgtctttggcggcacacagtcactccacacgaattcattcgatgaggccttaggcctccccacggtcaaaagcgcacgaattgcccgtaacacccagataatcattcaagaggagagcggaatacctaaggtcgcagatccttggggcgggtcttatatgatggaatgtctgactaacgatgtgtatgacgctgctttgaagttaataaatgagatagaagaaatgggcgggatggctaaagccgttgctgaaggaattcccaagttacgaatagaagaatgcgccgccaggaggcaggctcggatagatagcgggtccgaggttattgtaggtgtcaataagtatcagcttgaaaaagaggatgcagtggaggttcttgccattgacaacacatccgtcaggaataggcagatcgaaaagctgaagaagatcaaaagctccagggatcaggccctcgcagagaggtgcctagccgcactgaccgagtgtgctgcgtccggggatggcaatatactcgcactcgccgtggacgcgtctcgcgcacgctgcacagttggcgagattacggatgcactaaagaaggtctttggagaacacaaggcaaatgaccggatggtgtctggggcatataggcaggagttcggcgaatcaaaagaaatcacctctgcgattaagcgggtacataaatttatggaaagagaagggaggagacctcgcctccttgttgccaagatgggacaggatggtcacgacaggggagctaaggtcatcgccactgggtttgcagacctgggttttgatgttgatattggtccactgtttcagacccccagagaggttgctcagcaggccgtcgacgcagacgtgcacgctgtagggatctcgactcttgcagccggccataagaccttggttcccgaactcatcaaagaactgaatagcctgggtcgccccgacatattggtaatgtgtggtggggtgattcccccacaggactacgaatttctgtttgaggtaggagtctccaacgtgtttggcccaggaacccggatcccgaaagcagctgtgcaggtgttagatgacattgagaaatgcctggagaagaaacagcaaagtgtttag

SEQ ID NO: 2683 - DNA, 594 bp, Artificial Sequence
  Description of Artificial Sequence: Synthetic coding sequence
actaggtatctagcccgctgtaccgtcggggagatcacagacgcactgaaaaaagtgttcggtgagcataaggccaatgataggatggtcagcggagcctatagacaggagttcggcgaatcaaaagagatcacatcagccatcaagagggtccacaaatttatggaacgcgagggaaggagaccccggctgctcgtcgcaaaaatgggacaggatggccatgatcgaggggccaaagtgattgccactggttttgctgacctcggatttgacgtggacataggtcctctctttcagacaccacgggaagtcgcacagcaggctgtggacgcagatgtacacgctgttggaatttcgaccctggctgctgggcacaaaacactggtacctgagctgatcaaagagctaaattccctaggaaggccggatatccttgttatgtgcggcggcgtcatcccccctcaggattacgaatttctgtttgaagttggcgtgagcaacgtgtttggccccggaacccggatccccaaagctgcagtccaggtccttgacgatatcgagaagtgcttggaaaagaaacagcaaagtgtatag

SEQ ID NO: 2684 - DNA, 2685 bp, Artificial Sequence
  Description of Artificial Sequence: Synthetic coding sequence
atgatcctcctcgctgtcttgtttctttgctttatctcctcctacagtgccagcgtcaaaggacataccactggactcagcctgaataatgaccgcctttacaagctaacttacagcaccgaggtcctccttgaccgcggtaagggaaagctccaggattcagtgggatataggatctcatcgaacgtcgatgttgctttgttatggagaaacccagacggagacgatgatcagctgatacagatcactatgaaggatgtgaacgtggaaaatgttaatcagcagagaggggaaaagagcattttcaaaggaaaaagtccctctaaaattatgggtaaagaaaacctggaagcattgcaaagaccaaccctcctgcacttgatccacggtaaggtcaaagaattttattcttatcaaaacgaggctgtcgctattgagaatataaaacgcggacttgccagccttttccagacacaactgagctctgggaccaccaacgaagtggacattagcgggaactgtaaagtaacctaccaggcccaccaggataaggtgataaaaattaaggctctggacagttgtaagatcgccagatccggctttacgacaccgaaccaggtcttaggggtgagtagcaaagccacgtcagtcactacgtacaagatagaagattcttttgtcatcgccgtgcttgcagaagaaactcataattttgggttgaatttcctgcagaccataaaaggtaagattgtttcaaagcagaagctggaactgaaaactaccgaggccgggcccaggctcatgagcggcaaacaggcagctgctatcatcaaggcagtggattccaagtacactgcaattcccattgtcgggcaggtctttcagtctcattgtaagggctgcccatccctcagcgagctttggcgtagcactaggaagtatcttcagccagacaatttgagcaaggctgaagctgtgcgcaacttcctggctttcatccagcatctacgcactgcaaagaaggaagagatcttgcaaatccttaaaatggaaaataaggaagtgttgccacagttggtggatgcagtcactagcgctcagacctctgattcactcgaggccatcctggactttctggacttcaaaagcgactccagtatcatcctgcaagagaggttcttgtacgcttgcgggttcgcttcccaccccaacgaagaattgcttcgcgccctgatctccaaattcaaaggcagtatcggctccagcgacataagggagaccgtgatgataatcaccggcactctggttagaaaactatgtcaaaatgaggggtgtaaactgaaggctgtggtggaggccaaaaaactgatccttgggggcctggagaaggcagagaaaaaggaggatacaagaatgtacctgctggccctgaaaaatgcactgctgccagaaggaatccccagcctgttgaaatacgctgaggccggcgaaggacctatcagccacttagcaaccacagcgttacagagatacgacctgccgtttatcaccgatgaagtcaaaaaaacactgaacagaatataccaccagaatcgcaaagtgcatgagaagactgtgaggacagccgctgctgcgatcattttaaacaacaacccctcctatatggatgtaaagaatattctcctaagtattggtgagctgccccaggagatgaataagtacatgttagccatcgtgcaggacatcctgagattcgagatgccagccagtaagattgttcgaagagtgctgaaggagatggttgctcataattacgacaggttctcacgcagtggctcatcttccgcctacacgggctacatcgagaggtcaccccggtctgcctccacctattccttagatatactttacagcggaagcggaatcctcaggcgttctaatctgaatatctttcaatatatcggcaaagcgggcttgcacggttcccaagtcgtgattgaagctcagggcctggaggccctcattgcagccaccccagacgaaggggaagagaatctggactcatacgccgggatgagcgccatcctattcgatgtgcaacttcgacccgtgactttttttaacggctacagtgaccttatgtcaaaaatgctgagtgcttcgggagatcccatctccgtggtgaaaggactgatcctgctcattgaccacagtcaggaattacaactgcagtctgggctgaaggccaacatcgaagttcagggagggctagctattgatatatctggcgccatggagttttctttgtggtatcgcgagagcaaaacccgcgtgaagaaccgggttaccgtagtgattacgaccgatattactgttgattctagttttgtcaaggcagggttggagactagtactgaaacagaagccggtctggagttcatttccacggtgcaattctcccagtaccctttcctcgtttgcatgcagatggacaaggacgaagcaccttttcgccagttcgaaaaaaaatacgagagactctctaccggtagagggtacgtttctcagaagcgaaaggagagcgtgttagccgggtgtgagttcccactacatcaagagaacagtgagatgtgcaaagttgtgttcgcaccacagcctgacagcactagctccggctggttttag

SEQ ID NO: 2685 - DNA, 2685 bp, Artificial Sequence
  Description of Artificial Sequence: Synthetic coding sequence
atgatcttgctggccgtgctttttttgtgctttatttcaagctatagcgcaagtgtgaaaggacacactactgggctgtcgctcaataacgaccgactctacaagctgacatactccactgaagtccttctggacagggggaaggggaaactgcaggactcagtaggctacagaatatcttctaatgtggacgtcgcccttttatggagaaacccagatggggacgacgaccagctgattcagatcactatgaaagatgtgaacgtggaaaacgtcaaccagcagcggggcgaaaagagtatctttaaaggcaaatcccccagtaagattatggggaaagagaatctcgaggctctgcagcgcccaaccctactgcatcttatccatgggaaagtgaaggagttttattcataccagaatgaagctgtagccatcgagaacatcaagagggggttggcaagcctgttccagacgcagttaagctccggaacaactaatgaagtggacatttctggaaactgcaaggtgacttatcaggcacatcaggacaaggtgatcaaaatcaaagccttagattcttgcaagatagcgagatctggattcaccaccccaaaccaggttctaggagtttccagcaaggctacatccgtgacaacttacaaaatcgaggactccttcgtcattgccgtgctggcagaagaaactcacaattttggactgaattttctgcagaccatcaaaggaaagattgtttccaagcaaaagctggaactcaaaacgactgaggctggcccacgcctgatgtccggcaagcaggcagccgctatcataaaggctgtggatagcaaatacaccgccatccctattgttgggcaggtgtttcaatcgcactgcaagggatgtccatctttgtccgaattgtggcggtcgaccagaaagtatctccagccagataacctgtcaaaggccgaagcagtgcgcaattttttggctttcattcagcacctgcgcactgctaagaaagaagagatactgcaaattctgaaaatggaaaataaagaggtattgccacagctggtggacgccgtcacatcagcccagacatccgactcactggaggccattcttgattttctggacttcaaatcggattcttcaataatcctccaggagagatttctgtatgcttgtggatttgcttcacaccccaacgaggaactcctgagagccctaattagcaaattcaaggggtcaataggaagttccgatatccgggagaccgtcatgatcatcacaggtaccctggtacggaaactctgtcagaatgaagggtgtaaactgaaagctgttgtcgaagctaagaagttaatcttaggtggactggagaaggctgaaaagaaggaagacacccgcatgtatttgctagctctgaagaatgctctgcttcccgagggcattcctagcctgctcaaatatgcggaggcgggtgaagggcccatctctcatcttgcaaccacagcgcttcaaaggtacgacctgccatttatcactgatgaggtcaaaaagaccttaaataggatctatcaccagaatcgtaaagtgcacgagaagacagtccgaaccgctgccgccgctattattctgaacaataacccctcttacatggacgtgaagaatattctactgtcaatcggcgagttgcctcaggagatgaataagtatatgctggctatcgttcaagatattcttagatttgaaatgcctgcttctaagatagtacgaagagtgctgaaggaaatggtggcccataactacgacagattctccaggagtggctcaagtagtgcctataccggttacatcgagaggagtcccagatcagcttccacttattccttggatatcctgtactcaggctctgggatcctgaggcggagtaaccttaacattttccagtatatcggcaaggcagggctacacggctctcaggtagttatcgaagcccagggactcgaggcgttgatcgcagccactccggatgaaggagaggaaaacctggacagttatgcagggatgtctgccatcctgttcgatgtgcagttaagaccggtgacctttttcaacgggtacagtgatttaatgtccaagatgctgagcgcctctggagaccccatcagcgtggtgaaagggcttatactcctgatcgatcatagtcaggagctccaattgcagagcgggcttaaggcaaatatcgaagtacagggaggcttagctatcgatatctcgggcgccatggaattctcactgtggtaccgtgagagcaaaacaagggtgaaaaatcgagtcaccgttgtaattaccaccgatatcacagtcgactctagctttgtgaaggccggactcgagacatctacagaaaccgaggccggcctcgagtttatttcaaccgtgcagttctctcagtatccatttttggtgtgtatgcagatggacaaagacgaggcccccttcagacagttcgaaaagaaatatgagcggttaagtactgggcgaggctacgtgagccagaagagaaaagaatccgtgttggcagggtgtgaattcccgctgcaccaggagaattctgagatgtgcaaggttgttttcgcccctcagcccgatagcacatccagcggctggttctag

SEQ ID NO: 2686 - DNA, 537 bp, Artificial Sequence
  Description of Artificial Sequence: Synthetic coding sequence
atggccagagccccgctgcggcccgaaaatactattgtgcgcggcagcgcaaatcagtgtcaggatacctacagggcagaagagcttaccggacacaccaccgggctaagtctgaataacgacagactgtataaattaacctattccacagaggtactgctggacagaggcaaggggaaactgcaggatagcgtgggctatagaataagctcgaatgttgacgtcgccctgctgtggaggaacccagatggtgatgatgatcagctcatacagatcacgatgaaagacgtgaacgtggaaaatgtgaatcagcagcgtggggagaaaagcatcttcaaagggaaatctccgagcaaaatcatgggcaaggaaaaccttgaagcattacaacgcccaacccttttgcatctcattcacggcaaggtgaaggagttctactcatatcagaacgaggccgtagcgatagaaaacataaagcggggcctggcaagcctttttcagacacagttatccagtggtactacgaatgaggtttag

SEQ ID NO: 2687 - DNA, 1551 bp, Artificial Sequence
  Description of Artificial Sequence: Synthetic coding sequence
atgattcttcttgccgttctctttttatgttttatttcatcttatagcgcatctgtcaagggacatacaacgggactctctcttaataatgatcgactgtacaagctgacctactccaccgaggtccttctggaccgcggcaaaggcaaactacaggattcggtggggtacagaattagcagcaacgtcgatgtggccctactttggcggaatccagatggcgatgatgaccagctgatccagatcaccatgaaagacgtaaatgtcgagaacgttaaccagcaacggggcgagaaatctatcttcaagggcaagtccccctcaaagatcatgggaaaggagaatttggaggctttacagcgaccaacactgctacaccttatccacggaaaagtgaaggaattctacagttaccaaaacgaggccgtagccatcgagaacattaaacgcgggctcgcaagtctgtttcagactcagctcagtagtggaaccaccaatgaggtggacatttctggcaactgcaaggtgacctatcaggcccaccaggacaaggttatcaaaatcaaggctctggatagttgtaagattgcacggagcggttttacaacgcccaaccaggtgcttggagttagttcaaaagcaaccagcgtcaccacctacaagatcgaagactcattcgtgatcgccgtactggctgaagaaacacataactttggtcttaatttcttacagaccattaaaggaaaaattgtctctaagcagaaactggagctcaaaactaccgaagctggacccaggctaatgtctggaaagcaggcagctgcaatcattaaggcggtggatagcaaatacaccgcaatccccattgttggccaggtgttccagagtcattgcaagggttgcccatctctgtccgaactgtggcggagtacccggaagtatttacagccagataacctgagtaaggccgaagccgtccgcaacttcctcgcctttatccagcacttgcgaactgcaaaaaaggaagagattctgcagatcttgaagatggagaacaaagaggtgttgcctcaactcgttgatgccgtcacaagcgcccagacttctgattccctggaagccatactcgactttctagattttaagagtgacagcagtatcatcctccaggagcgctttttgtacgcctgtgggttcgcttctcaccccaatgaggagttgctgagagcgctcatatccaagtttaaaggcagtattggctccagtgacatccgggagactgtcatgatcataaccggcactctggtacggaaattgtgccagaacgaggggtgtaagctgaaagctgtcgtcgaagccaagaagttgatcttaggaggcctagaaaaggctgagaagaaggaggacacccggatgtatctcctggctctgaagaacgctctactgccagaaggcattccttccctccttaagtatgctgaggctggtgagggtccaatcagtcatctggctactaccgcattgcagcgctacgatctgtttcacaactag

SEQ ID NO: 2688 - DNA, 3771 bp, Artificial Sequence
  Description of Artificial Sequence: Synthetic coding sequence
atgctgttcaagctgctccaacggcaaacgtatacgtgtctgagtcatcgatatggactgtacgtgtgtttcttgggtgtcgttgtcaccatcgtcagcgcttttcagtttggcgaagtcgttctcgagtggagtcgggatcagtaccacgtcctgttcgactcgtacagagataatatagcgggaaagagctttcagaatcggctgtgccttcccatgcccatcgatgtggtgtatacatgggtgaatggcactgatctggaattgctgaaagaactgcagcaggtgagagagcagatggaggaagaacagaaggccatgagggagattctaggaaaaaacacaacggagcctacaaaaaagtccgagaagcagttagagtgccttctaacacactgcataaaagtacctatgctggtgctggacccagctctgcccgcaaacattaccctgaaagacctgccatcactctaccccagcttccatagcgcaagcgatatttttaacgtcgctaagcctaagaatccctccactaacgtgagcgtggttgtgtttgacagcacaaaggatgtcgaagacgcacactctgggttgctcaaggggaacagccgacagactgtgtggcggggctacctgaccacagataaagaggttcctggtctcgtactgatgcaggacttggcttttctgtccggctttccccccaccttcaaggaaaccaatcagttgaagacaaagctgccagagaatctcagtagtaaggtaaaactgctgcaactttacagcgaagcgtcagtggcactactgaagctgaacaaccccaaagacttccaggaattgaacaagcagaccaagaaaaacatgacgatcgatggaaaggagctcaccatctccccagcgtatctgctgtgggacctgtctgcaatctctcagtccaagcaggatgaagacatctccgccagtcgattcgaagacaatgaggagctccgttacagtctgaggtccatcgaaagacatgccccatgggttagaaatatctttatagtcactaacggccaaattccctcttggttgaacctggacaatcctcgggttacaatcgtcacccaccaagatgtgttccggaacctctctcatttgccaaccttttcttccccagctattgaatctcacattcacagaatagaaggactcagccagaagttcatttacctaaatgatgacgtgatgttcggtaaagacgtgtggcccgacgatttttatagccactcaaagggccagaaagtgtacctgacttggcccgttccaaactgtgccgaaggttgtcctgggagctggatcaaggatggctactgcgataaagcttgcaacaacagcgcctgcgactgggatgggggcgactgcagcggtaatagcggaggctctagatacatcgcgggcggcggggggactgggtcaatcggcgttgggcagccctggcagttcggagggggcattaacagtgtgtcctactgcaatcaggggtgtgctaattcctggttagctgataagttctgtgaccaagcgtgcaacgtactctcctgcggattcgatgctggcgattgcggtcaggatcactttcacgagctgtacaaagttatattactgcccaaccagacccattacattattcccaaaggagagtgtctgccgtatttctcctttgcagaggtggccaaacgtggggtagagggtgcctacagcgacaatcccattattcggcacgccagtattgccaataagtggaaaaccatccatctgattatgcattccgggatgaacgccacgactatccatttcaacctcaccttccagaacactaacgacgaagaatttaaaatgcaaattactgtcgaggtcgacactcgcgaaggcccgaagttaaattctacagctcagaagggatacgagaatctcgtgtctcctatcaccttgttacccgaggccgagatcctattcgaagatatccctaaagagaagcgattccccaagtttaagcggcacgacgtgaactccactaggcgtgcgcaggaagaagtgaaaattcccctcgtcaatattagtctcctgcctaaggatgcccaactatctctgaataccctggatctgcagttggaacatggcgacatcacccttaaaggttacaatttgagcaaatctgccctcttacgaagttttctgatgaactcccagcatgctaaaattaagaaccaggctattatcacggacgagacgaacgatagtctggtagctccccaggaaaagcaggtgcataagtctattctgccaaacagccttggcgtgtctgagcggctacagaggttgactttccccgcagtcagcgtgaaagtgaacgggcacgaccagggccaaaacccccctctggacctggagactacggccagattccgagtcgaaacacacacacagaaaacaatcggggggaatgtgaccaaagagaagcccccatcccttattgtgccactggagagccagatgaccaaggagaagaaaatcacaggaaaagaaaaggagaacagccgtatggaggaaaacgcagaaaaccacataggagtaaccgaagttctgctcggcagaaaactgcagcactataccgactcatatctgggctttctcccttgggagaagaagaaatatttccaggacctgctggatgaagaggaatcattgaagacccaactggcctactttacagatagcaagaacacaggacggcaattaaaggatacttttgcagactcgctccgatatgtcaataagatactgaactccaaatttggatttactagtaggaaagtcccagcccatatgcctcacatgatagaccgaatcgtcatgcaggaactccaagatatgttccctgaggagtttgacaagaccagcttccacaaagtccggcactcggaagatatgcagtttgccttcagctacttctactacctgatgagcgccgttcaacccctgaacatcagccaggtcttcgatgaggtggacacggatcaatctggagtgctctctgatcgcgaaatacggactctagccacaagaatccacgagctgcctttgtcgttacaggacctaacggggcttgagcacatgttaattaactgctcaaagatgctgccagccgatatcacccaattgaacaatattccgcccacccaggagtcatattacgaccccaatctcccgcccgtcacaaagagcttggtcacaaactgcaagccagtgacagacaagattcataaggcctacaaagataagaataagtaccgctttgagatcatgggcgaggaagagatcgcatttaaaatgatccgaacaaatgtgtcccatgttgtgggtcagctcgatgatatccgcaaaaaccccagaaagttcgtgtgtctgaacgacaatatcgatcacaaccacaaggacgcgcaaaccgtcaaagcagtcttacgcgacttctatgagtcaatgttccccattccctcacagttcgagctccctcgcgagtatcgcaatagattccttcatatgcatgagcttcaggaatggcgagcgtaccgcgataagcttaagttttggacacactgtgtgctggctacactgatcatgttcaccatcttcagcttttttgcagaacagctgatcgcactgaagcggaagatatttcctcgtagaaggattcataaagaagcttctccaaaccgcattcgggtttag

SEQ ID NO: 2689 - DNA, 1473 bp, Artificial Sequence
  Description of Artificial Sequence: Synthetic coding sequence
atgctgtttaagctcctgcagagacagacctacacgtgcttatcccacagatacggcctgtacgtttgttttctgggcgtcgtggtcacaatcgtctctgcctttcagtttggggaggtcgtcctggaatggtcacgggatcagtatcacgtactgtttgattcttaccgcgacaacatcgctggcaagtcatttcagaaccgtctgtgcctgccaatgccaatagatgtcgtgtacacctgggtaaatgggacagacctggagctgctgaaagaacttcagcaagtaagagaacagatggaggaggagcagaaggccatgcgggagattctgggcaagaatacaaccgagcccaccaagaagagtgagaaacaactagaatgtctgcttacccactgtatcaaggtacccatgctggtgctggaccccgccttgcccgcaaatatcacgttgaaagacctgccttccctgtatccaagcttccactccgcctctgacatcttcaatgtcgccaaaccaaagaaccctagtactaatgtgagcgtggtggtgttcgatagcacaaaagacgtggaggacgctcactcagggttgttaaagggcaattcgagacagacggtgtggcgggggtatttgaccactgacaaggaggtacccgggttagtcctaatgcaggatcttgctttcctgtccggatttccacctacattcaaggaaactaatcagctcaaaaccaagttgcctgaaaacctctccagcaaggttaagttacttcaactatactctgaggcttcagtggcactgctaaaattgaataaccctaaagatttccaagaactgaataagcaaacaaaaaaaaacatgactatcgacggtaaggagctgactatttcaccggcctacctactctgggacttgtcagccatctcacagagtaagcaagacgaagacatttcagctagcaggtttgaggataacgaggagcttaggtattctctgcgatctatagaacgccacgccccttgggtgagaaacatatttattgtgaccaatggccaaatcccttcctggttgaatctagacaaccccagggtgaccattgtgactcaccaggatgtatttagaaacctctctcatttgcctacctttagcagcccagcaatcgagtcccatattcacaggatagagggcctctcccaaaagttcatttatctgaacgacgatgtgatgtttggcaaagatgtctggcccgacgatttttattctcattcgaaagggcagaaggtctatctcacttggcccgtacccaattgcgccgaaggatgccccggctcctggattaaggatggctactgcgacaaagcctgcaataattcggcttgtgattgggatggcggcgattgtagtgggaaggatgtcttaaactgcaatagtttcatcttcatggagtactttctgttaaaccactactag

SEQ ID NO: 2690 - DNA, 1605 bp, Artificial Sequence
  Description of Artificial Sequence: Synthetic coding sequence
atggctactgcccttatggcagtggtgctgcgcgcagcagctgttgcaccaagactgcggggtagaggcgggactggtggagcacgtagactctcatgcggcgcccggagaagagcggcgagaggtacctctccaggacggcgtttaagtacggcctggtctcagcctcagcctcctccagaagaatacgccggggccgacgatgtctcccaatctccagtggcagaggaaccctcatgggttccatcaccaaggccaccagtgcctcacgagtcgccagaaccaccaagtggcagatccctcgtccagagagacatccaagcttttctcaaccagtgtggggcctcccccggggaggcccgacactggttaacccagtttcagacttgtcaccattctgccgacaagcctttcgctgtcatcgaggtcgacgaggaggttctgaagtgtcagcagggggtgagtagcttggcttttgctctcgcatttctgcagcgcatggatatgaaaccactggtagtcttgggcctgcctgcgccaaccgccccgtcggggtgcctttcattctgggaagcaaaggcccagctggccaagagctgcaaagttctggtggacgcactgagacacaacgccgcagccgctgtgccgttttttggagggggttccgttctccgggcggcagagcctgcgccacatgcaagttatggagggatcgtctcagtggaaacggatcttctccagtggtgtctcgagtcaggatcgattccgattctgtgtccaattggggagacagccgcgcggcgctcagtgctcctagactctctggaggttacagcctcattagccaaagccctccggcctacgaagatcatcttccttaacaacacaggaggcctgcgggattcaagccacaaggtactgtctaacgtaaacctgcctgctgatcttgatcttgtgtgtaatgcagagtgggtgagtactaaagagcgtcagcaaatgcgcctaatagtggacgtccttagtagactcccacatcactcttcagccgtcatcacagccgcatctactctcctgacggaactgttttcaaacaaagggagtgggacactgtttaaaaacgctgaacggatgctgcgtgtccgcagcctggataaactcgaccaaggcaggcttgttgacctggtgaatgcgtccttcggaaaaaagttgcgagatgattatttggccagccttcgaccccgcctgcactccatctacgtcagcgagggttacaatgcagctgccattctgactatggagcctgtcttaggcggtaccccctacttggacaagtttgtggtgtcatcttcccggcaggggcaggggtccggccagatgctgtgggagtgcctacgcagggacttgcagaccttgttttggaggtccagagtgaccaatcctattaacccgtggtacttcaaacacagcgatggcagcttttctaataaacagtggatcttcttttggtttggtctcgccgatatccgggactcttacgagctggtgaaccacgccaaagggctccctgactctttccataaaccagccagcgaccccggctcttag

SEQ ID NO: 2691 - DNA, 1107 bp, Artificial Sequence
  Description of Artificial Sequence: Synthetic coding sequence
atggatatgaaacccctggtcgtgctgggactccccgctcctactgcccccagtggctgtttatcgttctgggaggctaaggcacaacttgcaaagtcttgtaaggtgctggtggacgcgctccggcacaatgcggctgctgctgtgccatttttcggggggggatctgtcctgcgggccgccgaacctgcaccacacgcgtcctatgggggcatcgtgagtgttgagaccgatctactacagtggtgtctcgaatcagggagtatacccatactgtgtccaatcggcgagaccgcggcccgcaggtctgtcctactggactccctcgaggttacagcttcactggctaaggcactgaggccaactaaaatcatcttcctgaataataccggcggcctccgggattcctcccacaaagttctttccaacgttaacctgccagctgatctcgatttggtctgcaatgccgaatgggtgtccaccaaagagcggcagcaaatgcgccttatagtagatgtgctgtcccgtctcccccaccactcatctgctgttattactgctgcatctactctgctcaccgagctgttttccaacaaaggctcagggacactgttcaaaaatgccgaaagaatgctgcgcgtccgtagtctcgataaactggatcagggacgtctcgtcgatctggtgaacgctagttttggaaagaaactgagggacgactatcttgcctctcttagacccagactgcacagcatttacgtgtcagaaggatataatgccgccgcaatccttactatggagcccgtgctcggcggtacaccgtacttggacaagtttgttgtctccagcagtcgccaaggacagggttccggccagatgttgtgggaatgcctgagaagggaccttcagaccctcttctggcgatcccgagtgaccaaccccatcaacccctggtactttaaacacagtgacggatcctttagtaacaagcaatggatctttttctggtttggcctagctgacattcgcgatagttacgaactcgtgaatcacgccaaggggcttccggacagctttcacaaaccggcaagcgaccccggaagttag

SEQ ID NO: 2692 - DNA, 1188 bp, Artificial Sequence
  Description of Artificial Sequence: Synthetic coding sequence
atgcctgggcggtcttgcgtagcactggtgttgctggcggcggcagtttcctgtgctgtcgcacagcacgccccaccgtggactgaggactgcagaaagtctacatacccccctagcggccccacatataggggcgctgtgccttggtataccataaacctggacctccccccatataaacgctggcacgaactcatgctcgacaaagcacccgtgcttaaggtgatcgtgaacagcctcaaaaatatgattaacaccttcgttccttcagggaagataatgcaggtcgtcgatgaaaagctgccagggctgctgggaaacttccccggcccctttgaagaagagatgaaaggaatagccgcagtcaccgacatccctctcggagagataatctccttcaacatcttctatgaattgttcacaatctgcactagcatcgtggccgaagacaaaaaagggcatctgattcacgggaggaacatggactttggagtcttcctcggttggaacataaacaatgatacctgggtgatcactgagcagctcaagccccttaccgtgaatctagactttcagcggaacaataagaccgtatttaaggcatctagctttgccggatatgtcggcatgctgacaggctttaaacccggtctcttcagcctaacgctgaatgagcgcttctccattaatggcggctatctgggcatcttagagtggatcctcggtaagaaagacgttatgtggatcgggttcctgacaagaaccgtattggagaacagcacttcgtacgaggaagcaaaaaatctgctcacgaagaccaaaattcttgctccagcctattttatacttggggggaaccagtctggtgaggggtgtgtaatcacccgcgaccgaaaggagtccttggatgtctacgaactggacgcaaagcagggtcggtggtatgtggtgcagactaattatgaccggtggaagcaccccttttttctggacgaccggcggacaccagccaaaatgtgcctcaatcgtacttcccaggagaatatcagtttcgagacaatgtacgatgtgctgagtacaaagccagtgctgaataaattaactgtatacactaccctgattgatgtcactaaagggcagttcgagacttacctccgagactgccccgacccttgtattggatggtag

SEQ ID NO: 2693 - DNA, 1170 bp, Artificial Sequence
  Description of Artificial Sequence: Synthetic coding sequence
atgaactgctgcatcggccttggtgagaaggctcgcggatcacatcgtgcctcctaccccagcttgtcggctcttttcacagaggcttcaattctaggcttcggctctttcgctgtgaaagcccagtggacagaggactgcagaaaaagcacgtatccacctagtggtcccaccgtttttccagccgtaattaggtatcgaggagctgtgccttggtacacaatcaatcttgacctcccgccttataagaggtggcatgagctgatgctggacaaagctcctgtgcccgggctactgggaaactttcctgggcccttcgaggaggagatgaaaggcatcgccgcggttaccgacattcccttgggagagatcatcagtttcaatattttctacgagctcttcactatctgcaccagcatcgtggccgaagataaaaaaggacacctcatccacggccgtaatatggatttcggcgtttttctgggatggaacatcaataacgatacatgggtcattaccgagcagctcaagcctctaaccgtaaatctggattttcaacggaacaacaaaaccgtctttaaggcttcctctttcgcaggttatgtcgggatgctgacgggatttaaaccagggctgttcagtcttaccttaaacgagcggttttctataaatgggggctatcttggcatacttgaatggatcctgggtaagaaggatgtgatgtggatcggtttcttaacccgaactgtgttggagaactctacttcctacgaggaggcaaaaaatctgctgaccaaaaccaagatcctggcacccgcctattttatcctgggaggcaatcagtctggcgaggggtgcgtgatcaccagagacagaaaagagtctctcgatgtatacgagttggatgcaaagcagggcaggtggtacgtcgtccaaaccaattacgatagatggaaacatcccttctttctggatgacaggcgaacacccgcaaaaatgtgtctgaaccgcacatcccaggaaaacatttcattcgagacgatgtatgatgtcctgtctaccaaacccgtgctgaacaaattgacagtctataccaccttaattgacgtgacaaagggccagttcgagacatacctccgtgattgtcccgatccttgcatcggatggtag

SEQ ID NO: 2694 - DNA, 1236 bp, Artificial Sequence
  Description of Artificial Sequence: Synthetic coding sequence
atgaactgctgtattgggcttggcgagaaagcgcggggatcgcacagggcctcttaccccagcttgagtgcattattcacggaggctagcatactcggatttggtagcttcgccgtgaaggctcagtggacagaagattgccggaagtctacttaccctccaagtggtcctacttaccgtggagctgtgccttggtacactatcaatttggatttacccccctacaaaagatggcacgaactgatgttggataaggcccctgttctaaaagtcatcgtcaactcattaaagaatatgattaacacctttgttccctcaggcaagattatgcaggtcgtggacgagaaactacctggcctgctcggcaattttcctggcccctttgaggaagaaatgaaaggtattgcggctgttaccgatatacccctcggggaaatcatcagcttcaatatcttctacgagctctttacaatttgcactagcatcgtcgctgaagataagaaggggcacttaatccatggaagaaacatggattttggggtctttctgggctggaatattaataatgacacctgggtgattacagaacagttgaagccactgacagtgaatttggacttccagaggaacaacaagaccgtgttcaaagcaagttccttcgcgggctatgtgggaatgctgacgggttttaagccaggcttgttttccctgacactgaacgagcgtttttccatcaacggcggctacctgggcattcttgagtggatcctggggaagaaggatgttatgtggattggtttccttacgcgcacggtgctggagaactcgacctcttacgaggaagctaagaatctcctcaccaaaactaaaattctcgcgcccgcttacttcatcttaggggggaaccagtccggcgagggctgcgtcatcactagagaccgtaaggaatctctcgatgtttacgagctggatgccaagcagggacgctggtatgtggtccaaaccaactacgaccgctggaagcatccattttttctcgatgatcggcgaactcccgcaaaaatgtgtcttaatagaaccagtcaggaaaatatcagcttcgaaactatgtacgacgtgctttcaacgaaacctgtactgaacaaactaactgtgtacactacgctgatcgatgtgacaaagggccagtttgagacgtacctgcgcgactgtcctgacccctgtattgggtggtag

SEQ ID NO: 2695 - DNA, 918 bp, Artificial Sequence
  Description of Artificial Sequence: Synthetic coding sequence
atgctcgataaggctcctgtgcttaaggtgattgtgaactcactgaagaacatgattaatacctttgtcccaagcgggaagatcatgcaggtggtagatgagaagttgcctggcttgctgggcaattttcccgggcctttcgaggaagagatgaaaggaattgccgccgtgaccgacatccctcttggacatctcatccacggcaggaacatggattttggcgttttcctaggatggaatataaataacgatacatgggtgattaccgagcagctgaagccactgacagtgaatctcgacttccagagaaataacaaaacagtgtttaaagcaagctcctttgctggatacgtcggaatgctcacaggtttcaagccaggactgtttagtctcaccctgaacgagaggttttcaatcaacggcgggtacctagggatcttggaatggattttgggaaagaaggacgttatgtggataggttttctgaccaggacagtgctcgaaaattcaacaagctatgaggaggcgaaaaacttactgactaagacaaagattctggcaccagcttacttcattctgggaggaaaccagtctggagagggctgtgtcatcacccgcgatcgaaaagaatctctggatgtgtacgaattggatgccaaacagggtcggtggtacgtggtgcagaccaattacgatcggtggaaacacccattctttctggacgataggcgcacacctgctaaaatgtgcctcaatagaactagccaggagaacatctcctttgaaaccatgtacgatgtactatctacaaaacctgtcctgaacaaattgactgtttataccactttgatcgacgtgaccaaaggccagtttgaaacgtatttgcgcgactgccctgatccgtgcatcggatggtag

SEQ ID NO: 2696 - DNA, 1113 bp, Artificial Sequence
  Description of Artificial Sequence: Synthetic coding sequence
atgcccgggcggagctgcgtcgcattggtgctcctggcggcagcggtgtcctgtgctgttgctcaacatgcaccgccatggaccgaggattgtcgtaaatcgacctaccccccttccggtccgacataccggggggcggtgccatggtacaccataaacctcgatttgcctccttataagcggtggcatgaactgatgttggataaagccccggtcctcaaagtgatagtgaacagtctgaagaacatgatcaataccttcgtgccttccggcaagatcatgcaggtggtggatgagaagctgccgggcttgttaggcaatttccccggcccctttgaagaggaaatgaaaggtatcgccgcagtgactgatatccctctagggcacctcatccatggccgaaacatggatttcggggtttttctgggctggaatatcaacaatgatacctgggtgatcacagagcaactcaagcccctcacagtgaatttggactttcagcgcaacaataagactgtcttcaaggcaagttccttcgccggttacgtgggtatgctgaccggcttcaagcctgggctgttcagcttaactctcaatgagaggttctcgataaatggagggtatctgggaatcttagagtggatcttgggcaagaaggacgttatgtggatcgggtttctgacaaggacggtgcttgagaacagcacgagctatgaggaggcaaaaaacctactcaccaagacaaagatactcgctcctgcttactttattctaggcggcaatcagtccggggagggatgtgtgatcacacgcgaccgtaaagaatccctggatgtgtacgagctcgacgcaaagcagggaaggtggtacgttgttcagacaaactatgatcgatggaagcacccattcttccttgacgatcggaggactcctgctaaaatgtgcctcaacaggacatctcaagaaaatatctcattcgaaacaatgtacgacgtcctgagtacaaaacccgtgctcaacaagctgactgtgtatacaacattaatcgatgtgaccaagggacaatttgagacatacctgagagattgtccagacccatgtatcggatggtag

SEQ ID NO: 2697 - DNA, 405 bp, Artificial Sequence
  Description of Artificial Sequence: Synthetic coding sequence
atggatccgcagactgcccccagtcgggcactactcctcctgctgttccttcatctggcatttttgggcggtagaagtcacccacttggctcaccggggtccgccagcgacctagaaacatccgggctgcaagagcagcggaaccacctgcaaggtaagttaagcgaactgcaagttgagcagaccagcctggaacccttgcaggagtccccacggcccactggcgtatggaaatctagggaagtggccacggaaggcatccgcgggcacaggaaaatggtcctgtatactttacgcgctcctcgctcccctaagatggtccaggggagcggatgctttgggaggaaaatggacaggatctcctcttctagtggcctcggttgtaaagtgctcaggcggcattag

SEQ ID NO: 2698 - DNA, 726 bp, Artificial Sequence
  Description of Artificial Sequence: Synthetic coding sequence
atgagcatgctcttctacactctcattacagctttcctcatcggcattcaggcggagccccattccgagtctaatgttccagctggacacactatccctcaggcccactggacaaagctgcagcattccctggacaccgccttaaggcgcgctaggagcgcgcccgcagccgcaatagcggctcgggttgccgggcagacacggaatattactgtcgatcctcggctgtttaagaagcggcgcctgcggagcccacgtgtcctcttttcaacacagcctccacgtgaggccgcggatactcaggacctcgatttcgaagtggggggtgctgcaccgtttaatcgtacacaccggtcaaaaaggagctccagtcatcctattttccatagaggtgagtttagcgtgtgcgacagcgtgagcgtgtgggtgggcgacaagacaacagctactgacattaaaggaaaggaagtgatggtgctcggcgaggtgaacataaataacagtgtgttcaagcagtacttttttgagacaaaatgccgcgaccctaacccagtcgattcgggttgtcgtggaattgattccaagcattggaacagttattgtactacgacccatacttttgtgaaagctttgacaatggacggcaagcaggccgcttggagatttatccgcatagacactgcctgcgtctgcgtgctctctcgaaaagcagttagacgcgcttag

SEQ ID NO: 2699 - DNA, 1923 bp, Artificial Sequence
  Description of Artificial Sequence: Synthetic coding sequence
atgagcgagcggaaagaaggacgcgggaaggggaaggggaagaagaaagagaggggttctggtaagaagcccgagtctgcggccggtagccagagtcccgcattaccaccacggcttaaagagatgaagtctcaggagtccgctgccggaagtaagctagtgctgcgttgtgagaccagctccgagtatagttctctgagatttaagtggtttaaaaacgggaacgagttgaatcggaagaacaagccacagaacatcaagatccagaaaaagcccggtaagtcagagctcaggattaacaaagccagcctggccgactcaggggagtatatgtgcaaagtcatcagtaagctcgggaacgattcagcaagtgccaacataaccatcgtcgaaagcaatgaaattataaccgggatgcccgccagcaccgaaggtgcctatgtatcttcagaatcgcccatcaggattagtgttagtaccgagggcgctaacaccagcagttcaacctccacatctactactgggacttctcacttagttaagtgcgccgagaaagaaaagacgttctgtgtaaatggaggggagtgttttatggtcaaagacctgtccaacccgagtcgttacctgtgcaagtgccagcctggtttcactggtgcacgctgcacggaaaacgtccccatgaaggtccagaatcaggagaaggccgaagaactgtatcagaagcgggtgctgactattacgggcatctgtatcgcgcttcttgttgtgggcatcatgtgcgtcgtggcttattgtaagacgaagaagcaacgcaaaaagctgcacgacaggctgcgacagtcactgcggtcagagagaaacaatatgatgaatatcgcgaacgggccacaccaccctaatccaccccctgaaaatgtgcagctcgtgaatcagtacgtgtccaaaaacgttatctctagcgaacatatcgtggaacgagaggctgaaacatccttctccacctcacattatacttctaccgcccatcattccacaacagtaactcagaccccatcgcactcctggtctaacggccatactgagtctatcctaagcgagagccactcagtgatcgtgatgtcctccgtggagaactctcggcacagttctcccacggggggccccagagggcgactaaacggaaccggcggccctcgcgagtgcaactcctttctgagacatgccagagagacccccgactcgtatcgcgatagtccccatagtgagcggtacgtgtccgccatgactacgcctgccagaatgtcaccagtggatttccacactccatcgtcccctaagtctccaccgagcgagatgtctccaccggttagtagtatgacagtgtctatgccatccatggctgtgagtccctttatggaggaggaacggccactgctgttagtgacccccccacggcttagggagaagaaattcgaccaccatccccagcaattcagctctttccatcataatcctgcccacgactctaactccctgcctgctagcccactcagaatcgtcgaggacgaggagtacgagaccacccaagagtatgaaccagcccaggaacctgtgaagaagttagctaattccaggcgtgccaagagaaccaaaccaaatgggcatatcgcaaacaggcttgaggtggactcaaacactagctcccagagttctaacagcgagtccgagaccgaagatgaaagagtgggcgaggatactcccttcctgggaatccaaaaccccttagcggccagcctggaagctacgccggccttcagactggccgactcacgaacaaaccccgccggtcgcttctcaacccaggaggaaattcaggcccgcctgagcagtgtgatagccaaccaagaccctattgccgtgtag

SEQ ID NO: 2700 - DNA, 1914 bp, Artificial Sequence
  Description of Artificial Sequence: Synthetic coding sequence
atgagcgaaaggaaggagggccggggtaagggaaagggaaaaaaaaaagagcgaggtagcggcaagaagcccgaaagtgcagccgggagccagtcaccagcgcttccaccccggctcaaggagatgaaatcccaggaatccgctgctggaagtaaattagtgctgagatgcgaaacaagttctgagtattctagcttgcgatttaagtggtttaaaaacggcaacgagctgaatcggaagaataaaccacagaacataaagatccagaagaagcccggtaagtcggagctaaggatcaataaggcaagcttggctgactctggcgagtatatgtgcaaagtaatttctaagctcgggaatgacagcgccagtgccaacatcactattgtcgagagtaatgaaatcattactgggatgcccgcgtccaccgaaggcgcctacgtgagctctgaatcgccaattagaatatctgtctctacagaaggcgcgaacacaagctcaagcaccagcacgtcaaccaccggaacttcacacctggtgaagtgcgcagagaaggagaaaacgttttgtgtgaacggtggcgaatgttttatggtgaaggacctcagcaatccttcccggtatctttgcaaatgtcctaatgaattcactggcgaccggtgccaaaactacgttatggctagtttttacaaagcagaagagctataccaaaagagggtcttgacaatcactggcatatgtatagctcttcttgtggtgggtatcatgtgcgtagtcgcttactgtaagacgaagaagcagcgcaagaagctccatgacaggcttcggcagagtcttaggtctgaacgaaataacatgatgaatattgccaacggacctcaccatccaaatccaccgccagagaatgttcagcttgtgaatcagtatgtctccaagaacgtaatctcatctgaacacatcgtggagcgcgaggctgagacatcgttcagtacttcacactatacatcaactgcgcatcactctaccacagtcactcagactcccagccactcgtggagcaatggccacactgaatctatacttagcgaatcccattctgtgattgttatgtcttctgtggagaatagcagacattctagtcccactgggggtccaagaggccggcttaacgggacagggggtccacgggaatgtaactcctttcttcgccatgctcgggaaacaccagattcgtacagggactccccgcacagcgaaaggtatgtctcagctatgacaacgccagctaggatgtctcctgtcgactttcacaccccatcatcaccgaagtctcccccctcagaaatgagcccaccagtttcctctatgaccgttagtatgcccagcatggcagtgagtccattcatggaagaggagcgccctctgctccttgtgacccctcctcgccttcgcgagaaaaagttcgaccaccacccccagcagttcagctcattccatcataatccggctcacgattccaactctctacccgcctcacctcttaggatagtggaggatgaggaatatgagacgactcaggagtacgagcctgcccaggagccagtaaagaaattggccaattcaaggcgagcaaagaggactaaacccaatggccacatcgcaaaccgtctggaggttgactccaatacctccagtcaatcatcaaattcagaatctgagaccgaggacgagcgcgtaggagaggacacacccttcctcgggatccagaacccgctggcagccagcctcgaggccacaccagcattccgactagccgactcacgaaccaaccccgctgggcggttctcaacccaggaggaaatacaagcgcgtctgtccagtgtgatagcaaaccaagaccctatcgccgtgtag

SEQ ID NO: 2701 - DNA, 1836 bp, Artificial Sequence
  Description of Artificial Sequence: Synthetic coding sequence
atgagcgaaagaaaggaggggaggggtaaggggaagggcaagaaaaaagaaagaggaagcggcaagaaacctgaatccgcagccgggtcacagtccccagccctcccccctagacttaaggagatgaagagccaagaatcagctgccgggagcaagcttgtactgagatgcgagacttccagcgagtattccagtctccgcttcaaatggttcaaaaatggaaatgaactgaatcggaagaataagccccaaaacatcaagattcaaaagaaacccggcaagtcggagctccggatcaacaaagcctcactggccgacagcggggaatacatgtgtaaggtgatctcaaaattggggaatgattccgccagcgcgaacatcacaattgtcgagagcaatgctacttcaacatctaccactggaacctctcatctcgttaagtgtgcagagaaagagaaaacgttctgtgtgaatgggggagagtgctttatggtcaaggacctgagcaacccctcacggtatctatgcaaatgtcccaatgagtttaccggtgaccgatgccaaaactatgtcatggcttcattctacaagcatctcgggattgagtttatggaggctgaagagctgtaccagaaaagggtgttgacaatcaccggaatctgcatcgcactgctcgtggtgggcataatgtgcgtcgtcgcttattgtaagacaaaaaaacagcgtaagaagctgcacgacagactcagacagtctctgaggtctgagcgtaacaatatgatgaatattgctaacgggccgcaccatcctaacccaccccccgaaaacgtccaattagtgaaccagtatgtgagcaagaatgttatctcctccgaacatattgtcgaaagggaggccgagacgagtttctcgacaagtcattacacaagcacagctcaccactctacaaccgtcacccagaccccaagccacagttggtcaaacggtcatacggaatctatacttagtgagtcacattccgtgatagttatgagctctgtcgaaaactcccggcatagctctccaacggggggacctagaggcaggttgaacggcactggaggtccacgtgaatgcaattcatttctcaggcacgccagggaaacccctgactcgtacagagacagtccccactcagagcgctatgtgtctgcaatgaccacaccggcacgtatgagtcccgttgacttccataccccatcatctccaaaatcacccccgtctgagatgagtccacccgtctcatcgatgaccgtgagcatgcctagcatggccgtgtcaccattcatggaggaggaacgtcctctgctgctcgtgactcccccacggctgcgggagaagaagttcgaccatcacccccagcagtttagttcatttcatcataatccagcccatgattctaattcactccccgcctcacccctgcggattgtggaagacgaggagtatgagactacccaggagtacgaaccagcccaagaacccgttaagaaacttgctaactcaagacgcgcaaagcgcacaaagccaaacggccatatcgccaataggctcgaggtggattcaaacacttctagccagtccagcaattccgaatccgagactgaggatgaaagagtgggggaagatactccgttcctgggcatccagaatcctctggcggcgagccttgaagcaactccagctttccgactggctgactcccgcactaatcccgcagggaggttttcaacacaagaggaaattcaggctagactgtcctccgtgattgcgaatcaggacccaatcgctgtttag

SEQ ID NO: 2702 - DNA, 1947 bp, Artificial Sequence
  Description of Artificial Sequence: Synthetic coding sequence
atgagtgagaggaaggaaggtcggggaaagggcaaaggcaagaaaaaggaacgcgggtcaggcaaaaaacccgaatctgctgcaggcagccagtcgcctgccctgccgccgcgactgaaggaaatgaaatctcaggaatctgcagctggtagtaaacttgtgctgagatgcgaaacctcctcggaatactcctctcttaggtttaaatggtttaaaaatggaaatgagttgaaccgcaagaataagccccagaatatcaagatccagaagaaaccaggaaaaagtgaactcagaataaacaaagcctcccttgcagattctggggagtacatgtgcaaggttatttctaaactaggcaatgactcagcgtctgcaaatatcacaatagtggagagtaatgagatcatcacaggcatgcccgctagtaccgaaggcgcttatgtctcgtccgagtcaccaatcaggatctcagtttccacggaaggcgccaatacaagcagttccacttccacctcaacgactggaacctcacatctggttaagtgtgcagagaaggagaagactttctgcgtgaacggaggggaatgcttcatggtcaaggacctgagtaacccctctagatacttgtgtaaatgccaaccaggctttacaggcgctcgttgtactgaaaatgtgccaatgaaagtccagaatcaggaaaaacacagtggtgagccattccccgaggctgaggagctctatcagaagagagtcctgactataaccggcatctgcattgccttactggtggtggggatcatgtgtgtagtcgcctactgcaaaaccaaaaagcagcgcaagaaattgcatgacagattgcggcagagtctccggtcagagcggaataatatgatgaacattgctaacggaccgcatcacccaaatcccccgccagaaaacgtacaactcgtgaatcagtacgtttctaaaaatgtgatttcctctgagcatattgtcgaaagggaggctgaaacctctttttcaacaagtcattatacatcgaccgctcatcactcaaccaccgtcacgcagactccttcccacagttggtctaatggacatacagaaagtatattgagcgagtcccactctgtgatcgtgatgtcgagtgttgagaactcacgccactcatctcccactggaggtcccagaggccggcttaatggcacaggaggtccaagggaatgcaactccttccttaggcacgcgcgggaaactccagacagttaccgagacagcccccactctgagcgctacgtatccgctatgacaacgcccgcccgaatgagcccggtggactttcatactcctagttctccaaaatcgcctccatctgaaatgtctcctcccgtatcaagtatgaccgtttccatgccgtcaatggctgtgtccccttttatggaggaggaaaggccattgctcctggtcacgcctccccgcctgagagagaaaaagttcgatcaccatcctcagcaattttccagcttccatcacaatccagctcacgatagcaacagtcttcctgcaagcccattgcgcattgtggaggatgaagagtatgaaactacacaagagtatgaacccgcgcaggaaccggtgaaaaagctggccaattctcgtcgcgctaagaggacgaagcccaacggacacatcgcaaaccgtctggaggtggactcgaacacttcatcccagagttcgaacagcgaatccgagacagaggacgagcgcgtgggagaagacaccccttttctcggcattcagaatcctcttgctgcttcacttgaagcaactccggcctttcgtctggcagatagcaggactaatccggcggggcgcttctctacccaggaggagatccaggctcggctatcatctgtgatagctaatcaggatcctattgcggtgtag

SEQ ID NO: 2703 - DNA, 744 bp, Artificial Sequence
  Description of Artificial Sequence: Synthetic coding sequence
atgtccgaacgtaaagaaggaagaggcaagggaaagggtaagaagaaggagaggggtagtgggaaaaaaccagagtcagcagcaggttcacaaagtcctgcccttccaccgcgcctgaaagagatgaaatcccaagaaagcgccgctggatcaaaactcgtcctgcgctgtgagacatcatccgaatatagcagtctgaggttcaagtggtttaagaacgggaacgaactcaaccggaagaataagccccagaatattaaaatacagaagaagccggggaaatccgagctacgtatcaacaaagcatctctggccgatagcggggaatacatgtgcaaagtgatttctaagctagggaatgattctgccagcgccaacatcactatcgtggagtcgaatgagatcattaccggaatgcccgcatccacagaaggagcatatgtttcctccgagtcccccattagaattagcgtgtcaactgagggagcaaataccagctcaagcacttctacatctaccactggtacttctcatctggtgaaatgcgccgaaaaggaaaagactttctgcgtaaatggcggcgaatgctttatggttaaagatttgtccaacccatcccgctacctttgcaagtgccagccagggtttactggagcaagatgcacagaaaacgtgcccatgaaggtgcagaaccaggaatcagctcaaatgtccctactggtcatagccgcgaagactacatag

SEQ ID NO: 2704 - DNA, 1938 bp, Artificial Sequence
  Description of Artificial Sequence: Synthetic coding sequence
atgagcgagagaaaagaaggcagggggaagggaaaagggaagaaaaaagaaaggggctccgggaaaaagcccgaatctgcagccggcagccaatcccccgcactcccgccgcggcttaaggaaatgaagtcacaagaaagtgctgccggtagtaagttggttctacgctgtgagacatcctccgagtactcaagcctgagattcaaatggtttaagaatgggaatgagctgaaccgaaaaaacaaaccccagaacatcaagatacagaaaaagccaggcaagtcagagctgcggatcaacaaggcctccctcgctgactccggtgagtacatgtgcaaggtgatatcaaaactgggtaatgatagcgcctccgctaatataacaatcgttgagagcaacgaaatcatcaccggaatgcccgccagcaccgagggtgcttatgtcagcagtgaaagccccattcgaataagcgtgagcacagagggtgcgaacacatcaagttccacatctacaagcacaacaggcaccagtcatcttgtcaagtgtgcagagaaggaaaaaaccttttgcgtaaatggcggggaatgttttatggtgaaagatttgtctaatccctcacgatatctatgcaagtgccccaatgaatttaccggagataggtgccagaattacgtgatggcctctttctataagcacctggggattgagtttatggaggccgaagaactgtatcagaaaagggtcctgaccattaccggcatatgtattgccctgttggttgtagggattatgtgtgtggtcgcatactgcaaaactaagaagcaaaggaagaagttgcatgaccgacttagacagtctttgagatcagagagaaacaacatgatgaacattgctaacggccctcaccatcccaatcccccgcccgaaaatgttcagctggtcaatcagtacgtttctaagaacgtcatttcatccgagcatattgtcgagagggaggcagagacttccttctctacttcgcactatacgtccaccgcccaccattcgacgaccgtgactcagacaccgagtcacagttggagcaatgggcatactgagtccatcctcagcgagagtcacagtgttatcgtgatgtcgtcagttgaaaattcaaggcactcaagtcccaccggcggcccgagaggacgactgaacggaacgggcggccctagggaatgtaacagtttcttaagacacgctagagagacgccagattcttatagagactctccccactcagagcgttacgtctccgctatgactacacctgcacgcatgagtcctgtcgattttcacaccccaagcagccccaagtcccccccttcagaaatgagtccgccagtgtcttcaatgactgtgtctatgccaagtatggcggtgagcccttttatggaggaagaacgacccctgttgctggtgaccccccccagactacgggagaaaaaatttgaccaccaccctcaacagttctcttctttccaccacaatcccgcccacgactccaactctctgcccgcttcacccctgcgtattgtcgaagacgaggagtacgaaaccactcaggagtatgagcctgcccaggagcccgtgaagaaacttgctaattcacgccgggctaaaaggactaagcctaacggccacatagctaataggttagaggtagattccaataccagctcacagagcagtaactcggagtctgaaacagaggacgaacgcgtgggggaggatactccattcctggggattcagaatccattggccgcaagtctggaggccacacctgctttcaggcttgccgatagcagaaccaaccccgccggcagattcagtacccaggaagaaatccaggcaaggcttagcagcgtgatcgcgaaccaagatccaatagctgtgtag

SEQ ID NO: 2705 - DNA, 1923 bp, Artificial Sequence
  Description of Artificial Sequence: Synthetic coding sequence
atgtccgaaaggaaggagggcagaggtaagggaaagggaaagaagaaagaacgaggttccggtaagaagcccgagagtgccgccggctcgcagtcccccgccctgccaccacgcctgaaggaaatgaagtcccaagagtccgctgcgggcagcaagcttgtgctccggtgcgagaccagcagcgaatactcaagccttcgcttcaagtggtttaaaaacgggaatgaactgaaccgcaaaaataaacctcaaaatatcaagattcagaagaagccaggcaagtccgagttaagaatcaacaaagcatcattggctgacagtggagaatacatgtgtaaagtgattagcaagctgggcaacgactccgcctccgcgaacatcactatcgtagagtcaaacgagatcataactggcatgccagcctcgacagagggggcctatgtgtcaagcgagtcaccaatcaggatttctgtcagcactgagggtgccaacacaagtagctctaccagtacctccacgactgggaccagtcacctcgtgaagtgcgccgagaaggagaaaactttctgcgtcaatggcggcgagtgctttatggttaaggatcttagcaacccgtctaggtatctttgtaaatgtcagcccggattcaccggagctcggtgtacagaaaacgtccccatgaaagtacagaaccaagaaaaagctgaggagctataccaaaagcgcgtcctgaccattacagggatctgcattgcactgttagtggttgggattatgtgtgtggtggcttattgcaaaaccaagaagcagaggaaaaaactccatgataggctgcgccagtcattaagatcagagcggaacaacatgatgaatatcgcaaatgggccacaccaccctaatccaccacccgaaaatgtacagctcgtcaatcagtatgtctccaaaaatgtgatctcttccgagcacatagttgagcgagaggccgagacgtccttctcaacttctcactacacgtcaacggcccatcattccacaactgtcacacagaccccctctcactcttggtcgaatggccatacagagtccattctgagcgaatcccactccgtgattgtgatgtcaagcgtggagaactcacgacacagctcccccacgggcggtccccgcggtagactgaacggaaccggaggtcctcgggaatgcaactcatttctgaggcacgcccgcgaaacacccgatagttaccgagacagtccacattcagagcgatacgtcagcgctatgaccacacctgccaggatgagtcccgtggactttcacactcccagctccccaaagtctccaccctctgaaatgtcgccgccagtcagttccatgaccgtttctatgccatcgatggccgtctctccctttatggaagaagaaagaccactcctccttgtcacgcctcccagactgcgggagaagaaattcgatcaccaccctcaacaattcagttcgttccaccacaatccagcccacgattccaactctttaccagcttcgcccctgagaattgtggaagacgaggagtacgagacgacgcaagagtacgagcccgctcaggagccagtaaaaaaattagccaatagccggcgggctaaacggaccaagcccaacggtcacattgccaatagactggaggtcgactccaatacaagttctcaaagctccaactctgagagcgagacagaggacgagcgagtcggcgaagatacccctttccttggcatccagaatccattagccgcctcactcgaagccactcctgcttttaggctggctgacagccgaacaaatcctgccggacggttttcaacacaagaggagattcaggctcggctgtcttctgtgatcgccaaccaggatcccatcgccgtgtag

SEQ ID NO: 2706 - DNA, 1773 bp, Artificial Sequence
  Description of Artificial Sequence: Synthetic coding sequence
atggggaaagggcgtgccggcagggtcggaacaactgccttaccccctcggctgaaagagatgaaatcccaagagagcgcagccggctctaaactggtgttgcgctgcgaaacatcctctgagtactccagtctcaggttcaagtggtttaagaatggcaacgaactgaatagaaaaaataaaccccagaacatcaagattcagaagaagcctggcaaaagcgagctacggattaataaggccagcctcgctgattctggggagtatatgtgtaaggtcatctcaaaactgggcaatgattcagcaagcgccaacatcaccatcgtggagagcaacgcaacttccacatctaccaccggcactagtcatctggttaagtgcgccgagaaagagaagaccttctgtgttaacggtggggagtgcttcatggttaaggatctctccaatccctctcgatatctctgtaagtgcccaaacgaattcaccggcgaccgctgtcagaactacgtaatggccagcttttacaagcatcttggaatcgaattcatggaagccgaagagctgtatcagaagagggtcctgactatcacaggaatttgcattgccctccttgtggtggggattatgtgcgtggtggcatactgcaagactaagaaacagcgaaaaaagctgcatgaccgtctccgacagagcttaagaagcgaacgcaacaacatgatgaatatcgccaacggtccgcatcaccccaacccccctccggagaatgtgcagctcgtgaaccagtatgtttccaagaatgtgatatcttcagagcacattgtggaaagggaggccgagaccagttttagtacgtcccattacacaagcaccgcgcatcattctacaacagtgacccagaccccaagtcacagctggtccaatgggcacacagaaagtatcctatccgagtcgcacagcgtcatcgtgatgtccagtgttgagaattcccgacattcttccccgacaggaggtcccagaggcaggctcaatggcactggcggcccgcgagagtgcaactctttcttgagacatgcccgcgaaactccagacagttaccgggactcccctcactctgaacgatacgtaagcgcgatgacaactcctgctcgcatgtcccccgtcgatttccatacacctagtagtcctaagtcccctccctccgaaatgtcccctcccgtgtcctccatgactgtcagcatgcccagcatggctgtaagcccttttatggaggaggagcggccactgctcctggttactccgccacgactacgagagaagaaatttgaccatcacccgcaacagttttcctccttccatcacaacccagcacacgactccaattccctgcctgcctcccccctgcgaatagtcgaggacgaggagtacgagaccactcaggaatacgaaccagcccaggaaccggtgaagaaactcgcgaactcaagaagagcaaagcgaacgaaaccaaacggccacatagccaacagacttgaagtggactctaatacaagttcacagtctagcaatagtgagtcagaaaccgaggacgagcgagtgggggaggacacacccttccttggcatccaaaatcccctggcagccagcctcgaagcgacacctgcatttcgtctggctgattcccgtacaaaccccgccggtcggttcagcacacaggaggaaattcaggccagattgtctagcgtgattgcaaaccaggatcctatcgcggtgtag

SEQ ID NO: 2707 - DNA, 1269 bp, Artificial Sequence
  Description of Artificial Sequence: Synthetic coding sequence
atgaggtggcgccgggctccaagaaggtctggacgccccggtcctcgtgcacagaggcctggctcggccgcgcggtcttcgcctcccctgccgcttctgccactgttgctcttgctcgggacagccgccctggcgcctggcgcagccgcaggaaacgaagcagccccggccggcgcctccgtgtgctacagcagccctcctagcgttgggtccgtgcaagaactggcccaacgcgctgcggtcgtgattgaggggaaggtacaccctcagcggaggcagcagggcgcacttgacagaaaggccgccgctgccgccggggaagccggcgcatggggcggcgatcgggaaccccccgccgcaggccctagggcattgggcccccccgccgaggaacccttactggccgcgaatggcaccgtgccatcctggcccacagcgcccgtcccctctgcgggagaacctggagaggaagccccctatcttgtgaaagtacatcaggtctgggccgtgaaggccggaggcctcaagaaagactctctgttgactgtcaggctaggcacatggggacacccagcgtttccatcttgtgggaggcttaaagaagatagcaggtacattttttttatggaacccgatgctaatagtacaagccgggctcccgcggccttccgtgcgtccttcccccccctcgagaccggcaggaatctgaagaaagaagtgagcagggttctgtgcaagcgctgtgcacttcctccgaggctgaaggaaatgaaatcccaggagtccgcagctggttccaagttggtcctccgctgtgaaacaagttccgagtatagttcgctccggttcaaatggtttaagaacgggaacgaactgaataggaagaacaaaccccaaaacataaagatccagaaaaaacccggcaagtcggaactcaggatcaacaaagcttccctggccgacagcggggaatacatgtgtaaggttatctctaaactcggcaatgactctgcttctgccaatataacaatcgttgaatccaatgcgacatcaacgtcaacaacaggcacctctcacctggtgaaatgcgcggaaaaagaaaagacattctgcgttaatggcggcgaatgctttatggtcaaagatctgtctaacccctccaggtatctgtgtaagtgtccaaatgagtttacaggtgatagatgccagaactatgttatggcctctttctattctacctctaccccctttctttcactgccggaatag

SEQ ID NO: 2708 - DNA, 891 bp, Artificial Sequence
  Description of Artificial Sequence: Synthetic coding sequence
atggaaatatattcaccagacatgagcgaagtagcagccgaaagaagtagcagtccctctacgcagctaagcgccgaccccagcctggacgggctcccggctgcggaggatatgcctgaaccccaaaccgaggacggacgcacccccggactggttgggctggccgtgccttgctgcgcttgtttagaagcggaacgcctgcggggctgtctcaatagtgagaaaatttgcattgtgcctatcttggcctgtttggtaagcctctgcttgtgcattgccggcctgaaatgggtctttgtggacaagatatttgagtatgacagtccaacacacttagatccgggcggattagggcaggatcctattatctcactggacgcaactgctgcctccgccgtctgggtgtctagcgaagcttatacaagccccgtttctagagcccagagtgaatccgaagtgcaggtgactgttcagggggataaagctgtggtgtcattcgagccttctgccgcccctacacccaaaaataggatatttgccttcagctttcttccttccactgccccatcctttccttcacctacacggaaccccgaggttcgaacacctaagtcggcaactcagccacagacgacagaaaccaatttgcagacggcacctaagctcagcactagcacctctacgactggcacctcacatttggttaagtgtgcagaaaaggagaaaactttctgcgtgaatggaggggagtgttttatggtcaaggatctgtctaatccaagccgatacctgtgcaagtgcccgaatgaattcaccggggataggtgtcagaattatgtgatggcaagcttttacagtacttcaactcctttcctgtctctccccgagtag

SEQ ID NO: 2709 - DNA, 1389 bp, Artificial Sequence
  Description of Artificial Sequence: Synthetic coding sequence
atgtccgaacgcaaagagggccgtgggaagggaaaaggaaagaaaaaagagagggggagtggtaagaagccagagtccgccgccgggtcacagagccccgcccttcccccgcggctgaaggaaatgaagtctcaggagtcggcggccggttcaaagctagtgttacgttgcgagacttcgagcgagtactcctcactgaggttcaaatggttcaagaacggaaatgaactcaatcgtaagaataaacctcagaacattaagattcagaagaagcctggaaaatccgagctgcggataaataaggcctcgctcgcagactcaggagagtacatgtgcaaagtgatcagtaagcttgggaatgactctgccagcgctaatataacaatcgttgaaagtaacgagataatcaccggaatgcctgcctccacagagggcgcatatgttagttcagaaagccctattagaattagcgtgagtacagaaggtgcgaacacttcaagctcaacaagtacgagtactaccggtacaagccatttagtaaagtgcgccgagaaggaaaaaactttctgcgtcaacggcggcgaatgtttcatggtcaaggacctgagtaacccaagtcgctacctgtgtaagtgtcagcctggtttcactggtgcacgctgcacagagaacgtacctatgaaggtccagaatcaggaaaaagccgaggaactttatcagaagagagtattgacgatcactggtatctgtatcgcactcttagtcgtagggatcatgtgcgtggtggcgtattgtaaaactaagaaacagagaaaaaaactccatgacaggctgagacagtcgctgaggtccgagcggaataacatgatgaatattgctaacggccctcaccatcccaaccctccacctgaaaacgttcagctggtgaatcaatacgtctctaaaaatgtgataagcagcgaacatatcgtagagcgggaagctgagacctcattcagtactagtcactataccagtaccgctcaccattcaacaactgtgactcagaccccctcacatagctggtcaaacggtcatactgagagtatcctgtccgagagtcacagcgtgattgtaatgtctagcgttgagaactccagacactccagtcctactggcgggccacgaggacggcttaacggtacggggggcccacgggagtgcaattcttttctgcgtcacgctagagaaacgccagactcttaccgggatagcccccactccgagagacacaatctcattgccgagctgcgtcgcaacaaagcacatcggagcaagtgcatgcagattcaactgtccgccacacacttgcgctcgtcgagcataccgcacttgggcttcatcctatag

SEQ ID NO: 2710 - DNA, 1452 bp, Artificial Sequence
  Description of Artificial Sequence: Synthetic coding sequence
atgcaaatacccaaacacattagcatagaggacataaccgcaacgtccacaagtaccacaggcacttcccacttggtcaaatgcgcagaaaaagaaaagaccttctgtgtgaatggaggggagtgcttcatggttaaggacttaagtaaccccagtcggtacttgtgcaagtgcccaaacgagtttactggggataggtgccagaattacgttatggcctcattttacaaggcagaagaattgtatcagaaacgggtgctcacgatcaccggcatttgtatcgcgttgttggtggtcgggataatgtgtgtcgtagcatattgcaagactaaaaagcagcggaagaagttacacgatcgtttgaggcaaagcctgagaagtgagcggaacaacatgatgaacatcgccaacggtccacaccatcccaacccgccgcccgaaaacgtccagctggtgaaccaatatgtgtctaagaatgttatcagctccgaacacatagtagagcgggaggcggagacaagtttctccacgagccactacaccagtacagcacatcacagcacaaccgttactcagacaccctcgcattcttggtcgaacggtcatacagaatctattctctcagagagtcatagcgtgatcgtaatgtcctccgtggagaatagccgtcatagttctccgactgggggcccccgcggacggctaaatggtaccggtggcccacgtgagtgcaactcatttttaagacatgcaagggaaacacctgatagctatagggactcccctcactccgaacgctatgtttcagccatgacaacgccagcccgaatgagccccgtggacttccatactccatcctcaccaaagtcaccgcccagtgagatgagtcctcccgtgtcatccatgacagtgtccatgccgtccatggccgtgtccccgttcatggaggaggagcgtcctttactattagtcacccccccccgtttacgggaaaagaaattcgaccatcaccctcaacagttcagcagttttcaccacaatcccgcacacgacagcaattcacttcctgcatccccactgcgaatcgtggaagatgaagagtatgaaaccacccaggaatatgaaccagcacaggaacctgttaagaaactcgcgaactcccggcgggcaaagagaacaaaaccgaacggacacatcgctaaccgactagaagttgacagcaatacctctagccagagcagcaattctgagagtgagacagaagatgagagggtgggtgaggacacaccattcctggggattcaaaatcccctcgcggcatccctggaagccaccccggcctttcggctggccgatagccgaaccaacccggccggaagattctcgacccaggaggaaatacaggcaagactgtcctcagtgattgcaaaccaagaccctatcgcggtgtag

SEQ ID NO: 2711 - DNA, 1263 bp, Artificial Sequence
  Description of Artificial Sequence: Synthetic coding sequence
atgagcgaacggaaggagggcaggggaaagggaaagggcaaaaagaaggagcgtggtagcggcaagaaaccggaatcagcagccggttcccagagccccgccttaccacctcggctgaaagaaatgaagtcccaggagtcggcagcgggtagtaagcttgtgctgcgatgcgaaacatcaagcgaatatagttcccttcggtttaagtggttcaagaatggcaacgaactgaacaggaaaaacaaaccccagaatatcaaaatacaaaagaaaccgggtaagtcagagcttcgcatcaacaaggcatctctggctgattctggcgagtatatgtgtaaagtgattagtaagttggggaacgactcagccagcgcaaacataactatcgtggagtctaacgagatcatcacaggcatgcctgcgtctactgagggtgcatacgtgtcctcggagagtcctatccgtatctcagtgtctactgagggggccaacaccagtagttcaacctcaacaagcaccaccggcacatcccatttagtgaaatgcgctgagaaagaaaaaacgttctgcgtgaacggtggcgagtgctttatggtaaaagatctgtctaacccatcccggtacctatgtaagtgcccaaacgagttcaccggcgataggtgccaaaactacgtgatggcttccttttataaggccgaagagctgtatcagaagcgcgttcttacaatcacagggatttgtatcgcgctgcttgtggtaggaatcatgtgcgtggtggcttactgcaaaaccaagaaacagcggaagaaattgcatgatagactgagacagtccctgaggtccgagcggaacaacatgatgaacattgccaacggaccacaccacccaaacccgccccctgagaacgtgcaactcgttaaccagtacgtgtctaaaaacgtcatttctagcgaacatatcgtcgagagggaggcggaaacatcattttccacgtcacactataccagtaccgcacaccattcaacgaccgtgacacagacacctagtcatagctggagcaacggccatacagagtcgattctaagcgagagtcattctgtgatcgtgatgtcatccgtggagaactcacgacattcctcgcctacaggaggacccaggggtagacttaatgggacgggggggcccagagagtgtaattccttcctaagacatgcaagagagacaccggactcctatagagatagcccccactccgaaagatag

SEQ ID NO: 2712 - DNA, 1065 bp, Artificial Sequence
  Description of Artificial Sequence: Synthetic coding sequence
atgttgtttaatctgaggattttgcttaataacgccgcctttcgcaatggccacaatttcatggtacggaattttcggtgtggacaacccctgcagaacaaagtccagcttaagggccgcgacctgttaacgctgaaaaacttcacaggggaagagattaagtatatgctgtggctcagcgccgatctgaagtttcgaattaagcagaagggtgaatatttgccccttttacagggcaagtctctgggtatgatcttcgagaagaggtccacacgcacacgcctctctacggagaccggatttgctttgcttggcggtcatccttgcttcctgaccactcaggacatccacctcggagtcaatgaatcattgaccgatacagcacgggtgctgagctctatggccgacgccgtcctagcccgggtttataaacagtccgatcttgataccctggcaaaagaggcatcaatccccatcatcaatggcctgtccgatctgtaccacccaatacagattctcgcagactatctcactctccaagagcattactcgagtctaaaaggtttgaccctgagttggatcggggacgggaataacatcctgcattctattatgatgagtgctgcgaaatttgggatgcatcttcaggctgccacccccaagggctatgaacctgacgcctctgtaaccaagctcgccgaacagtacgcaaaggagaacggcaccaaactgctgttaactaacgatccacttgaagctgcccatggaggaaatgtactcattacagacacctggatttcaatgggacaagaggaggagaaaaagaaacggctccaggcctttcaagggtatcaagtaacaatgaaaaccgctaaggtagcggcgtctgactggacattcctgcactgccttcccaggaagccagaggaggtcgacgatgaggtgttctactcgccacggagtcttgtgttcccagaggccgagaataggaaatggacaatcatggcggttatggtgtccctccttacagactattctccacagttgcagaagcctaaattctag

SEQ ID NO: 2713 - DNA, 348 bp, Artificial Sequence
  Description of Artificial Sequence: Synthetic coding sequence
atgatccctgccaaggatatggctaaggtcatgatcgttatgctggctatttgcttcctgacaaagtctgatgggaaaagcgtcaaaaagcgcagtgtaagtgaaattcagctaatgcataatctggggaaacatcttaattccatggagcgcgtcgagtggctgaggaaaaaattgcaagatgtgcataattttgtcgccctcggcgctcctctggcacccagagatgctggatctcagcggccacgcaaaaaagaggacaatgtgctggtcgaaagccatgaaaagtcattgggtgaagccgacaaagccgatgttaatgtgctgacaaaggcaaaaagccaatag

SEQ ID NO: 2714 - DNA, 348 bp, Artificial Sequence
  Description of Artificial Sequence: Synthetic coding sequence
atgatacccgcaaaagatatggccaaagtaatgatcgttatgttagctatttgctttttaacaaagagcgatgggaagtcagtcaaaaagcgctctgtgagtgagattcagttgatgcacaatctcggcaagcaccttaactcaatggagcgagtagagtggttgaggaagaagctgcaggacgtccacaacttcgtcgccctaggggccccactggccccccgtgatgccggttctcagcggccccggaaaaaagaggataatgtgctagtcgagagccatgaaaaatctttaggcgaggcagataaagcggacgtgaacgtcctgacaaaggcgaagtcgcagtag

SEQ ID NO: 2715 - DNA, 354 bp, Artificial Sequence
  Description of Artificial Sequence: Synthetic coding sequence
atgtcaacggcagtcctcgagaatcccggccttgggcggaaactcagtgactttggacaggagaccagctacatagaagataactgtaatcagaatggggcaatttccctaatcttcagtctgaaagaggaagtgggcgctttagcaaaggtgttgagactattcgaagaaaatgatgtgaacctgactcacattgagtctcgaccgagcagattgaagaaggatgagtacgaattttttactcatctcgataagcggtccctgccagctctgactaacattatcaagatactccgacacgatatcggcgcaaccgtccacgaactcagtcgcgataaaaagaaggatacttag

SEQ ID NO: 2716 - DNA, 411 bp, Artificial Sequence
  Description of Artificial Sequence: Synthetic coding sequence
atgtccaccgcagtgctggagaatcccggtttgggccgtaagctgtctgacttcggacaggagacctcttatatcgaagataattgtaatcaaaacggcgcgatcagcctcattttttctctgaaggaggaggtgggagccttggccaaagtgcttagactattcgaagaaaatgatgttaacctcacccatattgagagcaggccctcacgactcaagaaggatgaatacgagttcttcacacatttagacaagagaagcctacccgctctgactaacatcatcaagatcctccgccacgatataggtgccaccgtccatgaactgagtcgagacaagaaaaaagatactgtgccatggtttccacgcaccatccaagaactcgaccggttcgccaaccagatcctctag

SEQ ID NO: 2717 - DNA, 1359 bp, Artificial Sequence
  Description of Artificial Sequence: Synthetic coding sequence
atgagtaccgctgtgcttgaaaatcccggacttgggaggaagctctccgacttcggtcaagaaaccagttatatagaggacaattgtaaccagaacggggcaatctccttaatcttcagccttaaggaggaggtgggagctctggccaaggtcctgcggctgttcgaggaaaatgatgtaaacttgacccatattgagtctcgaccaagcaggttaaagaaggatgaatatgaattctttacacatctggataagcggagtctccccgctttaaccaacataatcaaaatattacggcatgatataggagctaccgtgcacgaactttctcgtgacaaaaaaaaggataccgttccttggtttccaagaaccattcaggagctggatcgcttcgcaaatcagattttgtcatacggtgccgagctcgacgcagaccaccccgggtttaaagatccagtttatagagccagacgaaagcaattcgctgacatcgcttataattaccggcacggacagccgattcccagagtcgagtatatggaggaggagaagaagacctggggaaccgttttcaagactctaaagagcttgtacaaaacccacgcttgctacgaatataatcacatcttccccctgttggagaagtactgcggtttccacgaggataatatcccccagttagaagacgtgagtcagtttctgcagacttgtacgggtttccgcctgcgccctgtagctggactgctgtcatctagggacttcctcggaggccttgcgtttcgtgtctttcactgtacccagtatatcagacatggcagcaagcccatgtacactccagaacccgacatctgccacgaactcctcggccatgtacccctgttctctgatagatcattcgcgcagtttagccaggaaattggtctggcttcactgggggccccggacgaatatattgagaagctggcgacaatctactggttcactgtggaattcggcctgtgcaaacagggcgattcaattaaggcctatggcgccggccttctttcttctttcggggaactgcagtattgcctcagtgagaagcccaaattgctcccattggagctggaaaagactgccatccagaattacactgtgactgagttccagccgctgtattatgtggcagagtcattcaatgatgctaaagagaaggttcggaacttcgccgcaacaattcctagaccttttagtgtgagatatgacccttacactcaacggatcgaagttttggacaacacccagcagctgaagatcctcgccgacagtattaactcggagattggcatcctctgctctgccctgcagaaaatcaaatag

SEQ ID NO: 2718 - DNA, 3261 bp, Artificial Sequence
  Description of Artificial Sequence: Synthetic coding sequence
atggcttgcagcccggatgccgtcgtgagcccttcaagtgcattcctccgcagcggaagcgtctacgagccgctgaagtctattaacctgcctcgccccgataatgagaccctatgggataagttggatcattattataggatcgtgaaaagtaccctgctcctataccagagtcctactacaggcctcttccccacgaagacatgtgggggagatcagaaagcaaaaatacaagactctctgtattgcgccgcaggggcgtgggcactcgcactggcctacagaaggatcgacgatgataaaggtcggactcacgagctggaacatagtgcgatcaaatgcatgagaggtattctttattgttacatgcgacaggcagataaagttcagcagtttaaacaagatcctagacctaccacatgtcttcattcagtattcaatgtccacacaggcgacgagctcctcagctacgaggagtatggccatctgcagattaacgccgtgagcctctatctcctatatctggtggagatgatctcatccggcctccaaatcatctacaacacagacgaggtcagttttatccaaaacctggtgttttgcgtggagcgtgtgtaccgggttcccgattttggggtgtgggagcgcggcagcaagtacaataacggcagcacagagctgcacagttcctcagtggggttggccaaagcagctctcgaagctatcaacgggtttaatctttttggaaaccaagggtgcagttggtcagtcatcttcgtggacttggacgcacacaatagaaatagacagacactctgcagcttactgcctcgcgagtcacgctcccacaataccgatgccgctttactgccttgcatcagttacccggccttcgctcttgacgatgaggtgctcttcagccaaactctggacaaggtcgttcgaaaacttaagggtaaatatggctttaagagattcctgcgagatggctacaggacttcactggaggatcctaaccggtgttactacaagcctgctgagataaaattatttgacgggattgaatgtgagtttcctattttttttctgtacatgatgatagacggggtgttccggggtaaccccaagcaagtgcaagaatatcaagacctgctgactccagtgctgcaccacaccactgagggatatcctgtagtccccaagtactactatgtccccgctgacttcgttgaatacgagaaaaataacccagggagtcaaaaacgcttcccgtcaaattgtggaagggacggcaagctgtttttatggggccaggctctctatatcatcgctaagttgctagcagatgagctgataagtccgaaggacatcgacccggtgcaaaggtacgtcccactgaaagatcagagaaatgtgagcatgagattcagcaaccaggggcctctggagaacgatctggttgtccatgtagctctgatcgctgaaagtcagaggctgcaagtttttctcaacacttatggcattcaaacacagacaccgcagcaggtggagcccattcagatatggccacaacaggaacttgttaaggcttacttacagttaggcataaacgaaaagctcggcttatcaggcaggcccgaccgacctatcgggtgcctgggtacgagcaagatatatcggattttgggaaaaacagtcgtgtgttacccaatcatttttgatctcagcgatttttacatgtcacaggacgtgttcctgttgatcgacgacatcaaaaatgcccttcagttcataaaacagtactggaagatgcacgggaggccactctttctagtcttgattcgtgaggataatatccgtggctctaggtttaaccccattctggacatgctggcagctctcaagaagggcatcataggaggcgtgaaagttcacgttgaccgactgcagaccctgatttctggggccgtcgtggaacaactggatttcctgcgaatatctgatacagaagagctcccggaattcaagtcgtttgaagaattggaaccccctaaacacagtaaggtgaagaggcagtcatccactccatcagcccccgaactgggacagcaaccggacgtcaatattagtgagtggaaggataagcctacccatgaaatccttcagaaattgaacgattgtagctgcctggcatcccaggctattctgttaggcatactcctgaaacgggaagggcccaacttcataaccaaggaaggcaccgtcagtgaccacatcgaacgggtttacaggagagccgggtcccagaaactgtggtcagtggtgaggagagccgccagcctgctgagtaaggtggtcgattctcttgctccaagtatcacgaacgtcctggttcagggcaagcaagtgacactgggtgccttcggacatgaagaagaggtcatctccaaccctctttcgcctagggttatacagaacattatctactataaatgcaacactcatgatgagcgtgaggcagtgatccagcaagagcttgtgatacacatcggctggattatttctaataaccctgagctcttttcgggaatgctgaaaattaggatcggctggatcatccatgctatggagtatgaattgcaaatccgcgggggtgacaaacctgcactggacctataccagttgagccccagcgaggttaaacagctcctgcttgacatcctccaaccacagcagaacggcaggtgttggctcaacaggcggcagatcgacggctcccttaataggacccccactgggttctacgacagagtttggcagatactggagagaacacctaatgggatcatagtggcgggtaagcacctgccccagcagccaacactctccgacatgaccatgtacgagatgaatttctccttgttagtagaggataccctcggtaacattgaccaaccgcaatacagacagatcgttgtggagctgctgatggtggtgtcgatcgtcttagaacgtaaccccgagctggaatttcaggataaggtggatctggatcgcttagtaaaggaggccttcaacgaattccagaaagaccagagccgtctcaaggagatcgagaaacaagacgacatgacctctttctacaatacccctccactcgggaagaggggcacatgtagttatttaaccaaagccgtgatgaatttgcttctggagggagaagtgaagccaaacaacgatgacccatgccttatttcctag

SEQ ID NO: 2719 - DNA, 1221 bp, Artificial Sequence
  Description of Artificial Sequence: Synthetic coding sequence
atgaccctagatgtcggccccgaagatgagcttcctgactgggcggccgcaaaagagttttaccaaaaatacgacccaaaagacgtgatcgggcggggagtctcttccgtggtgcgacgatgtgtgcatcgggcgacagggcatgaatttgccgtgaaaatcatggaggtaactgcagaaaggctgagcccggagcagctagaagaggtcagagaagctaccagaagagagacacatattctcagacaggtggcaggccaccctcacataatcaccctgatcgactcatatgagagctctagctttatgttcctggtttttgatctgatgagaaaaggggaactatttgattatcttacagagaaggtcgcactgtctgagaaggagactcggagcattatgcgcagcctcttggaggcggtgtcctttcttcatgccaataatatcgttcatcgggatctgaagccagagaacatccttttggacgacaatatgcagattagactcagtgattttggtttctcttgtcatctggaaccaggagagaagctccgcgagttgtgtggcaccccaggatatctagctcccgaaatcctaaaatgttctatggatgaaacccacccagggtatggcaaggaggttgatctctgggcctgcggcgtgatcttgttcacactactggcaggcagtccccctttctggcaccggagacagatactgatgctgcgcatgatcatggaaggacagtaccagttctcaagcccggagtgggacgatcgctcatcgaccgtgaaagatctgatctcaagactgctgcaagtcgacccagaggccagacttacagctgaacaggcactgcagcaccctttcttcgagaggtgtgagggctctcaaccatggaatctgacaccaagacagaggttccgggttgcagtgtggaccgtcctcgccgccggcagagtggcactgtcaacacaccgagtgagacctttgactaagaacgctctgctgcgtgacccttacgcactgaggtcagtgcgccacctgattgacaattgcgcatttaggctgtacggccattgggtcaaaaagggggagcagcagaacagagccgctctgtttcagcacagaccccctggaccctttcccataatggggccggaggaggaaggcgacagtgccgcaatcacggaagatgaggccgtgctggtcctgggctag

SEQ ID NO: 2720 - DNA, 3708 bp, Artificial Sequence
  Description of Artificial Sequence: Synthetic coding sequence
atgaggagtcgcagcaattccggggtgcgactcgacggttatgcacgcttggtgcaacaaactatcctttgctatcagaaccccgtgaccggcttgctgtcggcctctcacgagcagaaggatgcatgggtacgtgacaacatttattctatactggcggtttggggtttgggcatggcgtatagaaaaaatgccgaccgggacgaggacaaagcgaaagcctacgagctcgagcaaaatgtcgtcaaactcatgagaggactgctgcagtgtatgatgcgacaggtggcaaaggtagaaaaattcaagcatacccaatctactaaggactccctgcacgctaagtacaacacggctacgtgcggaaccgtcgtgggagatgatcagtgggggcaccttcaggtcgacgctaccagcctctttctcctatttttggcccagatgactgcctctgggttacgcattatattcactctggatgaggttgctttcatccagaatcttgtcttctatatcgaggctgcctataaggtggccgactacggaatgtgggagcgcggagacaagacaaaccagggcattccagaactcaatgcttctagtgtaggcatggccaaggcagctctagaggccattgatgagctggatttattcggcgctcatggcgggcgcaagtcagtcattcacgttctccctgacgaggtcgagcattgtcagagcatcctcttctcaatgttaccacgagccagtacctctaaagagatcgacgccgggctgttgagtataattagctttcctgcttttgccgtggaggatgtgaatctcgtcaatgtgaccaagaacgagattatttccaaattgcagggaaggtatggttgctgcagatttctgcgagatggctacaaaacacctagagaggatcctaaccgtctgcactacgatcctgccgaactcaagctgttcgagaatatcgaatgcgaatggcccgttttttggacctacttcataatcgatggagttttttcaggggacgcagtgcaggtccaagagtatcgggaggctttggaaggcatcctgattcgagggaagaatgggatccgattggtcccggaattgtacgccgtgccacccaacaaagttgatgaagaatacaaaaatccgcataccgtggatcgcgtccctatgggaaaagtaccccacctatgggggcagagtctgtacattctgagttcccttctggctgagggattcctggccgctggtgagatcgatccccttaaccgccggttttccacctccgttaagccagatgtcgtcgtccaggtcacggtgttggcggaaaacaaccacatcaaggatctgcttcgaaaacatggcgtgaacgtgcagtctatcgccgatatccatcccatccaggttcagcctggacgcatcctgagccatatttacgcgaagcttgggcgcaataaaaacatgaacctgagcggtcgtccatatcgacacatcggtgtgctgggcacttctaagttgtatgtgatccgcaaccagattttcacgttcacaccccagttcactgaccaacaccacttctatctggccctggacaacgaaatgattgtggagatgctgcgtatcgagctagcgtatctgtgcacttgctggcgcatgaccgggaggccaactctcaccttccctatcagtcgtacgatgctaacaaacgatggctctgatattcacagtgcggtcctcagcacaatacggaaactggaggatggctattttggcggggcccgtgtgaagctgggaaacctgtcggagttcttgactacaagtttctatacctacctgacttttctagaccctgattgcgacgagaagctatttgacaatgcgagcgagggtacattctctcctgacagtgattcagacctcgtggggtatctagaagatacctgtaaccaggaatcccaggatgaactggatcattatatcaaccacctccttcagtctacaagcctgcgcagttacctgccccccctgtgcaaaaacaccgaggaccgtcacgtcttttcagctattcactccacacgcgatattctgtccgtcatggccaaagccaagggtctggaagtgccatttgttccaatgaccttgcctaccaaagtactttctgcccatcggaagtctctgaatctggtggattcaccacagccacttctggaaaaagtgcccgaaagtgattttcaatggcctagggatgaccacggcgacgtcgactgcgaaaagctcgttgaacagttaaaggattgctctaatctccaggaccaggcggatattctgtacatactatatgttatcaaaggcccaagctgggatacaaaccttagcggtcagcacggggtgactgtccagaatctcctcggtgagctatacggcaaggctgggttgaaccaagaatggggcttaatcagatatatctcgggcctgttacgaaagaaagtcgaggtgttagccgaggcctgtaccgatctgctgagccaccaaaagcaacttaccgtggggctccctcctgaacctcgtgagaagattatttcagcccctctgccccctgaagagcttaccaaattgatttatgaggcgtcaggacaagatatttcaattgctgtgctgacgcaggagatcgtggtgtatctcgccatgtatgtccgcgctcagccgtccctgtttgttgagatgctgcgcttgaggattggtttgatcatccaggtgatggccaccgagcttgctcggtctcttaattgtagtggcgaagaagcgagcgagagtctgatgaacctaagtcctttcgatatgaagaacctgctgcatcacattctcagcggcaaagaatttggggttgagcgatcggtccgaccaattcactcatccacatctagtcccacaatctctattcatgaagtaggccataccggggtgacgaaaaccgagcgctcaggcataaatagactgagatcagaaatgaagcagatgacacggcgcttctccgctgatgagcagttcttctccgtcggccaagcggcctcttcatccgcccatagctctaagtccgcccggtctagcaccccaagtagccctacaggtacctcttcatcagacagcggcggacaccacattgggtggggcgaacgccaagggcagtggttgaggcggcggaggcttgacggagctatcaatcgagttcctgtaggattctaccagagggtctggaagatcttgcagaagtgtcacggcctgagtattgacggctacgtcttaccatcgagtaccacacgggaaatgacccctcacgaaatcaagtttgctgtgcacgttgagtctgtgttgaaccgggtgcctcagcccgaatacagacagttactggttgaagccataatggttctgacactgctatcagatactgaaatgactagtatcggcggtattatccacgtcgatcaaatagtgcagatggccagtcagctctttcttcaagaccaggtgtccattggagccatggataccttggagaaagaccaggccacaggaatatgccactttttctatgattctgctccctccggagcatacggcaccatgacatacttaacgagggcggttgccagctacctgcaagagctgctccctaacagcggctgtcaaatgcagtag

SEQ ID NO: 2721 - DNA, 3261 bp, Artificial Sequence
  Description of Artificial Sequence: Synthetic coding sequence
atggcctgttctccagacgccgtggtatcacctagctcagccttccttagatcagggtccgtgtatgagccccttaaatctatcaatttgccacgcccggataacgagaccctttgggacaaactggatcactactaccggattgtcaagtccactcttttactgtaccaaagccctactactggtctcttccccactaaaacttgtggcggcgaccaaaaggcaaagattcaggacagcctatactgcgccgcaggtgcatgggccttggcgctggcctataggcggattgatgacgacaaaggtaggactcacgaacttgaacactcagcgattaaatgcatgcgtggcatcctctactgctatatgagacaggcagacaaggtgcagcagtttaagcaggatccacggccaactacctgcttgcactccgtgttcaatgttcatacaggcgacgagctcctgtcttatgaggaatatggccacctccagataaatgccgtgtccttgtatctgctctacctggtggagatgataagcagcgggctgcaaattatctataacactgacgaagtaagctttatccagaacctagtgttctgcgtggaaagagtctacagagttccagatttcggagtatgggaacgcggaagtaaatataataatggctccaccgagcttcactcctcttctgtagggctagctaaggcggctcttgaagcaatcaatggcttcaatctctttggaaatcaggggtgctcctggtctgtcatttttgtggatctcgatgcccacaaccgcaaccgacagacactctgcagcctcctgccacgagagtctcgatcccataacacggatgcagccttactcccatgtatctcatatcctgcttttgctctggacgacgaggtcctatttagtcagactcttgataaagtggtaaggaagctgaagggaaagtatggatttaagagattcctcagagacggatacaggaccagtctggaagacccgaatcgttgttactataaaccagccgaaattaagctgtttgacggaattgagtgtgaatttccgatctttttcctctacatgatgatcgacggagtttttcgtggcaacccaaagcaggttcaggagtatcaggatctgctcaccccagtgctgcaccacacaacggaaggttatcccgtagtccccaagtactactacgtccctgccgactttgtggagtacgagaaaaataacccagggagtcagaagcgcttcccatctaattgcggccgggacggaaagctgtttctgtgggggcaggcactctacattattgccaagctgctggccgatgaactcatctccccgaaagacatcgatcctgtccagaggtacgtacctctaaaggaccaaagaaacgtctcgatgcgtttttcaaaccagggccctctggagaatgatctggtggtccacgtggcattgatcgccgagtctcagcggctccaagtgtttctcaacacttatggcattcagacacaaacccctcagcaggtagagcctatccagatttggcctcagcaagagcttgtaaaggcctacctgcaactagggattaatgaaaaactgggtctatccggcaggccggaccgcccaattggctgcctcgggacaagtaaaatttatcgaattcttggaaagactgtggtgtgctaccctatcatctttgatctctcagatttctacatgagtcaagacgtgttcctgctgatcgacgatataaagaatgccctgcagttcattaagcagtactggaagatgcatggccgccctttgttccttgttctgattcgcgaggacaacatcagggggtctcggttcaaccctattttggacatgctcgctgcactgaaaaaagggatcattggcggagttaaagtccacgtggatcgtctgcagacgctgatttcaggagccgtcgttgaacagcttgattttctccgaattagcgacacagaggagttgcctgaatttaaatctttcgaagaactggagccccccaaacattccaaagtaaagcgacaatctagtaccccctctgccccggaattgggccagcagcccgatgtaaatatctcagaatggaaggacaagccgacccatgagatactccagaagcttaacgactgttcttgtctggcctctcaggcaatattgctcggcattttactgaaaagagagggcccaaattttatcaccaaggagggaaccgtgagtgaccacattgaacgcgtgtaccggcgggctggaagccagaaactctggagtgttgttcgtagagcagcatcattgctgtccaaggtcgtggatagcctggcccccagcattacgaacgtcctagtgcagggaaagcaggtgaccctcggcgcctttggccatgaggaagaggttataagtaatcccctgtcccctcgggtgattcagaacataatttactataagtgtaacacccacgacgaaagggaggctgtgatccagcaggaactggttattcacattggctggatcatctcaaacaaccctgagctcttctccggaatgctgaaaatccgaatcgggtggataatccacgccatggagtatgaacttcagatcagagggggagataagcctgccctagatctctatcagctatcgcctagcgaggtgaagcagttgcttctggacatccttcaaccacaacaaaacggcagatgttggttaaaccggcgacagatcgatggaagcctaaaccgtactccaactgggttctacgaccgggtgtggcaaattctcgaacgcacgcctaacggcattatagtcgctggcaaacatcttcctcagcagccaacgcttagtgatatgaccatgtatgaaatgaattttagcctgctggtcgaggacacactcggtaacatagaccagccacaataccggcagatcgttgtggaactgttgatggtggtaagcattgtgcttgagaggaatccggagctggagtttcaggataaggtggacttggaccgcctggtgaaagaggccttcaatgagttccagaaagatcagagccgactgaaagagattgagaagcaggacgatatgacctctttctacaacaccccccccttgggcaaacgtggcacttgcagctatcttactaaagccgtgatgaatctgctcctggagggcgaggtgaagccgaacaacgatgacccatgcctgataagctag

SEQ ID NO: 2722 - DNA, 3282 bp, Artificial Sequence
  Description of Artificial Sequence: Synthetic coding sequence
atggcgggagcagccgggctgaccgccgaggtctcctggaaagtcttggagaggcgtgctagaaccaaaagatccgggtcggtctacgaaccgctgaagagcattaatctgccccggcccgataacgaaaccctgtgggataagctggatcattactataggatcgtaaagagcacactgctcctttatcaatcacccacaacagggctctttcctacgaaaacgtgcggtggagaccagaaagccaaaattcaagacagcctctactgtgccgcgggtgcatgggcccttgctctcgcctatcggcgtattgacgacgacaaaggaaggacccatgagctggagcactcagccattaaatgcatgcggggcattttatattgttacatgcgccaggcggataaggttcagcaattcaaacaggatcctaggcctacaacttgtctccattcagtcttcaatgttcatacaggggacgaattgctttcctacgaagagtatgggcacctgcagatcaatgccgtgtcattgtatctgctatacttggtggagatgatctcctctggcctgcagatcatatataacacggacgaagtatcttttatccaaaaccttgtcttctgtgttgagcgtgtgtatcgggtgccagactttggggtctgggagagaggatctaaatacaataacggatccaccgagctgcactcctctagtgtaggccttgcgaaggccgcacttgaagcgataaatgggttcaacctgtttggtaaccagggttgctcctggtcagtgatcttcgtggatctggacgcccacaatagaaacaggcagacactgtgcagccttcttccccgtgaatctaggagccacaatacagatgccgccctcctgccttgtatatcctacccagcctttgccttagatgacgaagtattatttagccagactctggataaagttgtaaggaaacttaaaggaaaatacgggttcaaacggttcctgcgcgacggttaccgtacgtcattggaagaccccaatcgttgttactataagcctgcagagattaagctgttcgacgggattgagtgcgaattccccatatttttcctatacatgatgatcgacggcgtgttcaggggtaacccgaagcaagtacaggaatatcaagatctcctgaccccagtcctacatcatacaaccgaaggttaccccgtggtgcccaagtattactatgtgcctgctgatttcgtcgaatatgagaagaataatcccgggtcacagaaaagatttcccagcaactgtggaagagatggcaagctctttctgtggggccaggcactttacatcatagcgaaactgctggcagacgagctgatatctcccaaagacatcgaccctgtgcaaagatacgtaccactgaaagatcagcgcaacgtgtccatgagattctccaatcagggtccgctcgagaacgacctcgtagtacatgtggccttgatcgcggaatcccagcgcttgcaggtgtttctgaacacgtacggaattcagacacagactccacagcaagtggaaccaatccagatctggccccagcaggagctggtgaaagcctacttgcagctgggcatcaacgaaaaactgggcttatcagggcggcccgaccgaccaatcggctgtctgggaaccagcaagatctatcgcatcctgggtaaaactgtggtgtgctatccgatcatctttgatctgtctgacttctacatgtctcaggatgtctttcttttgatcgatgatatcaagaacgcactgcagttcatcaaacaatactggaaaatgcatggcagaccactgttccttgtactcatccgcgaagataacattcgaggatcccggttcaatcctatcctggatatgctggccgcactgaaaaagggaatcatcggaggagtgaaggtgcatgtggacaggctccagacactgatctccggagccgtcgtcgagcagctggacttcctgcggatctctgatactgaggagctccctgagtttaaatctttcgaagagctggagccacctaagcatagcaaagtgaagagacaaagctctaccccttctgcccctgagcttgggcagcagcctgatgtcaacatctccgagtggaaggataagccaactcatgagatactccaaaagctgaacgactgcagctgtctcgcgtcacaggcaatcctactcggtattttactgaagcgggaaggcccaaacttcattacgaaagagggcacggtctcagatcacattgagagagtctatcggcgtgcaggttcccagaaactttggctggccgtgagatatggagcagcgttcactcagaaattctcttcgtccatagccccgcacattactacctttctcgttcacgggaagcaggttaccctgggcgcattcggacacgaagaagaagtcatctcgaaccccctcagcccaagagttatccagaatatcatctattataagtgtaacacacatgacgaacgcgaggccgtgatacagcaggagctcgttattcacattggctggataatatcaaataacccagagctgttttctggtatgctgaaaatccggattggctggatcatacatgcaatggaatacgaactccaaatccgggggggcgataaaccagctctggacctgtaccagctctcccctagtgaagtcaaacagttgctgctggatatactacagccccagcaaaacggcagatgttggctcaataggcgacagattgacggatccctgaacagaaccccaaccggcttttacgaccgcgtgtggcagatcctggagcgcacgcctaatggcattatagtagctggaaagcatctaccacagcagccaactctgagtgatatgaccatgtatgaaatgaatttctcattgcttgtggaagatacactaggaaacattgaccaaccccaataccgacagatcgtagtggagttgctaatggtggtgagcatcgtgttggagcggaatccagagctggagttccaggacaaggtcgacctggatcgactagttaaggaagcgtttaacgagtttcagaaggatcagagtaggctgaaagaaattgagaagcaggatgatatgacatcgttctataatactccaccactcggcaagcggggtacttgtagctatctcacgaaagctgttatgaatttgctgctagaaggagaagtgaaacctaacaatgacgatccctgtttaatttcatag

SEQ ID NO: 2723 - DNA, 3261 bp, Artificial Sequence
  Description of Artificial Sequence: Synthetic coding sequence
atggcatgttcacccgatgcagtggtgtctccatccagcgcttttctccggagcggatccgtatatgagccactgaaaagcattaatctgcctcgtcccgacaacgaaaccctgtgggataagttggatcattattaccgaatcgtgaaaagtacactgttattatatcagtccccaaccacagggctcttccctactaagacttgtggaggagaccaaaaggcaaaaattcaggactccctctactgtgcagctggtgcatgggcacttgccttggcctatcgtcgaattgatgacgacaagggcaggacacacgaattggaacacagtgccatcaaatgtatgcgcggtatcctgtactgttatatgaggcaagcagacaaagttcagcagttcaagcaggatcctcggcccacaacctgcctgcattcagtttttaatgtgcacacaggagatgagctgctgtcctatgaggaatatggacacctccagatcaatgctgtgtcgctgtacctgttgtacttagttgaaatgattagctccggcctgcagattatttataatacggatgaagtgtcttttatccagaacctggtgttctgcgtagagcgcgtgtaccgcgtgcctgactttggcgtttgggagcggggatctaaatataacaacggatccactgaattgcatagtagtagtgtgggcttggccaaggcggcgctggaagccatcaacggattcaacctatttgggaaccagggctgcagttggtcggttatatttgtcgatctggatgcccataaccggaatcggcaaacactctgctctctgttgcctagagaatctcgctctcacaataccgatgccgcactgctaccttgcatctcctacccagctttcgccttagatgacgaagtgttattctcacagacacttgataaagtggtccgcaaactcaaagggaaatacggattcaaaaggttcctccgcgatggctacaggactagtttagaggacccaaatcgctgctattataaaccggccgagattaagttatttgacggcattgaatgcgaattccctattttctttttgtacatgatgattgatggcgtgtttcggggaaatccaaagcaggtgcaggagtaccaggacctgctgaccccagtcctacaccacaccactgaaggttacccggtcgtacctaagtattactacgttcccgctgattttgttgaatacgaaaagaacaaccctggatcacaaaagagatttccaagtaactgtggccgagacggcaaacttttcctttggggtcaggctctttacatcatcgccaaactgttagccgatgagctgatcagccccaaggatattgaccctgtgcagcggtacgttccattgaaagatcagaggaacgtgtctatgaggttctcaaatcaaggacctttggaaaacgatttggtggtgcacgtcgcattgatcgctgagagccagaggctgcaggtgtttctgaacacctacggaatccaaacccaaacaccccagcaggtggaaccaatccaaatttggccacagcaggagctggtcaaggcgtacctgcagctgggcatcaacgagaaactgggcctctcgggacggcctgaccgccccattgggtgtctcgggaccagcaaaatttaccggatcctgggaaagaccgtcgtgtgctaccccattattttcgacctctccgacttttacatgtcgcaggacgtgtttctccttattgacgatattaagaatgcactgcagttcattaagcagtactggaagatgcacggtcggccgttgtttctggtgcttatcagggaggataacataagagggagtagatttaatcctatccttgacatgctggctgctctaaagaagggcatcatcggaggcgtcaaagtgcacgttgaccgcttacagactctaatctcgggcgccgtagtggaacagctggattttctgcgcatctcagataccgaagaattacctgagtttaagtccttcgaagaactcgaaccccctaagcattcaaaggtgaagcgccagagcagtaccccatctgcacccgaactcggacagcagcccgatgtgaacatctcagagtggaaggataaacccacacatgagatccttcaaaagctgaacgactgttcttgcttagcatcacaagccatcctgctcggtatattgctgaaacgggaaggtcccaattttataaccaaagagggaaccgtatcggaccatatcgagagagtgtatcggcgcgcaggttcccaaaaactgtggctggcagtcaggtacggagccgccttcacccagaagttctccagtagcatcgcaccccacattaccacttttctcgtccacgggaagcaggtgacactgggtgctttcggccatgaggaggaggtaattagcaatcccctgagcccgcgggtcatccagaatattatctactataagtgtaatacacacgacgaacgtgaagcagtgattcagcaagaattggtcattcacattggatggatcatatcaaacaatccagagctcttcagtgggatgcttaagatccgcattggctggatcatccatgccatggaatatgaactacagatacgggggggcgacaaaccagccctggatctgtatcaactttcaccctccgaagtgaagcagctgctgctcgatatcctgcagccgcaacagaacggtagatgctggctgaataggagacagattgatggatctctgaaccggacacccacggggttctacgatagggtgtggcagattctggagagaaccccaaacgggatcattgtggccggaaaacacctcccgcagcagcctacattgtcagacatgacaatgtacgaaatgaacttttcactcctcgtggaggataccctgggaaacatcgatcaaccgcagtacaggcaaatcgtcgtggagctcctaatggtggtgtccatcgtgctggagaggaatccagagctggaattccaggataaggtggatctcgacagattagtcaaagaagcattcaatgaattccaaaaagatcagagcaggctgaaggagattgagaagcaggacgatatgacgtctttctataatacccctccgctgggtaagagagggacgtgttcttatcttacaaaggccgtcatgaatctcctgctcgagggtgaagtcaagccaaacaatgacgacccctgcctaataagctag

SEQ ID NO: 2724 - DNA, 1221 bp, Artificial Sequence
  Description of Artificial Sequence: Synthetic coding sequence
atgaccctcgacgtgggaccagaggatgagcttcctgactgggctgcggccaaggaattttatcagaagtatgacccaaaggatgtaatcggccgcggggtcagcagtgtggtgcggaggtgtgtccatagggccactgggcacgagttcgcggtgaaaatcatggaggttactgctgagcgtctgtctcccgagcagttagaggaggtgagagaagctacgaggagggagacccacatcctgagacaggttgccggtcacccgcatattattaccctgatagattcctacgaatcttctagttttatgtttctggtattcgatctcatgagaaagggcgagctgtttgactatctaaccgagaaagtggccttaagtgagaaggagacccggagcatcatgcggagcctgctcgaggcagtttcattcctgcatgcgaacaatattgtacaccgcgatctgaaaccggagaacattctcctggacgataatatgcaaatccgcctgtctgatttcgggttcagctgccacctggagcccggggagaaactaagagaattatgtggcacaccaggctacttggctcccgaaattctgaagtgctcaatggacgaaacccacccagggtatgggaaagaggtcgatctttgggcctgtggagttatcctcttcactctccttgcaggatcaccccccttctggcatcgacggcagattctgatgctcagaatgattatggaaggccagtatcaattttcttctcctgagtgggacgataggtctagcacagtgaaagatctgataagtcgactgctgcaagtggatcccgaggctcggctaaccgctgaacaggcactacagcatccattcttcgagcggtgtgagggctcccaaccatggaatttgactccgcgtcagcggttccgggtcgcagtgtggacagtcctggcagccgggcgcgtggccttgtcgacacatcgggtgcgacctttaacaaagaacgcactactgcgcgacccttatgccctgagaagcgtgcggcatctcattgataactgcgcatttagactgtatgggcactgggtgaagaagggcgaacagcaaaaccgggcagcattattccagcataggccccccggcccatttccaatcatgggaccagaggaagagggcgacagcgccgcgatcactgaggatgaggctgtgctcgtgttgggctag

SEQ ID NO: 2725 - DNA, 1125 bp, Artificial Sequence
  Description of Artificial Sequence: Synthetic coding sequence
atgacactggatgtgggccccgaggacgagctgcctgattgggccgcagcaaaggagttttaccagaaatatgatcctaaagacgtgatcggtcggggcgtgtcatcggtcgtaagacgttgcgtccatcgtgccaccggccacgagttcgccgtgaaaataatggaggtgacagccgagagactgtcaccggagcagctggaagaggttcgcgaggccacgcggagggaaacccatatcctcaggcaggtggcaggacacccgcacatcattaccctgattgactcttatgaatcctccagttttatgttcctggtctttgatcttatgaggaagggcgagctatttgactatctgactgagaaagtagctttgtccgaaaaggagactagaagcatcatgagatcactcctagaggcggtgtcctttctgcatgcaaataatattgttcatagggacttgaaacctgaaaatatcctactggatgacaatatgcagatcaggttatccgactttgggttctcttgtcacctggagcctggcgagaaattgcgcgaactgtgcggcactcccggttacctcgcaccggagatcctgaagtgtagcatggacgaaacgcatcctggatatggtaaagaggtggacctctgggcctgcggggtgatcttattcactctcctggcaggaagtccacctttttggcatagacggcagatcctgatgctgcggatgatcatggaaggccaataccagttttcttcgcccgaatgggacgatcggtctagcacggtcaaggacctaatcagcagacttttgcaggtggatcctgaggccagactcaccgctgagcaagcattacagcaccccttctttgagaggtgcgagggatcccagccatggaacctgaccccccggcagaggttcagagttgcagtctggaccgtgctggcagctggcagggtcgcactgtcgacccatagagtaaggccccttacaaagaatgctctcctgcgggatccctatgctctcaggagtgtgcgacaccttatcgataattgtgccttcaggctgtatggacactggatccgcaagcagtggatcgggaagttaatggcctgcgtgtag

SEQ ID NO: 2726 - DNA, 3999 bp, Artificial Sequence
  Description of Artificial Sequence: Synthetic coding sequence
atgcagcaagccccacagccctacgagttcttcagcgaagaaaacagtcctaagtggagaggactgctggtttcggccctgcgaaaggtgcaggagcaggtgcatccaacgctgagcgcaaatgaggagtccctgtactacatcgaggagcttatcttccaacttctgaacaaactgtgtatggcccagccacggaccgtacaggatgtggaggaaagggtgcagaagacattcccacatcctatcgacaagtgggcgattgcagatgcccagagcgctatagaaaagcgaaaacggcgcaaccctctgttgctgcccgttgacaagattcacccgagcctcaaggaagttctgggctacaaagtcgattaccatgtcagcctctacatcgtcgccgtactcgaatatatctcagctgacattttgaaactggcgggaaattatgtgttcaatatacgccactacgaaattagtcaacaggacattaaagtgtcaatgtgtgctgacaaagtactcatggacatgttcgaccaggatgacatcggtcttgtgagtctgtgcgaggacgaaccatcttcctcaggagagctgaactactacgacctggtgcgcaccgagattgccgaggaaaggcagtatctccgcgagctcaacatgatcataaaagtgtttcgcgaagcctttctgtcggatcgcaagttgtttaagccaagtgatatcgagaaaatttttagtaacatcagtgacattcacgaactgacagtgaaactcctagggttgattgaagacactgtagagatgaccgatgaatcatcaccccatccactggctggctcatgttttgaggatctcgcggaggagcaggcattcgatccctacgagacactcagccaagacatattgtctcccgaatttcacgagcatttcaacaaactgatggctcgtcccgccgtggccctgcatttccagtcaatcgccgatggctttaaggaagcagttaggtatgtgctacctcgcctaatgctggtgcccgtgtaccactgctggcattacttcgaacttttgaaacagctaaaggcctgctcagaagaacaagaagaccgtgaatgtctgaaccaagccattaccgctctgatgaacctccaggggtctatggatcgaatttacaaacagtacagccctcggagacggcctggcgatccagtgtgtccgttctatagtcatcagttgcggtcaaagcatctcgccattaagaaaatgaacgaaatccagaaaaatattgatggctgggagggaaaagacatcggacagtgctgcaacgagttcatcatggaaggccctttgacacgaattggagccaaacatgaaagacacatttttctgttcgacggcctgatgattagctgcaagcccaaccacggacagacacgactgcctggctattcctctgccgagtatcgactgaaagagaagttcgtgatgcgcaagatccaaatctgcgataaagaggatacctgtgaacataagcacgcctttgagctggtgtccaaggatgaaaactcaatcatcttcgccgcaaaaagtgccgaggagaagaataactggatggccgctctgatcagcctccattatcggtccaccctcgacaggatgttggattctgtcctgttaaaagaagaaaatgaacaaccactgcgcttgccgagtcccgaggtgtaccgctttgtcgtgaaggactccgaggagaacatcgtttttgaggacaatctacaatccaggtctggcatcccaattatcaaggggggcacggttgtaaagctgattgaacggctgacataccatatgtacgccgatcccaattttgtccggacttttttaaccacatacagaagcttttgtaaacctcaagagctgctttctttgcttatcgaaaggttcgaaattcctgagcccgaaccaaccgacgccgataaactagctatcgagaaaggggagcagcccatcagtgctgatctgaagagattcagaaaagaatacgtgcagcctgttcaactgcgcattctgaacgtctttcgccactgggtagagcatcacttttatgacttcgagagggacctcgagctgttagaacggctcgagagctttattagtagcgtgaggggtaaggcaatgaagaagtgggtggaatccattgcaaagataattaggagaaaaaaacaggcccaggccaatggagtgagccataatattacctttgagtctcctccccccccaattgagtggcacatttcaaagccggggcagttcgaaacgttcgaccttatgaccctgcaccctattgagatcgccagacaactcactctgctggaaagtgacctgtatcgcaaggtacaacctagcgagctggtgggttctgtctggactaaggaagacaaggaaattaatagccctaatctccttaagatgattagacataccacgaacctgactctgtggttcgaaaaatgcatcgtcgaggctgagaacttcgaggagcgggtggccgtcctgtcacgaatcatcgagatcctccaggtgtttcaggacttaaacaacttcaacggcgtgttggaaattgtctccgcggtgaatagtgtgagtgtgtacaggttagatcatacctttgaagcattgcaggaacgaaagcgtaagatactcgatgaggccgtcgaactctcccaggaccattttaagaagtacctggtgaaattgaagagtatcaatcctccgtgcgtgccgttctttggcatctatctgaccaatatccttaaaaccgaggagggcaacaacgacttcttgaagaagaagggcaaagatctgattaacttctctaagagaagaaaggtggccgaaattaccggggagatccagcagtatcagaaccagccatactgtctaaggatagagcctgacatgcgcaggttttttgagaacctgaaccccatggggagcgcttcagagaaggaatttacggactacctgtttaataaatctctggagatcgaacctcgcaattgcaaacagccgccccgttttcccaggaagagcaccttctccttaaaatcccctggcatccgtccaaatacaggcagacatggtagcacctcaggtacactgaggggccacccaacgccgttggagagagagccctgtaaaataagcttttctagaatcgccgaaaccgagctggagagcaccgtcagtgcacctaccagccctaacactccttccacacctccggtgagcgcgtcgagcgacctgagcgtgttcctagatgtcgacttgaacagctcctgcggatctaacagcatttttgctccagtcttgctgcctcattcgaaatccttctttagttcatgcggcagcctgcataaactgtccgaagaacccctgatcccaccgccacttccaccccggaagaaattcgaccacgacgcctccaactccaaaggtaacatgaagtctgacgacgatcctcctgcaatcccgccgagacagcccccaccacctaaagtcaagccccgcgtaccagtgcccaccggggctttcgatggaccactccatagcccacctccgcctccccctcgggacccactccctgacacaccgcctcctgtgcccttgcgccctccagagcacttcatcaattgtccgtttaatctgcagcccccgcccttgggacacttgcaccgcgacagcgactggctccgcgatattagtacatgccccaactcgccctccacaccaccttctactccttcacccagagtgccgcgcaggtgctatgtcctctctagcagccaaaataatctggcccatccccctgcgcctcccgtgccccctaggcagaacagttcgccgcaccttccaaagctgccaccaaaaacatacaaaagagagctgagtcacccccctctgtatcgccttccactgctagagaatgctgaaacaccacaatag

SEQ ID NO: 2727 - DNA, 2442 bp, Artificial Sequence
  Description of Artificial Sequence: Synthetic coding sequence
atggcaaaacccctcactgaccaggaaaagcgaagacagatctctattagaggcatcgtcggggtagaaaacgtggctgagctcaagaaatcattcaacaggcacctacacttcacgttggtgaaggaccggaacgtagccactaccagggattactacttcgccttggcccatacggtccgcgaccatttggtgggccgctggataagaacgcagcagcattactacgacaaatgcccaaaactcgggctggatatcgaggaactagaggagatagaggaggatgctggactgggcaatggcggcctaggcagacttgctgcatgctttctcgatagcatggccactcttgggctggccgcgtacgggtacgggatcagatacgaatatggcatctttaatcagaaaatccgcgatggctggcaggtggaagaggccgatgactggcttagatacggcaacccatgggagaagtcacgacccgagttcatgttgcctgtgcatttctacggcaaagtggaacatacaaacactggtacgaagtggattgatacccaggtggtcctggccctcccctatgatacgccagtccccggctatatgaacaatacagtgaatacgatgagactctggtctgctcgcgcacccaatgactttaatctgagggattttaatgttggggactacattcaagccgtacttgatagaaacttggccgaaaacattagccgtgtgttgtatcccaacgacaacttcttcgagggcaaagaactgagattgaagcaggaatattttgtcgtggctgctacattacaggacattatcagaaggtttaaggccagcaagtttggttccacgagaggcgctggtacagtgtttgatgcatttcccgatcaagtggccatccagctgaatgacactcaccctgccctcgccatccccgagctaatgagaatctttgtcgatatcgagaagctgccctggtctaaggcatgggagctcacgcagaagacgtttgcatacactaaccacactgtgctgccagaggcattagaacgctggccggtagatttggtagagaagctgttgccaaggcacttggagatcatatatgagataaatcagaaacacctggatcggattgtcgcactattccctaaggacgtggaccgtttgaggcgaatgtcattgatcgaggaggaaggctcaaagagaattaatatggcccacctctgtattgtgggtagtcacgccgtgaacggcgtcgccaaaatccactcagacatcgtaaagacaaaagtttttaaagacttcagcgagttagagcctgacaaattccagaataagactaacgggataactcctcggcgctggctgttgctgtgtaatccaggcctggcggagctcatcgccgaaaaaatcggagaggattacgtgaaagatctctcgcagctgaccaagctgcattcatttctgggtgatgacgtttttctgcgcgagttggccaaagtcaagcaggagaataaacttaagttttctcaatttttagagaccgagtacaaagtcaagataaaccccagttcgatgttcgatgttcaggtcaagagaatccacgagtacaagaggcagctgctcaattgcctgcacgtcatcacaatgtacaataggataaagaaagaccccaagaaactgttcgtccctaggacggtcattatcggcggtaaggctgctcctggctaccatatggccaagatgattatcaagcttatcacctcagtggcagatgtagtgaataacgaccctatggttggctctaaactcaaagttatcttcctggaaaactatcgggtgagcctagcagagaaggtgatcccagctaccgatctcagcgagcagatttccaccgcagggacagaggccagtgggaccgggaacatgaagtttatgcttaatggcgccctgacaattgggacaatggatggagccaatgtggaaatggcagaggaggcaggagaggagaacctgttcatttttggaatgaggattgatgacgtggcagccctggacaagaagggatatgaggcgaaggaatactatgaggcactgccagagctcaagttggttatcgaccagatcgataatggattcttttcacctaaacagccagatctttttaaggatatcatcaacatgctgttctatcatgaccgatttaaagtattcgctgattacgaagcttacgtgaagtgccaggacaaggtttcacaattatacatgaaccctaaggcgtggaataccatggtattgaagaacatagctgccagcgggaagttctctagcgaccggactatcaaggaatatgcccagaatatttggaatgtcgagccttccgatctgaagatctctctttctaacgaatcaaataaggtaaacggcaactag

SEQ ID NO: 2728 - DNA, 2433 bp, Artificial Sequence
  Description of Artificial Sequence: Synthetic coding sequence
atggagcacaaagaggtcgtgttgctgcttctcctgttcttgaagagcggacagggtgagccactggacgactacgtcaacacccagggcgcaagcctgttctccgtgaccaaaaaacaactgggagcaggctctatcgaagagtgtgcagcaaagtgcgaagaggatgaagagtttacctgcagagcattccaataccattccaaagaacagcagtgtgtgattatggcagagaacaggaagagctccattattatacgaatgcgcgatgtagtgttattcgagaagaaggtatacttgtcagagtgcaaaacagggaatggtaagaattacaggggaacaatgtcgaaaacaaaaaatggaatcacctgccagaagtggtcctcgacaagtccccaccgacctagattctctcctgcgactcaccccagcgagggtctcgaggagaattactgccggaatcctgacaatgacccacaaggcccttggtgctatacaacagaccccgagaagcgctacgattattgtgatatcttagagtgtgaagaagaatgcatgcactgtagcggcgaaaattacgacgggaagatctcgaagacaatgtccgggctggagtgccaggcttgggattcccaaagcccccatgctcacggctatattcctagcaagtttcccaacaaaaatctgaaaaaaaactattgccgaaatccggatagagaactgagaccctggtgcttcacgaccgaccccaacaaacgctgggaattatgtgacatccctagatgtacaacaccacctccctcatccgggccgacctaccagtgtcttaaaggaacgggcgaaaactatagaggcaacgtggctgtgaccgtcagcggccacacctgccagcattggagtgcccagactccacacacccataataggacccccgaaaactttccttgcaaaaacttggacgagaactattgcagaaatccagacggcaaaagggccccatggtgccatacaactaactcacaggtcaggtgggagtactgcaaaattccctcctgcgacagctccccagtgtcaacagagcaacttgctcctaccgctccccctgagttgacccccgtcgtgcaagactgctatcacggcgacgggcagagctaccggggcacatccagtacaaccacaaccggtaagaaatgccagtcgtggtcatcaatgacccctcatcggcatcagaaaactcccgaaaattatccgaatgccggcctgaccatgaactattgcaggaatcctgacgcagataagggaccttggtgcttcacgacagacccttctgtgcggtgggagtattgcaacctaaaaaagtgttccggcacagaggcatctgtagtagccccccctcccgtggtcctcctgccagatgtggaaacaccctccgaggaagactgtatgttcgggaatgggaaagggtacaggggtaagagggctactaccgtgacaggaactccgtgccaggactgggctgctcaggagccccataggcattccattttcacacctgagaccaatccacgcgcaggactggagaagaattattgcaggaatcctgacggcgacgtgggtggtccttggtgttataccaccaaccctcggaaactgtatgactactgcgatgttccccagtgcgctgctccttcattcgactgtggaaagccacaagtggagcccaaaaaatgccctggacgcgtggtgggcggttgcgttgcccacccacacagctggccatggcaggtgtcccttagaacccggtttgggatgcacttttgtggaggaacgctgatcagccctgagtgggtcctgacggccgcccactgtctcgagaaaagcccgcggccgagctcctacaaggttatcctcggcgctcaccaggaagtgaatctggaaccacatgtccaggaaatcgaagtgtctagactgtttttagagcccactcgcaaagacatcgccctgctgaagctgtctagtcctgctgtgataaccgacaaagtgatccccgcctgcctcccatccccgaactacgtcgtagcagacaggactgaatgttttatcactggttggggagagacgcagggcacctttggcgccggtctgcttaaggaagcccagttaccggtcatagaaaacaaggtatgtaaccgttacgaatttctgaacgggcgggtgcagtccacagagctttgtgccggtcatctcgctggaggcacagacagttgtcagggtgactctgggggaccactcgtgtgctttgaaaaagataagtacattcttcaaggagtaacgagctggggtttgggatgcgctaggcccaataaacctggggtatatgttagggttagtcgtttcgtgacctggattgagggtgtcatgcggaataactag

SEQ ID NO: 2729 - DNA, 633 bp, Artificial Sequence
  Description of Artificial Sequence: Synthetic coding sequence
cgctttggtatgcacttttgcgggggaaccctgatctcacccgagtgggtattaactgccgcgcactgtctcgagaaaagtccacgaccctctagctataaagtgatcctgggtgctcaccaggaagtgaacctggagccccatgttcaagagatagaggtgtcccgtctttttctggagccgacgaggaaggatattgctcttctgaaactcagttcccccgctgtaattacagacaaggtaattcccgcctgcctgcccagccccaattatgtcgtcgccgaccgcacagagtgttttatcaccggttggggtgagacgcagggcactttcggcgctggactgttgaaggaagcccagttgcccgtgatcgagaacaaggtgtgtaaccgctatgaattcctcaacggcagagtgcagagcaccgaactttgcgccggtcatctggcaggtggaactgattcttgccagggggactccgggggccctctcgtgtgctttgagaaagataagtacatcctgcagggtgtaacgagctggggactcggctgtgccaggccaaataagcctggtgtgtatgtgcgtgtcagtcggttcgttacttggatagagggggtcatgcggaataactag

SEQ ID NO: 2730 - DNA, 411 bp, Artificial Sequence
  Description of Artificial Sequence: Synthetic coding sequence
atggaacacaaagaggttgtgctgctcctgctgctgttccttaaatccggccagggcgagccgctggacgactacgtaaacactcagggcgccagcctcttctcagttaccaaaaaacaactgggggcgggctctattgaggaatgcgccgctaaatgcgaagaggatgaggagttcacttgtcgagcgtttcagtaccattctaaagaacagcaatgtgtgattatggcggagaataggaagtctagcattattatccgaatgcgggacgtcgtcctgtttgagaagaaggtgtacttgtctgaatgtaagaccggcaacggaaaaaactatcgcgggaccatgtctaagacaaaaaatgggattacatgtcagaagtggtcctcgacatcccctcaccgcccacggtag

SEQ ID NO: 2731 - DNA, 945 bp, Artificial Sequence
  Description of Artificial Sequence: Synthetic coding sequence
atggggattggacgctcggaaggggggcggcgaggcgctgccttgggagtactgctggcactgggcgccgcactgctggccgtgggaagtgcaagcgaatacgattatgtctcatttcagtccgacatcggaccttaccagtctggacgcttttacactaagcctccccagtgtgtcgacatccctgccgatctgcgattatgccacaacgttgggtataagaagatggttctgcctaacttgctagagcatgagacaatggctgaagtaaagcagcaggcctcctcctgggtacccctgttgaacaaaaactgtcatgctggaacgcaagttttcctgtgcagcctgttcgcccctgtatgtctggatcggcccatctacccttgtcgttggctgtgtgaggctgtacgggactcctgtgagcccgtcatgcagtttttcggattctactggcccgaaatgctgaagtgtgataagttcccggaaggggatgtgtgtattgcaatgacacctccaaatgcaacagaggcctcgaaaccacaagggacaaccgtctgccccccctgtgacaatgagcttaagagcgaggcgatcatagagcatctctgtgcgtctgaatttgcgctgagaatgaaaattaaggaggtgaagaaggaaaatggagataaaaaaatcgtgccaaaaaagaaaaagccattgaaattaggtccgatcaagaagaaggatcttaagaaattggtactatatttgaaaaatggtgctgattgtccatgtcaccaactggataacctgtcccaccacttcctcataatgggacggaaggttaagtcgcagtacttacttaccgccatccacaaatgggataagaagaataaagaatttaagaacttcatgaagaaaatgaagaatcacgaatgtccaaccttccagtctgtgttcaagtag

SEQ ID NO: 2732 - DNA, 882 bp, Artificial Sequence
  Description of Artificial Sequence: Synthetic coding sequence
atggatgctatgaagaggggcttatgttgcgtactcctgctgtgtggggcggtttttgttagccctagccaggaaattcacgcccgctttcgccgcggggcccgatcttatcaggtaatctgccgggacgaaaagacccagatgatctaccagcagcatcaaagctggctgcggcctgtgctgaggtccaatagagtggagtattgctggtgcaactccgggagagcccaatgtcactctgttcccgtgaagagttgcagcgaacccaggtgtttcaatggcggcacatgccaacaggctctgtatttcagtgacttcgtgtgtcaatgccccgaaggattcgcgggtaaatgttgtgaaatcgataccagggctacgtgttacgaagatcagggaattagctatagaggcacttggagcactgccgagtcaggggctgagtgtacgaattggaattccagcgcgctcgctcaaaaaccttactcggggagaaggccagatgccattcgtttgggcttagggaatcacaattactgcaggaatcccgatagagatagtaagccttggtgctatgtgtttaaagcaggaaaatatagctccgagttttgctctactcccgcctgctccgaagggaacagcgattgttactttgggaatgggagcgcgtatcgcggcacccacagcctcacggaatctggagcctcatgtttgccttggaatagtatgatactgatcggtaaggtgtacaccgcacagaacccaagcgcccaagcactgggactcggaaagcataattattgtcgatgtagaaccggcagatccgtgagcagtcctgccaccgcgtctatgcgcccatgcctcctgtccatcagatctggctag

SEQ ID NO: 2733 - DNA, 1551 bp, Artificial Sequence
  Description of Artificial Sequence: Synthetic coding sequence
atggacgccatgaagcggggcctgtgttgcgtattattgttatgtggtgccgtgtttgtgtctcccagtcaggagattcatgcccgctttcggcgaggagcaagatcctaccagggctgctctgagcctcgttgtttcaacggaggcacctgccagcaggccttatacttcagcgacttcgtgtgccagtgtccggagggctttgccgggaagtgttgtgagatcgacactcgcgccacgtgctacgaggaccagggaatctcatatagagggacatggagcacggcagagagcggcgccgagtgcacaaactggaactcttctgcactggcacagaagccctatagcggacgccgccccgacgccatcaggcttggccttggaaaccacaactactgccgtaatccagatagagattccaagccatggtgctatgtgttcaaagccggaaagtatagcagcgaattttgcagcacccctgcatgctcagaaggtaactctgattgttattttggaaacggctcagcctatagaggaacgcacagcttaacggagagcggggcctcatgcctgccctggaacagtatgattttgataggcaaagtgtacactgcacagaatccgtctgctcaggctctgggactgggtaagcataactattgccggaaccctgacggggacgcaaaaccatggtgtcacgtgctcaagaatcggagactcacatgggaatattgcgacgtccccagctgctctacctgcgggctccgccaatacagccagccccagtttcgcataaagggtggtctcttcgctgacattgcttctcacccctggcaagcagccatcttcgccaagcacagaagatctcctggggagagattcctttgtggcgggattctgatcagttcttgctggatcctgtctgccgcccactgcttccaggagagattccctccgcaccacttaaccgttatactaggcaggacctatcgcgtggttcccggagaggaggaacagaagttcgaagtggagaaatatatagtccataaagaattcgatgacgacacctacgacaatgatattgccctgttacagctgaagagcgactcctcccgctgcgcacaggaatcaagtgtagtaaggacagtgtgtcttccccccgcagatctacagcttccagattggactgagtgcgaactcagtggttacggcaagcacgaagccctgagtcccttctactccgagaggttgaaagaggctcatgtgcgcctgtatccctcatctaggtgcacctcgcaacatctcctaaaccgtaccgtgaccgacaacatgctgtgtgccggagatactaggtccggcggccctcaggctaacctccacgacgcatgccaaggggattccggcggcccgttggtgtgccttaatgacgggcgcatgactctggtcggcatcatatcttggggccttgggtgtggccagaaggacgtgccaggcgtctacactaaggtgaccaattacctcgattggattagggacaatatgcgaccatag

SEQ ID NO: 2734 - DNA, 1689 bp, Artificial Sequence
  Description of Artificial Sequence: Synthetic coding sequence
atggacgctatgaaaagaggactgtgttgtgtgctactcctctgcggtgccgtctttgtgtcccccagtcaggaaattcacgcccggtttcggcggggggctcgaagctaccaggtcatctgcagggacgaaaagacccagatgatctatcagcagcaccagtcttggctaagacctgtgcttcgtagtaaccgagtggaatattgctggtgcaacagcggcagggcccaatgtcactcagtgcctgtgaagtcctgttcagagccccggtgtttcaacggcggtacttgccaacaagccttgtacttctctgacttcgtatgtcaatgccccgagggcttcgctgggaaatgttgcgaaatcgacactcgagccacctgctacgaggatcaagggatcagctataggggcacctggagcactgccgaatccggcgcagaatgcaccaattggaatagttccgcactggcccagaaaccttattccgggaggaggccggatgcgatcagactgggccttggcaatcataactattgccgcaaccctgaccgcgactccaaaccatggtgctatgtctttaaggcaggcaaatactccagtgaattctgttccacacccgcttgctccgaagggaactctgattgctactttggcaacggctcggcctaccgcggtacacattcactcaccgagagcggcgctagttgtttgccatggaatagtatgattcttattggtaaagtctacacagcccagaaccccagtgctcaggccctgggtctggggaaacacaactactgccggaaccccgatggagacgcaaaaccatggtgccacgtgctcaaaaaccggaggcttacgtgggaatactgcgatgtgccgagctgcagcacatgtggcctgcgccaatattctcagccccagttccgcattaagggtggactgtttgcagatattgcctctcatccctggcaagcagcgatcttcgcaaaacaccggcgatcaccaggggagcgcttcctgtgcggtggcatcttgatatcatcctgttggatcctctccgcagctcattgttttcaggagcgatttccaccccatcatcttaccgtgatcctgggacgcacgtatcgcgtcgtgcccggtgaggaggagcaaaagtttgaagtggagaaatacatcgtgcacaaggagttcgacgatgacacctacgataacgacatagccttgctgcaactgaagtccgacagctcacgctgcgctcaggagtcttccgtcgtgagaaccgtctgcctcccgcccgcggacctgcaattaccagattggactgagtgcgaattgagcgggtatgggaagcacgaggcactctcacccttttactccgagaggctaaaagaagcacacgtccggctttacccctcaagcagatgtacatcccaacacctgttaaatcgcactgtgacagacaacatgctttgtgccggcgacaccaggagcggaggaccccaggccaacctgcacgacgcttgtcagggggacagcggggggcccctggtgtgtctaaatgacggccggatgactctggttggcattatctcctggggcctcggctgcggccagaaggacgtccccggggtatacacaaaagtcacaaactaccttgactggatccgtgacaacatgagaccatag

SEQ ID NO: 2735 - DNA, 1311 bp, Artificial Sequence
  Description of Artificial Sequence: Synthetic coding sequence
atggatgccatgaagaggggcctgtgttgcgtccttctcctctgcggcgccgtcttcgtgtccccatcccaagagatccacgcgagattccgtcgaggcgctcgctcgtaccaggtcatttgtcgggatgaaaaaacacagatgatctatcagcagcaccagagttggttacggcccgttctgcgctccaaccgcgtggaatactgctggtgcaatagcgggcgagctcagtgccactctgtccccgtgaaacggaatagcgactgctattttggaaacggctcagcctaccgcggaacgcatagtttaactgagtcaggtgcctcctgcctcccctggaattctatgatcctgatcggtaaggtgtacaccgctcagaatcctagcgcacaggcgcttggtctaggcaagcacaactattgtcggaaccctgatggcgacgctaagccttggtgtcatgtgttgaaaaaccgccggcttacttgggagtactgtgacgtgccatcttgcagcacgtgcggtctgcgtcagtattctcaaccacagttccgcataaaaggcggactgttcgctgacatcgccagtcacccatggcaggcagccatctttgcaaaacatagaagatctcctggagaacgattcctgtgcggcggcatcctgataagtagctgctggatccttagcgccgctcactgctttcaggagagattccccccacaccatcttacagtgattctggggcgaacataccgagtggttccaggcgaagaggagcagaagtttgaggttgaaaagtacattgtgcacaaggaatttgacgatgacacatacgacaacgatatagcgttgcttcagctcaaatctgactcaagccgatgcgcccaggaatcaagtgtggtcaggactgtctgcctcccccccgccgatctacagttacctgactggaccgagtgcgaactttccggttatggcaaacatgaggctctgtctccattctatagcgaacgcctgaaagaagcgcacgtcagactgtacccctccagtcgctgcaccagtcagcacctgctcaaccggacagtgactgataacatgctttgcgctggagatacacgcagcggaggcccccaggccaacctgcacgacgcttgtcagggagactctggggggccactcgtgtgtttgaatgacgggaggatgaccctggtgggcataatatcctggggcctggggtgtggtcagaaggacgtgcctggcgtgtataccaaagtgacgaactacctggattggatccgggataatatgcggccctag

SEQ ID NO: 2736 - DNA, 1500 bp, Artificial Sequence
  Description of Artificial Sequence: Synthetic coding sequence
atggatgccatgaaaaggggactgtgttgcgttttattactgtgtggagccgtctttgtgtccccttctcaggagattcacgctcgcttccggcgcggcgcgcggtcatatcaggtgatctgtcgcgatgagaagactcagatgatttaccaacaacatcagtcatggctgaggcccgtgcttcgatcgaacagggtcgagtattgttggtgcaactctggcagggctcagtgccactccgtgcccgtgaagagttgctccgagcctaggtgctttaacggcggcacttgccagcaggccctctatttctctgattttgtctgccagtgtccagagggattcgcgggaaagtgttgcgaaatcgattccaagccatggtgttacgtgtttaaggctggtaagtactcctctgaattctgttcaacacctgcctgttctgaggggaactcagactgctatttcggtaacggcagcgcttatcggggtacacactctcttaccgagagtggcgcttcctgtctcccatggaactccatgatactgatcggcaaggtctatactgctcagaacccttccgcccaggcgttgggacttggaaagcacaactactgcagaaatcccgacggggatgccaagccttggtgtcacgtgctcaagaaccgcagacttacatgggagtactgtgatgtcccaagctgctccacttgcggattacgacagtacagccaaccgcagttcagaataaaaggtggcctgtttgccgacattgcctctcatccctggcaggcggctatcttcgctaagcaccggcgctcacccggggaaaggtttctgtgtggtgggatcctcatctcctcttgctggatcctgtccgccgcacattgtttccaagaacgcttcccaccccaccatctgaccgtaattctcggtcgaacttacagggttgtgcctggtgaggaggagcaaaaattcgaagtggaaaaatacatcgtgcataaggagtttgatgatgatacctatgataatgacattgctctgcttcagctgaagtcagatagttccagatgcgcgcaggagtcaagtgtggtgaggacggtttgtctgccacccgccgaccttcagctgcctgattggacagagtgcgagttgtctggctacggcaagcatgaagctctgtctccattctactcagagcgtttgaaagaagcgcacgtgcgcctctatccgagttcgcggtgcacctctcagcacttgctcaatcgcactgtgactgacaatatgttatgtgccggggacaccaggtccgggggtccccaagccaacctccacgatgcctgccagggcgatagcggcggtcctctggtgtgcctgaacgacggcagaatgacacttgttgggataattagctggggactgggttgtggtcagaaagatgttcccggcgtgtatactaaggtcaccaactacttggactggattcgggacaacatgagaccctag

SEQ ID NO: 2737 - DNA, 537 bp, Artificial Sequence
  Description of Artificial Sequence: Synthetic coding sequence
atggatgcaatgaaacggggtctctgttgtgtcctgttactctgcggggcagtatttgtctcaccatcacaggaaatccacgcgcggtttaggaggggcgctaggtcctatcaggtaatctgtcgcgacgagaaaacacagatgatttaccaacagcaccagagttggttgagaccagtgctccgttcaaatcgtgtcgaatactgttggtgtaacagtggaagggcgcagtgccacagcgtgcccgtcaagtcctgctctgaaccacggtgttttaatggaggaacatgccagcaggccctttacttcagcgactttgtatgccagtgccctgagggtttcgccgggaaatgttgtgaaatcgacacaagagcaacctgttacgaggatcagggcatcagctacagaggtacatggagtactgccgaaagcggagccgaatgtaccaattggaactcctctgccctggcacagaaaccctacagcggtcggcgacctgacgcaatacggctcggcctggggaatcataactactag

SEQ ID NO: 2738 - DNA, 474 bp, Artificial Sequence
  Description of Artificial Sequence: Synthetic coding sequence
atggatgctatgaaaagagggttgtgctgcgttcttctgctctgcggcgctgtgtttgtttccccatcccaagagattcacgcccgattcagacggggcgcccgcagttatcaggtgatatgtcgcgatgagaagacacagatgatctaccaacagcaccaaagttggctacgccctgtactcaggtccaatagggtagagtactgttggtgcaattcaggaagggcacagtgtcacagtgtccctgtcaagagttgttcggaaccacggtgttttaacggtggcacttgccagcaagctctttatttctctgattttgtctgtcagtgtccagagggtttcgcgggcaaatgttgtgaaattgacacgcgggctacatgttatgaagaccaaggcatcagttacagaggtacctggtcaacagccgagagtggcgcggaatgcaccaattggaactcctcagctcttgcgtag

SEQ ID NO: 2739 - DNA, 1422 bp, Artificial Sequence
  Description of Artificial Sequence: Synthetic coding sequence
atggacgctatgaaacgcggattgtgttgtgttctcctgctgtgtggcgcagttttcgtgagccctagccaggagatccacgcacggttcaggcggggtgccaggtcataccaagtcatatgtcgcgatgaaaaaacacagatgatttatcagcagcatcagagctggttgagaccagtcctccgatccaatagggtcgaatattgttggtgcaatagcggacgggcacagtgtcatagcgtgcccgtaaagtcatgttctgagccgaggtgctttaacgggggaacatgccagcaggctctttacttcagtgacttcgtttgccagtgccccgagggctttgccgggaagtgctgcgagatcggaaactcggactgttacttcggcaatgggtctgcttatagaggcacacactctctgacagaatcaggggctagctgcttgccatggaattctatgatattgatcggtaaggtctatacggcccagaatccctctgctcaggccttgggcctgggaaagcacaactactgtcggaaccccgacggtgatgcaaaaccatggtgccacgtcttaaagaatcggcgactaacctgggaatattgtgatgtcccctcttgtagtacttgcggcctgagacaatactcacagccccagtttaggattaaaggtggactcttcgccgacattgcatcacatccgtggcaggctgccatatttgcgaagcatagaaggagcccgggggagcgattcctctgcggtgggatactgattagctcttgctggattctgtctgccgcgcactgctttcaagagagatttcctcctcaccatctaacagtcatcctgggcaggacctatagggtcgtgccgggtgaggaggaacaaaagttcgaggtggaaaagtacatcgtgcacaaggagttcgacgacgatacctacgataatgacattgctttactgcaactgaagagcgactcttctaggtgtgctcaggagagcagcgtcgtccgcaccgtgtgtcttccacccgccgaccttcaactgcccgactggactgaatgcgaattgtctgggtatggcaaacacgaggccttatcacccttttattctgaacgcctgaaggaagctcatgttagactgtaccctagctcccgatgcacaagtcagcatctcctgaatcgtacagttactgacaatatgctgtgtgccggagacactcgaagcggaggacctcaggccaacttacacgacgcgtgtcagggagatagtgggggcccattggtgtgtctgaacgacggacggatgactcttgttggaattatcagttgggggctgggttgcgggcagaaagatgtcccgggtgtatacaccaaggtgaccaattatctggattggattcgggataacatgcgcccctag

SEQ ID NO: 2740 - DNA, 1083 bp, Artificial Sequence
  Description of Artificial Sequence: Synthetic coding sequence
atggctggacatttagcttctgacttcgcatttagcccaccaccaggcggcgggggcgatgggcctggtggccctgagcctggctgggtggatcctcgaacgtggctgtcattccaggggccacccgggggcccaggaatcggccccggggttggcccaggatcagaagtctggggaattccaccatgtccacctccctatgaattctgcggcggcatggcatactgtggccctcaggttggcgtaggactggtaccacaggggggactcgagaccagtcagccagagggtgaggcgggtgtaggggtggagtcaaactccgacggcgcttcacccgagccatgcaccgtgacccccggtgcagtaaagctagagaaagagaagctggaacaaaatccagaggagtcccaggacatcaaagctctccagaaggaactggagcagttcgctaagcttctcaaacagaaacggataacccttggatacacccaggccgacgtcgggctcacattaggcgtcctatttggaaaagtcttcagccagacgacaatatgccggtttgaggcgctacaattatcttttaagaacatgtgtaagcttcgacccctgctacagaaatgggtagaagaagccgataataacgaaaacctgcaagaaatttgcaaggcggaaaccctggtgcaagccagaaaacggaagcgaacctcaattgagaacagagtgcgaggtaatttagagaatctgtttctacaatgtccaaaaccgaccctgcagcaaatttcccacatcgcccagcagctcggactggagaaagatgtcgtgagagtttggttttgcaatagacgccaaaaagggaagcggagcagttccgattatgcccagagggaagacttcgaagcagccggctctcccttttcaggggggccagtatcatttcctctggcaccaggaccacacttcggcaccccaggttacggctcccctcatttcacggcactttactcaagtgttccatttcctgagggggaagcattcccaccagtgtctgttacaactctggggagtccgatgcactccaattag

SEQ ID NO: 2741 - DNA, 798 bp, Artificial Sequence
  Description of Artificial Sequence: Synthetic coding sequence
atgcacttctaccggctgtttcttggagcaacgagacgctttctaaaccctgagtggaaaggcgagatcgataactggtgcgtctacgttctcacttctctgctgcccttcaagatccaatcgcaggatatcaaagctctgcagaaagaactggaacagttcgcaaaactccttaagcagaaacgcattaccctgggctatactcaagcagatgtgggtctcactctgggggttctgttcggcaaagttttttctcaaaccaccatatgcaggttcgaagctcttcaactctcatttaaaaacatgtgcaagctacgccctctgcttcagaagtgggtcgaggaggccgataacaacgagaacctgcaagagatatgtaaagcagaaaccctcgtgcaggccagaaagagaaagagaactagcattgagaacagggtaaggggtaatttggagaatctgttccttcagtgtcccaaacccactctgcaacagataagtcacattgcacaacagctgggcctggaaaaggacgttgtgcgagtatggttctgtaatcgacgacagaagggaaaacggtcgtcaagcgactatgcacagagggaggacttcgaggccgccggctctcctttcagtggaggaccggtctcttttcccctagctcctggcccacacttcgggactcccggctacgggtctcctcacttcacagccctctatagcagtgtgcctttcccggaaggcgaggcctttccgccagtgagcgtcaccactctgggctccccgatgcactcaaattag

SEQ ID NO: 2742 - DNA, 1083 bp, Artificial Sequence
  Description of Artificial Sequence: Synthetic coding sequence
atggctggccacttagccagtgacttcgcattttctccccccccgggagggggaggtgatggacctgggggtcccgaacctggctgggttgaccctcgcacatggctgagttttcaaggcccccctggcggcccaggaattggcccgggtgtggggcctggtagcgaagtatggggtattccgccctgtccacctccttatgagttttgcgggggaatggcatattgtggaccacaagtcggtgtgggcttggtccctcagggggggctggagacttcccagcctgaaggagaagctggcgtgggcgtggagtctaattcagacggcgcctctcctgagccctgtacggtgacgccaggcgccgtgaaactcgagaaagaaaagcttgaacagaatccagaagaatcccaagacattaaagctctccagaaggagctcgagcagttcgcgaaacttctcaagcagaaacgtataactcttggctatacccaggcagatgtaggcttaactctcggagtgctgttcgggaaggtcttcagccagactaccatctgtcgatttgaagcactgcaactctcattcaagaacatgtgtaagctgcgacctctcttgcagaaatgggtagaagaagctgacaataacgagaatctacaagagatttgtaaggctgaaaccttagtgcaggctaggaagaggaaacgcaccagtatcgagaaccgcgtcaggggaaacctcgaaaacctcttcctccaatgccccaagcctacccttcagcagatatcacatatagcccagcagctcgggcttgagaaggacgttgtgcgtgtatggttttgcaaccgccgccagaaaggaaagcgcagcagcagcgattacgcacagcgtgaggactttgaagccgcggggtctccattcagcggtgggccggtgagctttccattggcacccggacctcactttggcaccccaggatacggttcaccgcatttcactgctctgtattcatcagtgccctttcctgaaggcgaggccttccctcccgtgtcagtcacgacactgggttctcctatgcattctaactag

SEQ ID NO: 2743 - DNA, 798 bp, Artificial Sequence
  Description of Artificial Sequence: Synthetic coding sequence
atgcacttctataggctttttctcggagcaacacgacgctttctgaaccctgaatggaagggcgaaatcgacaactggtgcgtatatgtgttgacaagcctgctgcctttcaagattcagtcccaggatattaaggccctgcagaaagagcttgaacaattcgccaagctccttaaacagaagcgtattactctgggatatacacaggctgacgttggccttaccctaggcgtgctgttcggaaaagtgtttagccagaccacaatatgccggtttgaggcactgcagctctcttttaaaaatatgtgtaagttgcgacctctgctgcagaaatgggtggaagaagccgataacaacgagaacctccaggaaatctgcaaagcagagacattggttcaggcccggaagaggaagcgcacatctatcgaaaatcgagtcaggggaaacctcgaaaaccttttcttgcagtgtcctaagcccacactccaacagattagccacatagcacaacagctgggactggagaaggacgtcgtgcgagtctggttctgcaaccggcggcagaaaggcaaaaggtcttcatccgactacgcccaaagggaagacttcgaagccgcaggctctcctttttccggcgggcccgtgagtttcccgcttgccccaggcccgcatttcggaacccccggatacggatcaccgcacttcacagccctgtattcttcagttccttttccagaaggcgaggcatttccgcccgtgagtgtaacaactttggggagccctatgcactccaactag

SEQ ID NO: 2744 - DNA, 798 bp, Artificial Sequence
  Description of Artificial Sequence: Synthetic coding sequence
atgcatttttatcggctgttcctgggggctactcgcaggttcttaaatccggagtggaaaggggagatcgataattggtgtgtatacgttctgaccagcctcctgccattcaaaatccagtcacaagacatcaaggccctccagaaagaactcgagcagttcgcaaagttgttgaagcagaagcgaattacactgggctacactcaggctgacgtcggattaacacttggagtgttgttcggcaaggtgtttagtcagaccacaatctgtagatttgaggccctgcagctgagtttcaaaaacatgtgtaagttacgaccactcctccaaaaatgggttgaagaggccgacaataatgagaacctgcaggagatctgcaaggctgagacgctggtgcaggctcggaagcgtaagcgcaccagcattgagaaccgagtgagaggtaacctggagaacctcttcctccagtgcccaaagccaaccctccagcaaatcagccacatcgctcagcagttagggttggaaaaggacgtggtcagggtatggttttgcaatagacgccagaaaggcaagaggtcttctagcgattacgcccagcgggaggacttcgaagcagccggctcaccattcagcggcggcccagtctccttcccgctcgctcctggcccacactttggcacacctggatacggctcacctcactttactgctctgtactcttcagttcccttccccgagggggaggccttcccacccgtgagcgtgaccactctaggcagtccaatgcattctaattag

SEQ ID NO: 2745 - DNA, 1083 bp, Artificial Sequence
  Description of Artificial Sequence: Synthetic coding sequence
atggcagggcaccttgcgagcgattttgctttcagtccgcctcctggcggcggaggcgatggccccgggggacccgagcctggatgggtagatccgcgaacctggctctctttccagggtccccctgggggcccagggatcgggccgggagtgggtccaggttcagaggtctggggtatacccccttgcccacccccgtatgaattttgtggcggtatggcatattgtggcccgcaggtcggcgtggggctggttccccaaggtggcctggaaacttcacagcccgaaggtgaagccggcgtgggcgtcgagagcaatagtgacggcgcaagccccgagccgtgcaccgtcacacctggagcggtcaagttagagaaagagaagctcgagcagaatccggaggagagtcaagacattaaggcactgcagaaggaactggaacagtttgctaagctgttgaaacagaagcgtatcaccctgggctatacgcaagcggatgtggggctcactttgggtgtgctcttcggcaaggtgttttcacagacgactatctgtagatttgaggccctacagctctcgtttaaaaacatgtgcaaactcagacccttgctccagaagtgggtggaagaggctgataacaatgagaacctgcaggagatttgcaaggcagaaactctggtgcaggcgagaaagagaaagcgaaccagtattgaaaaccgggttcgcggaaacttagaaaacttatttctgcagtgccccaaacctactctccagcagatcagtcatattgcccagcagctcggcctcgaaaaagacgtggttagggtgtggttctgtaatcggaggcagaagggtaagcgtagctccagcgactacgcgcagcgcgaggatttcgaggcagcaggatcccccttttcaggcggtcccgtaagctttcctctcgcacccggcccacactttggcactcctgggtacgggtctccacatttcactgctctgtattcgtctgttcccttccctgagggtgaggcgtttcctccggtctctgtgacaacattgggtagtccaatgcactctaattag

SEQ ID NO: 2746 - DNA, 1083 bp, Artificial Sequence
  Description of Artificial Sequence: Synthetic coding sequence
atggccggtcacctcgcctccgacttcgctttcagtcccccaccagggggtggaggagacggacccggtggacccgaaccgggatgggtcgatcccagaacttggttgtctttccaaggccccccaggaggccctggaatcgggccaggggtcggaccaggttccgaggtctggggaattcccccatgcccacctccgtacgaattctgtggcggtatggcttattgcgggccacaagttggcgttggactggtgccccaaggggggctggagacatcccaaccagagggcgaagcaggagtaggcgtggaatccaatagtgatggagccagccccgagccatgcactgtgaccccaggcgccgtcaagctggaaaaagagaagctggagcagaacccggaagagtcccaagatatcaaggccttgcagaaagagctggagcaatttgccaagcttctcaagcagaaaagaatcaccctcgggtatactcaggccgacgtaggattgaccctgggagtgctgttcggcaaagttttttctcagactactatttgtcggttcgaggctctgcagctgtcttttaaaaatatgtgtaaactcaggcccctcctccagaagtgggttgaagaggcagacaataacgagaatctgcaggaaatctgcaaggccgagactctcgtccaggctcggaagcgaaaaaggactagcatagagaaccgggtgaggggtaatctggaaaatctttttctgcagtgccccaagcccacactgcagcagatttcacacatcgcacaacagctcggcctagaaaaagacgtcgtcagggtttggttttgtaatcggagacagaaaggtaaacgaagcagcagtgattatgcgcagcgcgaggatttcgaggcagccggctcaccattttcgggggggcctgtgtcattcccactggctcccggcccccacttcggcacccctgggtacgggtcgcctcacttcacagccctttacagttccgtgccattccccgagggggaggccttcccaccagtgtcggtcaccactctgggaagccctatgcactctaactag

SEQ ID NO: 2747 - DNA, 798 bp, Artificial Sequence
  Description of Artificial Sequence: Synthetic coding sequence
atgcacttctatcggctcttcctgggcgctaccaggaggtttctcaatccggagtggaagggcgagatagacaattggtgtgtttacgtcctgacgtcactactcccctttaagattcagagtcaagacatcaaagcgcttcagaaggagcttgagcaatttgccaagctacttaagcagaagcgcatcaccctcggttacacgcaggcagatgttggcctgacgctgggggttttgttcgggaaggtgtttagccagacaaccatttgcagattcgaggctcttcagctctctttcaagaacatgtgcaagcttcgccccctcctgcagaagtgggtggaagaggctgacaataatgagaatctccaggaaatctgcaaggcagagaccctagtgcaagcccggaaaagaaagagaacgtcaatcgagaatagggtccggggaaatctggagaatctgtttctgcagtgcccaaagcctactctgcaacaaatcagccacatcgcacagcagttgggccttgaaaaggacgtggtgcgtgtctggttttgcaatcgtcgccagaaaggtaaaagaagcagctccgactacgcacagcgcgaggattttgaggctgcaggatcccctttcagcggcggacctgtgagcttcccccttgcaccagggccacattttggaactcctggttacgggagtccccacttcactgctctgtattcttctgtgccgtttccagagggagaagcctttccgccagtgtcagtgaccaccctaggcagtcccatgcacagcaattag

SEQ ID NO: 2748 - DNA, 1083 bp, Artificial Sequence
  Description of Artificial Sequence: Synthetic coding sequence
atggccggccatctcgcgtccgattttgcctttagccccccgcctggcggtggcggggatggcccaggaggccctgaaccggggtgggtggacccacgtacctggctgagctttcagggacccccagggggaccagggattggtcctggtgtaggtcctggatccgaggtctggggcattcccccttgcccccctccatacgaattttgtggtggtatggcgtactgtggacctcaggtaggagttggtctcgtcccacagggtggactggagacctcccagcctgagggagaagccggcgtgggggttgaatcaaatagcgacggagctagtcctgagccttgtactgtcacacctggcgctgtcaaactggagaaagagaaactggaacagaacccagaagaatcacaggacatcaaagcgctgcaaaaggaattggagcagttcgcaaaattgctcaaacagaaaaggatcacacttggctatacgcaggccgatgtgggcctcacccttggtgtgttgtttggtaaggtatttagccaaaccactatctgtaggtttgaggcactgcagttgtccttcaagaatatgtgcaagctacggcctctgttacagaagtgggtggaagaggcggacaataacgagaatttgcaagagatctgtaaggctgagacactggttcaggcccgcaagaggaaaagaacatcaatcgagaatagggtccggggaaatctggagaacctgtttctgcagtgtcctaaaccaaccctccagcagattagccatatcgcccagcagctcggtctggaaaaggacgtggtgcgtgtctggttttgtaacagaagacagaagggaaaacggagctcatcagactatgcccagagggaagacttcgaggctgccgggtcccctttctcaggcgggcctgtatccttcccactcgctcccggacctcactttggaacccccggctatgggagccctcactttaccgccctgtacagcagcgtcccgttcccagagggcgaggcctttccccctgtttccgtcacaacactagggagccccatgcattctaattag

SEQ ID NO: 2749 - DNA, 369 bp, Artificial Sequence
  Description of Artificial Sequence: Synthetic coding sequence
atggcaggccacctggccagtgatttcgcatttagccctcctcctgggggcgggggcgacggcccaggtgggcccgagccaggttgggttgacccccgcacctggctgtcattccaggggccacccgggggacctgggatcggccctggggtgggacccggctccgaggtatggggtattcccccttgcccacctccgtacgagttttgcggggggatggcatactgcggaccccaagttggagttggcctggtaccacagggcgggctggagacgtcacagccagaaggggaagccggcgggggcgagcagctacggtggggtttgccaggcgctctgcaccggcatccctggtgccgggaagcctag

SEQ ID NO: 2750 - DNA, 798 bp, Artificial Sequence
  Description of Artificial Sequence: Synthetic coding sequence
atgcatttttatcgattgttcctgggagcgactcggcgatttctcaacccagaatggaagggcgagattgacaactggtgtgtgtatgtgctgactagtttgcttccattcaagatccagtcacaggatataaaggcccttcagaaggagctggaacagttcgccaagttactcaagcagaaacgaatcactttaggttatactcaggcagatgtcgggctgacactcggcgtactctttgggaaggtgttcagccagactacaatttgtaggtttgaggccctccagctatcctttaagaacatgtgcaaactgcgccctctgttgcaaaaatgggtggaagaggccgacaacaacgagaatctccaggagatctgcaaggctgagacattagttcaggcacggaaaagaaaacggacttctatagaaaatagagtccgcggaaacctcgagaacctgttcctgcagtgccccaaacctaccctgcaacagatcagccacattgcacagcagctgggtttggaaaaggatgtcgtgcgggtgtggttttgcaacagaaggcagaaaggcaaaagatccagctccgactatgctcagagagaagatttcgaagctgctgggtcaccattctcgggggggcccgtgtcgtttcctcttgctcccgggccacactttggaacccccggatacggatccccacactttaccgctctctatagttcagtcccattccctgaaggcgaggcttttccccctgtgtcagtgaccaccctgggctctcctatgcactcaaactag

SEQ ID NO: 2751 - DNA, 1083 bp, Artificial Sequence
  Description of Artificial Sequence: Synthetic coding sequence
atggcgggccacctagcctcagattttgccttttctcccccaccaggcggcgggggagatgggccgggaggaccggagccgggctgggtcgatccgagaacttggttgagcttccagggccctccagggggtcccggcattggacctggtgtgggccccgggtccgaggtatggggcatccccccttgtccccccccctacgagttctgtgggggcatggcatactgtggcccccaggtgggagtgggcttggtccctcagggcggcctggagacctcccaacccgaaggggaggctggggtgggggtagagtccaacagcgacggagcctccccagaaccatgcacagtgaccccaggcgccgtgaaactggagaaggaaaagctcgagcagaatcccgaagagtcacaggatattaaggccttgcagaaggaattggagcagtttgcaaaactcctgaaacagaagcgtataactctcggctacacacaggccgatgttgggctgactttgggcgtgctgtttggcaaggtcttctcccagactacgatctgcagatttgaggctttgcagctgtctttcaagaatatgtgtaaactgcgccctttgttgcaaaaatgggttgaggaggcagacaataatgaaaacctgcaggaaatctgtaaagcagagacccttgtgcaagcaaggaagaggaagcgcacatcaatcgaaaatagagtcaggggtaatttggaaaacctgtttctgcagtgccccaaaccgaccttacagcagatcagccacatagcccagcagctgggcctggagaaagatgtggtgcgggtttggttctgtaacagacgtcaaaaaggaaaacgttcatcttccgattacgcccagagggaggatttcgaggctgctggaagtccattttctggaggcccagtctccttcccattggctcctggcccccatttcggcacaccagggtacggcagcccccactttacggcactttatagcagtgttccatttccagaaggcgaagcctttccaccggtctctgtgactaccctgggctcacccatgcactccaattag

SEQ ID NO: 2752 - DNA, 372 bp, Artificial Sequence
  Description of Artificial Sequence: Synthetic coding sequence
atggcgggtcatctggcctccgatttcgccttctccccgcctcctggcggaggcggagacggccccgggggaccagagcctggctgggttgaccctaggacttggttaagtttccaggggccccctggaggccccggtattggacccggggtcggtccgggctccgaggtctgggggatcccaccctgcccccctccttacgagttttgtggaggaatggcatactgtggacctcaggtgggagtgggcttggttccacaaggcgggcttgagacgtcccagccagagggtgaagcaggagtgggagtagagactcctatggggcccccgaggtctcccgccccccaccccttcccttttcctctgctttag

SEQ ID NO: 2753 - DNA, 558 bp, Artificial Sequence
  Description of Artificial Sequence: Synthetic coding sequence
atggctggccatctggctagcgatttcgctttcagccctccccccgggggaggtggggacggaccaggcgggcccgaacccggctgggtggaccctcggacgtggttgtcattccagggacctcccggcggaccggggatcggacccggggtaggacccggaagcgaagtctgggggattcctccttgccctccaccctatgagttttgcggtggcatggcctactgtggcccacaggtgggcgtggggctcgttcctcagggagggttggaaacttcgcagccagagggggaagcaggggttggggtcgaaagcaattccgatggcgcttcccctgagccctgcaccgtcacgccgggggccgtgaaactggaaaaggaaaaattggagcaaaatcccgaagaaagccaagacattaaggccctacagaaggaacttgagcagtttgccaagctgctgaaacagaagcgcatcacccttggctatacccaggccgatgtccatcctggaggttctatatgggagggcatacagccaaacgaccacctccctctgtag

SEQ ID NO: 2754 - DNA, 372 bp, Artificial Sequence
  Description of Artificial Sequence: Synthetic coding sequence
atggccggtcatttggctagtgatttcgcattcagtccaccccccggaggaggaggtgatgggcccggtggaccagaacccggctgggtggatccaagaacttggttgtcattccaggggccaccaggcgggccaggcattgggcctggagtgggccccgggagcgaggtgtgggggattccaccctgtccccccccttacgagttttgtgggggaatggcatactgtggtccacaggtaggagtcgggctcgtgcctcagggaggcctggaaacaagccaacccgaaggggaggcaggggttggagtggaaacaccaatgggaccaccgagatctccagcaccccacccatttcccttcccattgttgtag

SEQ ID NO: 2755 - DNA, 558 bp, Artificial Sequence
  Description of Artificial Sequence: Synthetic coding sequence
atggccggccacctggcttcggacttcgcttttagtcctccgcccggcggcggcggagatggacccggcggacctgagcctggctgggtggaccctagaacctggttgagctttcagggtccaccaggaggtcctggcataggaccaggagttggacctggctctgaggtttgggggattccaccctgtcccccaccctacgaattttgcggagggatggcctattgcggaccccaggtgggcgttgggctagtgccccagggcggcctggagaccagccagcccgagggtgaggctggcgtgggcgttgaatccaacagtgatggtgcgtcccctgagccttgcacggtcacacccggagcggtgaaactcgagaaggaaaagctagagcagaatcccgaagagtcacaagatatcaaggccctgcagaaggagcttgaacaatttgccaaactcctgaagcagaaaagaataaccctcggatatacacaggccgatgtccatcctggaggttctatatgggaaggcatccagccgaatgaccatctcccattgtag

SEQ ID NO: 2756 - DNA, 372 bp, Artificial Sequence
  Description of Artificial Sequence: Synthetic coding sequence
atggccggtcatctcgcatctgactttgccttttcacctcctcctggcgggggcggagatggaccaggcggccctgaacccggttgggtggaccctagaacatggctctcctttcagggccctcccggcggacccgggataggacctggtgtagggccagggagtgaggtatgggggattcccccttgcccacccccttacgaattttgtgggggaatggcctactgcggcccacaggtcggcgtgggactggtcccacaggggggcctggaaacaagtcagccggagggtgaagcaggcgtgggagtggagactcccatggggccccctcgcagcccagctccacacccattcccttttccactcctctag

SEQ ID NO: 2757 - DNA, 558 bp, Artificial Sequence
  Description of Artificial Sequence: Synthetic coding sequence
atggctggacacctagcctcagattttgcattcagccctccacccggcgggggaggggacgggccagggggcccagaacccggttgggtagatccacgcacttggctgagctttcagggcccaccagggggacccgggataggtcccggagttggacccggaagtgaggtgtggggtattcctccctgtccaccgccgtatgaattttgcgggggcatggcttactgcgggccgcaagtcggggtcgggctggtgccccagggaggccttgagacatctcaaccggagggcgaggctggagtcggggttgagtctaatagcgacggagcgtccccagagccttgtacagttacgcctggcgctgtgaagcttgaaaaagaaaagcttgaacagaacccagaagagagccaggatattaaagctttacagaaggaattggaacaattcgcgaaactgctcaagcagaagaggataaccctgggctacacccaggcagacgttcatcctggcggcagcatctgggaggggattcaaccaaatgaccacttgcctctatag

SEQ ID NO: 2758 - DNA, 558 bp, Artificial Sequence
  Description of Artificial Sequence: Synthetic coding sequence
atggctggacaccttgcatcagacttcgcgtttagcccacctccagggggagggggagacggccctggaggcccagagccgggctgggtggacccccgcacttggttatcatttcagggaccccctggggggccaggaatagggcccggcgtgggacccggcagcgaagtatggggcatccccccatgcccgcctccctatgagttctgtggaggaatggcgtactgtggccctcaggtcggcgtcgggctggtaccccaaggtggcttggagacgagtcagccggagggggaggccggagtgggcgtagaatctaatagcgacggcgcatcacccgaaccctgtaccgttactccgggggccgtaaagttggagaaggaaaagttggagcagaatcccgaagaatcccaagatattaaggctctccagaaggagctcgagcaattcgccaaactgttgaagcagaaacgtatcacactcggctacacgcaggcggatgttcatccaggtggcagtatatgggaaggaattcagcctaacgaccatctgcctctgtag

SEQ ID NO: 2759 - DNA, 372 bp, Artificial Sequence
  Description of Artificial Sequence: Synthetic coding sequence
atggctgggcatctggcttctgactttgccttctcaccgcctcctggaggaggtggtgacggtccgggcggtcctgagcccgggtgggtcgatccaaggacctggctcagcttccagggaccgccaggtggcccaggtattggaccaggggtcggaccgggatccgaagtttgggggatccccccatgccccccaccctatgaattctgtgggggcatggcttactgtgggccccaggtgggagtgggactcgtgccccaaggtggtctcgaaaccagtcagccagagggtgaggcaggagttggggtggaaactccaatgggtccaccccgctctcctgcaccgcatcccttccccttccctctgctttag

SEQ ID NO: 2760 - DNA, 372 bp, Artificial Sequence
  Description of Artificial Sequence: Synthetic coding sequence
atggctggacatctcgcgagcgatttcgcattttcgccgccacccggcggcgggggagatgggcctggaggccctgagccaggctgggtcgacccacgcacatggttgtcttttcagggaccgccaggcggcccaggcattggtcctggggtcggacctggcagtgaagtctggggaatacctccctgtcctcctccttatgagttctgtggaggcatggcatattgtgggccacaggtcggagtgggactcgtcccacaagggggcttagaaaccagtcagcccgagggcgaagccggagtcggcgtagagaccccgatgggcccacctcgctcccccgcaccccacccattcccatttcctctcctttag

SEQ ID NO: 2761 - DNA, 2079 bp, Artificial Sequence
  Description of Artificial Sequence: Synthetic coding sequence
atggggacagtgtccagcaggcgcagctggtggccccttcccctccttctccttcttctgttacttctgggacccgctggtgcccgcgctcaggaggacgaggatggggattacgaggaattggtcctggctctccgtagtgaggaagacgggctggccgaggctcctgagcatgggacaaccgcgacctttcaccggtgcgctaaggatccatggcgactccctgggacatacgtggtggttctgaaggaggagacgcatctgtcacagtctgagcgcacggcccgcagacttcaggcgcaagcagccaggcggggatacctcacgaaaatactgcacgtcttccacggtctgctgcctgggttcctggtaaagatgtccggagatctgttagagctcgctctgaagctgccgcacgtcgactacattgaagaggattcctccgtgtttgcccaaagtatcccgtggaatctggagcggattacacctccaagataccgggccgatgaataccagcctcccgacgggggatccctggtggaggtctatctcctggacacttccattcagtctgaccatcgagagatcgaggggcgggtgatggttacagactttgagaacgttccagaagaagacggtaccaggttccaccggcaggcgagcaagtgcgattctcacggaacacacctggccggcgttgttagtggccgcgacgcaggggtggccaaaggcgcaagcatgagatccctgagggtccttaactgccagggtaaggggaccgtgtccggtacacttattggattggaattcatccgcaaaagtcagctggtgcagcctgtgggaccccttgtggtgctcctcccattggcagggggctacagtcgggtcctaaatgccgcatgtcagcggttggcccgggctggagttgtgctggtcactgccgcagggaacttcagggacgatgcttgcctctactcgcccgcctccgcgccagaggtgattaccgttggagctacaaatgcccaggatcagcccgtgacactcggaaccttaggcaccaattttggcagatgtgtcgacttatttgcgccaggcgaggacatcataggggcctcatctgattgttctacctgtttcgtgtcccagtccggtaccagtcaggccgctgctcacgtggccgggatcgccgctatgatgctgtctgcggagcccgaacttacacttgctgaactccgacaaagattgattcacttctcagctaaggacgtgataaacgaggcctggtttcccgaggatcaacgggtccttaccccaaacctcgtcgccgccctgcctccttcgacccatggagccggctggcagttgttctgtcggaccgtctggagcgcccattctgggcctactcgcatggccactgccgtcgctagatgtgcaccagatgaagagctcctctcttgttccagctttagcagaagcggtaagcggaggggagagagaatggaggcccagggaggaaagttggtatgtagggcccataacgcctttggaggcgaaggcgtgtatgccattgctagatgctgtttgttgccacaagcgaactgttcagtgcatacagcacctcccgcggaggcctctatggggacacgagttcattgtcaccagcagggccatgtcctgaccggctgttcttctcactgggaggttgaggatctgggaacgcataaaccgccggtcctgaggccgaggggtcagcccaatcaatgtgtgggccaccgcgaggcaagtatccatgcctcctgctgccacgccccgggtttagaatgcaaggttaaagaacacggcattcccgctccacaggaacaggtgaccgtagcatgcgaagagggttggacattgaccgggtgttccgcactgccgggaacctcccatgttctgggagcgtacgcggttgataacacatgcgtggtaagaagcagagacgtttctactaccggcagtacaagcgaaggagcagtgactgctgtagccatttgttgcagatccaggcacctcgcccaggcaagccaggaattgcaatag

SEQ ID NO: 2762 - DNA, 618 bp, Artificial Sequence
  Description of Artificial Sequence: Synthetic coding sequence
atgggcaccgtctcttctagaaggagctggtggcctctgcccttgctgctgctcctgctcctattactcgggccagcaggcgcaagggctcaggaagatgaggacggggattatgaggagctggtgctggcccttagatcggaggaagatgggctggctgaggcgcctgagcacgggacaacagcaacatttcacaggtgcgcaaaggatccctggagactgcccgggacgtatgtggttgtgctgaaggaggagacccatctgtcccagagcgaacgtacggcgagaaggctgcaggcccaggccgccagacggggctacctgacaaagatcctgcacgtgttccatggcctgcttccaggattcttagtgaaaatgagcggggacttgctggaactagcgctgaagctcccacacgttgactacatcgaagaggactcctccgtgttcgctcagtccattccatggaacctcgagaggattacacctccacgttatcgggccgatgaatatcagccaccagcctacctggaggatcactgtgggggtcatcgcggcgcagtccagatggccctgcagaaaactcaggaaactctcggccaagaacaattcgattag

SEQ ID NO: 2763 - DNA, 801 bp, Artificial Sequence
  Description of Artificial Sequence: Synthetic coding sequence
atggtgacggattttgagaatgtccctgaagaagatggaacccggtttcatcgacaggccagcaaatgtgatagtcacggcactcatctggcaggagttgtgagcggcagggatgccggggtggccaaaggcgcatctatgcgcagcttacgtgtgctgaactgccagggcaagggaaccgtgtcgggaaccctgatcggcctggaatttatccgcaagagccagctcgttcaaccggtaggtccactggtggtgctactgcccttggcgggcgggtactctagagtcctgaacgccgcctgccagaggctcgccagagctggcgtagtattggtgaccgcagccggcaatttcagggacgatgcctgtctatacagtcctgccagtgccccagaagtcattacagtaggagcaacaaacgcccaggatcaaccagttactttgggaactctgggaaccaatttcggtcgctgcgtggacctatttgcccccggcgaggatattattggtgcctcctctgattgttcaacatgttttgtgagtcagagcggcacttcgcaggctgccgcccacgttgctgggatcgccgccatgatgctgtctgcagagcctgaacttactctggctgagttgcggcagaggctgatccatttctctgcgaaagacgtgattaacgaagcctggttccccgaggaccagcgcgtggggtcttgcttcgcaggtctatatggccagcacacacgcgggctccatggatggcctcagccaagcccggcagccccacagatgcgcagctgctag

SEQ ID NO: 2764 - DNA, 3972 bp, Artificial Sequence
  Description of Artificial Sequence: Synthetic coding sequence
atggaagacggcggtcttactgcttttgaagaggatcagagatgcctttcacagagtctgcctctccctgtatcggccgagggacctgccgctcagacaactgctgagccctccaggtcattttcatcagctcacagacacctctcccgccgcaatggccttagtcgtctgtgtcaaagccgcaccgcgctatcagaggataggtggtcatcctactgtctgagctcccttgccgcccagaacatctgcacctctaagttgcattgccccgcagcacctgagcacacagacccatctgagcctcggggatctgtcagttgctgtagtctccttagggggctgtctagtgggtggtcttccccccttctgccagccccggtgtgcaatcccaacaaagccatctttactgtcgacgccaaaaccactgaaatcctggtagctaacgataaggcttgcggcttgctgggttacagcagccaagacctcatcgggcagaagctaacccaattctttctgcgcagcgacagcgatgtcgttgaagcactctcagaagaacacatggaagctgacggccacgcggctgtggtattcggtaccgtggtggacattatcagccgttcaggagaaaagataccagtgtccgtgtggatgaagagaatgaggcaggagcgacggctgtgctgcgtggtggtccttgagccagtggaacgggtatctacctgggtcgctttccagtctgacgggactgttacttcctgtgattccctttttgctcatctccatgggtacgtgagtggtgaggatgtggccggtcagcacataacagacctgattcctagcgtgcagctaccccccagtggccagcacatccctaagaatttgaagatccagcgtagtgtcgggcgtgctcgtgatggtactacttttcccctgagccttaaattaaagagtcagcccagcagcgaggaagctaccaccggagaagccgcccctgtgagcggttatcgggcatccgtttgggtgttttgcactatcagtggcctgataacactgctcccggatgggacaatccacggaattaatcactcgtttgctcttaccctgttcggatatgggaaaaccgagctgctgggcaaaaacattacttttctgatccccgggttctatagttatatggacctggcctacaactcttctctgcaactgcccgatttagcatcttgtctcgatgttggcaatgaaagcggttgcggcgagcggactctggacccctggcagggacaagacccagccgagggtgggcaggacccacggatcaatgtcgtactagctggcggacatgtggtccctagggacgaaatcagaaaactcatggagtcacaagatattttcacaggaacacagacagagctcatagcaggtggtcaactactgagctgcttatcaccacaacccgctccaggcgtggataacgtcccagagggctctttaccagtgcacggtgagcaagctcttcccaaggatcagcaaatcacagcgcttgggcgagaagagcccgtggccatcgaatcaccggggcaggatctgcttggagagagtcggtctgaacccgttgacgttaaaccattcgctagctgcgaggactcagaggctcctgtgcccgctgaagacggcggctctgatgccggcatgtgtggcttgtgtcagaaagcccagcttgaaaggatgggtgtaagcggaccctctggctccgacctgtgggccggagcagcagtggcgaagccgcaggctaagggtcagctggcaggtggcagtctattgatgcactgcccatgttatggctcagaatggggtctgtggtggcgtagccaagatctggccccctctccctctggaatggctggtctgagtttcgggacccccaccctggacgaaccctggcttggcgtggaaaacgatagagaggagcttcagacttgcctcatcaaggagcagttgtcccagctgtctctcgccggcgccctggacgtgcctcacgcagaactcgttcctaccgagtgtcaggccgtgactgctcctgtgtccagctgcgacctgggaggacgtgatctatgtggtgggtgcaccggctcctcctccgcctgctacgcactagccacagatttgcctggcggactggaggctgtagaggctcaagaggtagatgtcaattccttcagctggaatctgaaggagctcttcttttccgaccagaccgatcagactagtagcaattgctcatgcgccacatctgaactgagagagaccccatcctccttggccgttggatctgacccagacgtcgggtccttgcaggagcaagggtcttgcgtgctggacgatagggaattgttactcctgacgggtacctgcgtagacctgggtcagggcagacgtttccgagagtcctgcgttggtcatgaccccaccgaacctttggaagtgtgcctagtgtcttccgaacattacgcggcctctgacagggaatcccccggccacgtgccttccactctcgatgctgggcctgaagatacctgtccttcagcggaggaacctcgcttgaatgtgcaggtcacttctacaccagttattgtaatgaggggagcagcgggtctccagcgtgagattcaggagggcgcatactccggctcctgctaccatcgggacgggctgaggcttagcattcagttcgaagtgcgccgggtagaacttcaaggccccacccccctgttctgctgttggcttgtgaaggacttgctccactcccagagagacagtgcagcccgcacccgtctgtttctcgccagcctgcccggcagcacccactccaccgctgccgagctcacgggacctagtctagtcgaagtgctccgagcacggccctggtttgaggagcctcccaaagcagtagaattggagggtctcgctgcctgcgagggcgagtactcccaaaagtactccaccatgtctccactcggcagcggggcattcggcttcgtgtggaccgcggtggacaaggagaagaacaaggaggtcgtcgtcaaattcataaaaaaggagaaagtactggaagattgttggatcgaggatcccaagttaggcaaggtgacgttagaaatagcaattctctccagggtagaacacgccaacatcatcaaagtcctggacatctttgaaaaccaagggttcttccaactcgtgatggaaaaacatgggagcggcttagatctttttgccttcattgatcggcacccccgactggacgaaccacttgcttcctatattttccgacagctggtgtctgcagtcggatatctgcgtctgaaagacataatacacagggacattaaggacgaaaacatcgtgattgcagaagactttacaattaagctgattgatttcgggtccgcagcatacttggagcgtgggaagctgttttacacattctgtgggaccattgagtactgcgcccctgaggtgctgatgggaaacccatacagaggtcctgagctagaaatgtggagcctgggagtcaccctatacactctggtttttgaggagaacccattttgcgagctcgaagagacagtcgaggccgctatacatccaccttacctagtatctaaggaacttatgtctcttgtcagcggcttactgcagcctgttccagaaagacgaaccaccctagagaagcttgtgaccgatccctgggttactcagccagttaatctcgccgactacacctgggaggaagtcttcagggtgaacaaacccgaatccggcgtcttgagcgctgcaagcttagaaatggggaaccggagtctttcagacgtggcacaggcccaagagctatgtggaggccccgttcctggcgaggcacctaatggccaagggtgcctccacccgggcgatcctcgactcttaaccagctag

SEQ ID NO: 2765 - DNA, 1488 bp, Artificial Sequence
  Description of Artificial Sequence: Synthetic coding sequence
atgtggcaattaacctcactgctcctcttcgtggccacatgggggatttccggtacgcccgctcctctcgatagcgtcttttcttctagtgaacgggcacatcaagtcctccgaatcagaaagcgcgccaactcttttctggaggagctccgccatagcagtctcgagcgcgagtgtatcgaggaaatctgcgacttcgaggaagcaaaggaaatcttccagaacgtggatgatacccttgcgttttggtccaaacatgtcgacggtgatcaatgcctcgtgctacccctcgaacacccctgtgcctcattgtgctgtggacacggcacatgtatagacggcatcggctctttcagctgtgactgtagaagcgggtgggagggaaggttttgtcagcgcggcgagggagagcggtggatgctagccggaggtggcgctggactagggccaggctggggaagaggtacgtcgacttcatgcccaagaccgcctctgccagccgaggtaagcttcttgaactgcagtctggataacgggggatgcactcactactgtctcgaagaggtcgggtggcgcagatgcagctgtgcaccgggatacaagttgggggacgatttgctccaatgccacccagcggtcaagttcccctgcggcagaccatggaagcggatggaaaagaagcggagtcacctgaagcgtgatactgaggatcaggaagatcaagtcgaccctcggctgattgacgggaagatgaccagacgcggagactcgccatggcaggtggtgctcctggacagcaagaaaaagcttgcctgcggggctgtcctgattcacccttcctgggtgctgactgccgcgcactgcatggacgaaagcaagaaactgctggttaggcttggcgaatatgacctgagacggtgggaaaagtgggagctggatctcgacatcaaagaggtgttcgtccatccaaactattccaagtctacgacggacaatgacatagccctcttacacctggctcagcctgctacattgagtcaaacaatagtgcctatctgcctacccgacagcggactggccgaaagagagttgaaccaggcaggccaggaaacactagtaacgggctggggataccatagttcgcgcgagaaagaggcaaagcgtaatcgtactttcgtgctgaatttcataaaaatcccagtagtgcctcacaacgagtgctcagaggtgatgtccaacatggtgagcgaaaacatgttatgtgccgggattctgggagaccgtcaggatgcctgtgagggtgacagtggcgggccgatggtggcaagctttcacgggacgtggttcctcgtgggactggtgagctggggggagggttgtggattgctgcacaactatggagtctacaccaaagtttcccgataccttgactggatacatgggcacatccgtgataaagaggcccctcaaaagtcttgggctccttag

SEQ ID NO: 2766 - DNA, 1386 bp, Artificial Sequence
  Description of Artificial Sequence: Synthetic coding sequence
atgtggcagttaacgtcacttctcctgttcgtggctacttggggtatctccgggacccctgcacctctagactcagtctttagttcatctgagcgggcacaccaggtgctgcgaatccgaaaacgagcgaactcttttctggaggagttacggcatagctcgctggagagagaatgtattgaagagatttgtgatttcgaagaagcgaaggaaatttttcaaaacgtcgatgatactctagccttttggtcaaagcacgtggatggggaccaatgtctcgttttaccactggaacatccatgcgccagtctctgttgcgggcacgggacctgcatcgacggtattggctcattttcatgcgactgccggagcggctgggaaggccggttctgtcagcgcgaggtgtcttttctgaattgctcgctggataatggaggttgcacacactactgcctggaggaagtgggctggcggcgatgtagttgcgccccaggttataagctgggggatgacctgttacagtgccaccccgcggtcaaattcccttgtggaaggccatggaagcgaatggagaagaaacgtagccacctcaaacgcgatacggaggaccaggaggaccaggtggaccctagactgatcgacggaaagatgactagacgcggcgatagcccatggcaggtcgttctcctcgatagcaaaaagaagttggcctgtggcgcggtactcatccacccctcatgggtcttaactgctgcgcactgtatggacgaatcaaagaagttgctggtgcgactgggggagtatgacctgagacgctgggaaaaatgggaactagatctagatattaaagaggtctttgttcaccccaattatagtaagtccactaccgacaacgatattgccctcctgcacctggcgcagccagcaaccctctcacagaccatcgtcccgatctgcctgcccgactcgggcctggcggagcgggagttaaaccaggcgggccaggagacactggttaccgggtggggttaccacagctctcgggaaaaagaggctaaaagaaaccgcactttcgtgttaaatttcattaagatcccagtggtgcctcacaacgagtgttcggaggtcatgtccaacatggtttcagagaacatgctctgcgccggcatcctgggggatagacaagacgcgtgtgaaggtgacagcgggggacctatggttgccagctttcatggcacttggtttttggttgggctggtgagctggggggagggttgcggactacttcacaactacggcgtctacaccaaggtctctcgatatctggattggatacacggacatattcgagataaagaggcaccccagaagtcctgggcgccatag

SEQ ID NO: 2767 - DNA, 351 bp, Artificial Sequence
  Description of Artificial Sequence: Synthetic coding sequence
atgtggcagcttacctcgctgctcctcttcgttgcgacatggggtatcagcgggaccccagcccccttagactcagtattcagttcaagtgaacgagcccatcaggttttgcgaattcggaaacgggcaaattccttcctggaggaattgagacactcatctctggagcgcgaatgcatagaagaaatttgcgattttgaagaggccaaggaaatattccagaacgtcgacgacaccctagcgttctggtcaaagcatgtcgacggcgatcagtgcttagtgctgccccttgagcacccatgtgccagtctttgctgtggccatggtacgtgtattgatggaattgggtag

SEQ ID NO: 2768 - DNA, 381 bp, Artificial Sequence
  Description of Artificial Sequence: Synthetic coding sequence
atgtggcaacttacttcgctcctgttatttgtggcaacctggggcatcagcgggaccccggctccgctggactcggtatttagctcctccgagagggcccaccaggtgctgaggattaggaaaagggctaattcgttcttagaagaactgcgacactcgtctctggagagagagtgtatagaggagatttgtgatttcgaagaggcaaaggagatttttcaaaacgtagatgataccctggctttctggtcaaaacacgtggatggggatcagtgcctggtgctgccgcttgaacacccttgcgcgagtctttgttgtggtcacggaacctgtatcgacgggatcggttcatttagttgtgactgccggtccggatggtag

SEQ ID NO: 2769 - DNA, 1551 bp, Artificial Sequence
  Description of Artificial Sequence: Synthetic coding sequence
atggccgcgggacgtcgtacatgttccatttcaacaacacgaccttgtgcgtccgccagccggatgtggcagctgacctctctacttctttttgtggcgacttggggaatttccggaacccctgcaccactggattctgttttcagcagcagcgaacgggcgcaccaggtgctgcgcattagaaagcgcgcaaattccttccttgaggagttacgccactcctcgctggaaagggaatgcatcgaggaaatctgtgattttgaggaagccaaggaaattttccagaacgttgatgataccctggccttctggtccaagcacgtagacggcgatcagtgcctggtgcttccgctggagcacccctgtgcctcactttgctgtggacacggtacctgtatcgacggtatcggtagctttagttgtgactgccgctctggctgggaagggagattctgccagcgaggtgagggggagcgctggatgctagctggtggtggggcaggactcgggccagggtggggaagaggaacctcaacgtcatgtcccagaccaccactgcctgctgaggtgtcttttcttaattgttccctcgataacggagggtgtacccactactgcctggaagaagtcggatggcgacgctgctcatgcgcccctgggtacaagctcggggatgatttgctgcagtgccacccagcagtcaaatttccatgtggacggccatggaagaggatggagaagaagcgatctcatttgaagagggatacggaagatcaggaggatcaggtcgacccaagactaatcgacggcaagatgacaaggcggggtgacagcccatggcaagttgtactgctggactcaaaaaagaaactggcatgtggcgccgtcttgattcacccctcatgggtgctgaccgccgcccactgcatggacgagtccaaaaagttgttggtgcggcttggcgaatacgatcttcgacggtgggaaaaatgggagctggacttggatatcaaagaggtgttcgtacatcccaattattcgaaatctaccactgataatgacatcgctctgctacacttggcacaaccagccactctgtcgcagaccattgtaccaatctgcttgcctgacagcgggctcgctgagagggagctgaaccaggccggacaggagaccctggtgacggggtggggatatcactcctcaagagagaaggaggccaagcggaataggaccttcgtgctcaactttatcaagatacctgttgttccacataacgagtgctcggaggttatgtcaaacatggtctccgagaacatgctctgtgccgggatactgggggatcgccaggacgcctgtgaaggcgattccggtggcccaatggttgcatcattccatggtacctggttcctagttggactggtgtcctggggcgaaggatgcggcctcctgcataattatggagtgtacaccaaggtgtcaagatacctggactggattcatggtcacatccgcgataaggaggccccccaaaagtcctgggccccctag

SEQ ID NO: 2770 - DNA, 1263 bp, Artificial Sequence
  Description of Artificial Sequence: Synthetic coding sequence
atgtggatgacccactggccatctggaccgtcaaccagtactgtgacctctgcttggagttgcccgtggtcgaccagagcaccggcatgcgccgctggcaccgcacgagcttctaccgcttccgctgctagcgccgctacagcggctgccgctggccgggcagccagtgcaagtgcagtgcggggccgaggagggtgctggaggggcggcgccggcctgggtccaggatggggacgcggaacctctactagttgccccagacccccactgcccgcagaagtgtctttcctcaattgctcattagacaacgggggctgcacccactactgtttggaagaggtcgggtggaggcggtgttcctgcgcccctggatataagcttggagacgacctgcttcagtgccaccccgctgtgaaatttccttgtggacggccctggaagcgtatggagaaaaagcgctctcacctgaagagggacaccgaggatcaggaggatcaagttgaccctcgcctgatcgacggtaaaatgactagacggggcgactctccctggcaagttgtactgcttgatagcaagaagaaactggcttgtggagcagtgctgattcacccctcatgggtgctgactgccgcccattgcatggatgagagcaagaagcttctcgttcgtctgggcgaatacgacctgagaaggtgggagaagtgggagttagacctcgatatcaaggaggtttttgtgcatccaaactatagcaaaagtacgaccgataacgacatcgccttgttgcatttggcccagccagcaacacttagccagacaattgtccctatatgtttgcctgattcaggacttgccgagagggaactgaaccaggctggtcaagaaacactggttaccggctgggggtatcacagcagtcgtgagaaagaggcaaaacgaaaccggacatttgtgctgaactttatcaagatcccggtcgtgccacacaacgagtgtagcgaagtcatgagcaacatggtcagcgaaaatatgctgtgcgccggtatacttggcgaccgacaggatgcatgtgagggcgactccggaggtccaatggttgccagtttccatggcacatggttcctcgtggggcttgtcagctggggagagggctgcggactgcttcacaactacggtgtctatacaaaggttagccgctacctcgattggattcacggccacatcagggataaagaggcaccacagaagtcctgggctccttag

SEQ ID NO: 2771 - DNA, 354 bp, Artificial Sequence
  Description of Artificial Sequence: Synthetic coding sequence
atgcctcggctttttttcttccatctcttgggggtctgtctgctgcttaaccaattttcgcgagcagtcgcagacagctggatggaagaggtcattaaactgtgcggccgggaactggttcgcgcgcagattgccatctgcggtatgagtacctggtccaagagaagtctatcccaagaagacgcaccccagaccccccgccctgttgcaggagactttattcaaaccgttagcttaggcatatctccagacggaggtaaagccctacgcactggatcctgctttacacgggaattcctcggcgccttgtccaaactctgtcatccatcaagtacaaagattcaaaagccatag

SEQ ID NO: 2772 - DNA, 558 bp, Artificial Sequence
  Description of Artificial Sequence: Synthetic coding sequence
atgcccagactgtttttctttcacttactgggagtgtgcctgctccttaatcagttttctagagctgtggctgattcatggatggaagaagtaattaagctgtgtggaagggagcttgtccgagcccagatagctatatgtgggatgtcaacatggtctaaacgatctttatcacaggaggacgccccacaaaccccccgacccgtcgcggaaattgtgcccagctttataaacaaagacactgagactataaatatgatgagtgaattcgtcgcaaatttgccccaagagctgaagcttacccttagcgagatgcagccagcgctgccccagctgcagcaacatgtccctgtactgaaagattccagccttctgtttgaggagttcaagaagctgattagaaatcgtcagtctgaagcagccgactccagccccagcgaactaaagtacttagggttagatacccacagccggaaaaaaaggcagttgtattctgctctggctaataaatgttgccacgtgggatgcactaagcgcagtttggccaggttctgttag

SEQ ID NO: 2773 - DNA, 1047 bp, Artificial Sequence
  Description of Artificial Sequence: Synthetic coding sequence
atgaatggaactgaaggcccaaacttttacgttccattcagcaacgctacaggggtggtgcgaagtccattcgagtatccacaatactatcttgctgagccatggcaatttagtatgctcgcagcatacatgttcctcctgattgttctcgggttcccaatcaatttcctgactctctacgtgaccgttcagcacaagaagctgcgaaccccacttaactacattctgttaaatcttgcagtcgctgatctctttatggtgttaggagggtttacttctactctgtacaccagtcttcacgggtattttgtgttcggccctactggctgtaatctggaagggttttttgccaccttgggcggggagattgccttatggtctcttgtcgtcctcgccattgagcgatatgtcgtggtgtgcaagcctatgagtaatttcaggttcggcgagaaccatgctataatgggagtggcattcacctgggttatggcccttgcctgcgcagcgccacccctcgcgggctggtccaggtacatcccagaaggccttcagtgcagttgcggaatcgactactatactttgaagccagaagtcaacaatgagagcttcgtcatctatatgtttgttgttcattttactatacctatgatcattatctttttttgctatgggcagcttgtgttcacagtcaaggaggcagcggcccagcagcaagagagcgcaaccactcagaaggccgagaaggaggtcactcgaatggttataataatggtgatcgccttcttgatatgttgggttccatacgccagtgtggcattctatatctttacacatcaagggtccaactttggccctattttcatgacaatcccagcgttttttgcgaaaagcgccgctatctacaacccagtaatatatatcatgatgaacaaacagttcagaaactgcatgctgacgacaatctgttgcgggaaaaaccctctgggcgatgatgaggcgagcgcgacggtgtccaaaaccgagactagccaggttgcaccggcctag

SEQ ID NO: 2774 - DNA, 1257 bp, Artificial Sequence
  Description of Artificial Sequence: Synthetic coding sequence
atgccaagctctgtgtcttggggaatcctgctgctggctggactgtgctgtcttgtgccagtcagtcttgctgaagatcctcagggagatgctgctcagaagactgataccagtcaccacgatcaggatcatccaacttttaacaagataacccccaatttggccgaatttgctttttctctgtacagacagcttgcgcaccagtcaaatagtacaaacattttctttagcccggtatccatcgctaccgccttcgctatgctttctcttggaacgaaggcagacacgcatgatgagatcctggaggggttaaactttaacctgacggaaattcctgaagcacagatacacgaggggttccaggaactgctgcgtaccctgaatcagcctgacagccagctgcagctcacaacagggaatggcctgttcctttccgaaggactgaagctggttgataagtttctggaagatgtcaaaaaactttaccattcagaggcgtttactgtgaattttggggacactgaggaggcgaaaaagcagatcaatgattacgtcgaaaaaggtacacagggcaagatcgtagacctggtcaaggagttggatcgagacactgtgtttgcccttgttaactacatattttttaaaggcaagtgggaacgcccctttgaagttaaggatacggaggaagaagattttcatgtggatcaggtgactactgtgaaagtcccaatgatgaaacgtctggggatgtttaacattcagcattgtaaaaaactctcaagctgggtgctgctgatgaagtacttggggaatgccacagccatctttttcctgcccgacgagggcaaacttcagcacctcgagaacgaattgactcacgatatcataactaaatttctcgagaatgaagaccgccggagcgctagcctccacctgcccaaattgtccattaccgggacctacgatcttaaaagcgtgttaggccaattaggaattacaaaagtgttctctaatggtgccgacctgagtggcgtgactgaggaagccccgcttaagttgtccaaggcagtgcacaaggccgtgttaaccattgacgaaaagggtactgaagctgcaggtgctatgtttcttgaggccatccctatgagcataccccccgaagtgaaatttaacaaaccgttcgtttttttgatgatcgaacagaacaccaagtctccgttgtttatgggaaaagttgtgaacccaacgcaaaagtag

SEQ ID NO: 2775 - DNA, 1257 bp, Artificial Sequence
  Description of Artificial Sequence: Synthetic coding sequence
atgccttcgtctgtgtcttggggcattctccttctggccggcctctgttgcctcgtgccagtgtcacttgccgaagatccgcagggcgatgcagctcaaaaaacagacacctcccatcatgaccaggatcacccgacgtttaacaaaataaccccgaatctagcagaatttgcattctccctgtataggcagctggcacaccagtctaactctacaaacatctttttttcgcctgtgtcgattgcaactgcctttgcgatgctaagcttgggaaccaaggctgatactcacgatgaaattctggaggggctgaatttcaacttgactgagataccggaggcccagattcatgaagggttccaagaactgcttcggactcttaaccagccagattcacaacttcaactgaccacaggaaacggcctgtttctgtcagaggggctgaagcttgtggacaaatttcttgaagatgtgaaaaagctgtaccattcagaagcattcacagtgaatttcggcgatactgaagaagcaaagaagcaaatcaatgactacgtcgagaaaggcactcagggtaaaatcgtggacctagtgaaggaattggatcgcgatacggtgtttgctctcgtgaattacatttttttcaaaggaaagtgggagcgcccctttgaagtcaaagataccgaggaggaagactttcatgtggatcaggtgacaactgtaaaggtgcccatgatgaaaaggctcggcatgttcaacatacagcactgcaagaaactgtccagctgggtgcttcttatgaagtatctcggcaacgctactgccatttttttcttgcccgatgagggcaaacttcagcatctcgaaaatgagttgactcacgatatcattaccaaatttctcgagaatgaggatcgccgcagtgcaagtctccatctccccaagctgagcattactggaacctatgatttaaagagcgtgttgggccagctggggatcacaaaagttttctcgaatggcgctgaccttagtggcgtgaccgaggaggccccactcaaacttagtaaggcggtccacaaagcagtattaactatcgacgagaaggggacagaagcggcaggcgctatgtttctggaggccataccgatgagcatcccccccgaggtgaaatttaacaaaccatttgtgttcttaatgattgagcaaaataccaagtcccccctttttatgggcaaggtggtgaatcctacccagaagtag

SEQ ID NO: 2776 - DNA, 1257 bp, Artificial Sequence
  Description of Artificial Sequence: Synthetic coding sequence
atgccaagtagtgtgtcttggggtatcctgctcttagccggcctctgctgcctcgtccctgtcagcctcgcagaggacccacaaggtgacgctgcccagaagactgacaccagtcaccacgaccaggaccacccaacattcaataagatcacaccgaatttagccgaatttgctttctccctgtatcgacagttggcccaccagtctaattccaccaacatcttctttagccccgttagtatcgccacagcatttgccatgctctcattggggacaaaagccgatacacacgacgaaatcttagagggcctcaattttaatttgaccgaaattccggaagcccagatccacgaaggcttccaagagctactgcgaacacttaatcaaccagattcccaactgcaactaacaacaggcaatgggcttttcttaagcgaaggccttaagctcgtcgataagtttctggaagacgtcaaaaagctctaccatagcgaagccttcacggttaattttggggatacagaggaagcaaagaagcagatcaatgactacgtagaaaaaggcacccaagggaagatcgtagatttggttaaggaactggaccgcgacacagtcttcgcccttgtcaactacatcttcttcaaggggaagtgggaaaggccattcgaggtgaaagacacagaagaggaggactttcacgtggaccaggtcacaaccgtgaaagtgccgatgatgaaaagattggggatgtttaatattcagcattgcaagaagctaagctcttgggtgctgcttatgaagtacctcggcaacgcaacggccatattcttcttaccagatgagggaaagctccaacatttggaaaacgaacttacccatgatataattactaagttcttggagaatgaggatagaagatctgcgtccctgcacctacctaaactctcaatcactggcacttatgatctgaaatcggtcttgggacagcttggtattacaaaggtcttctctaatggagccgatctcagtggggtaacggaggaggcaccattgaagttgagcaaggcagtgcacaaagcagtgctgactatcgatgaaaaaggcactgaagcagccggtgcaatgttcttagaggctatccccatgtctatccccccggaggtgaagtttaataagccctttgtctttctcatgatcgagcaaaatacaaaatcacccctcttcatgggcaaggtcgtcaacccgacccaaaagtag

SEQ ID NO: 2777 - DNA, 1080 bp, Artificial Sequence
  Description of Artificial Sequence: Synthetic coding sequence
atgccatcgagtgtgtcttgggggatacttctgttagcgggactttgctgcctggtgcctgtctccctggccgaagacccgcagggcgacgccgctcaaaagactgacacatcacatcacgatcaggaccaccccacattcaataaaatcactccaaatttagccgagtttgcattcagcctttataggcagttagcacaccagtcgaattccactaacatctttttcagcccggtctcaatagccacagcttttgccatgctttccctgggcactaaggctgacacccacgatgagatacttgaaggacttaacttcaatctgacagagatccctgaggctcagatccacgagggcttccaggagctgctgagaaccttgaatcagccggattcacaactgcagcttaccacaggaaatggactgtttctgagcgaggggctgaagcttgtggacaagttcctcgaggatgtgaagaagttataccacagtgaagctttcacagtgaacttcggcgacaccgaagaggcaaagaaacagattaacgattacgtagaaaagggaactcagggtaagatcgtggatctcgtgaaggagttagatcgggatacagtctttgcactcgtcaattacatattcttcaaaggcaaatgggagcggcccttcgaggtgaaggacactgaggaagaggactttcacgtcgatcaagtaaccacagtgaaagtaccaatgatgaagaggctggggatgttcaacattcagcattgcaaaaagttgagctcttgggtactcctaatgaagtatcttggaaatgcaactgcgatctttttcctaccagacgaaggcaagttacaacatctggaaaacgagttaacgcatgacatcattacaaaatttctggagaacgaggaccgaaggagcgcctcgctgcatctcccgaaattgagcataaccggaacctacgatctaaaaagcgttctagggcaactgggcattacaaaggtcttttcaaacggcgctgacctgtccggagtgacagaagaggctcctttgaagttgtccaaggtaagatccccttag

SEQ ID NO: 2778 - DNA, 1257 bp, Artificial Sequence
  Description of Artificial Sequence: Synthetic coding sequence
atgccttcatcagtgagctggggcattctgctcctagccggcctctgctgcctggttcctgtgtctctggccgaggatccccagggagatgcagcccagaaaaccgatacatcacaccatgaccaggatcaccccactttcaacaagatcacacccaacctggcagagtttgcattctcgttgtaccggcagttagcgcatcaaagcaattccaccaacatcttcttcagccccgtgtccatagccacggcatttgcaatgttgagcctgggtacgaaagcggacactcatgacgagattctggaagggctgaactttaatctgacggagattcccgaggcacagattcacgagggctttcaagaactgctgcggactctaaatcagcccgatagccagctgcagctgacaaccggtaacgggcttttcctgagcgaaggcctgaagctcgtagacaagttcttggaagatgttaagaagctgtatcatagcgaggccttcactgtcaactttggggacacagaggaggctaagaagcagataaatgattacgttgaaaaaggcacccaggggaagattgttgatttggtcaaagagctagacagggacaccgtcttcgccctagtcaactatatcttctttaagggcaaatgggagcgtccattcgaggtcaaagataccgaggaggaagatttccatgtggatcaagttactaccgtcaaggttccaatgatgaaaagactaggcatgttcaacatccagcattgcaagaaactcagctcctgggtgctcctcatgaagtatctagggaatgctactgcaatattcttcctgccagatgagggaaagctgcagcacttggaaaacgagctcacacacgacattatcactaagttccttgaaaacgaggacaggcggagcgcctccctccatctgcccaagctgagcattacaggaacctatgacctgaagagcgtgttggggcagctaggtatcaccaaagtcttttctaatggcgcggatctatccggcgtcaccgaagaggcccccttgaaactgagcaaggccgtgcacaaagcagtactgacaatcgatgaaaaaggaaccgaagcagccggagctatgttcttagaagccatcccaatgagcatccctcccgaggtcaaattcaacaaaccctttgtcttcctcatgatcgagcagaatacaaaatcgcctctgtttatggggaaggttgtgaatccaactcagaagtag

SEQ ID NO: 2779 - DNA, 1257 bp, Artificial Sequence
  Description of Artificial Sequence: Synthetic coding sequence
atgccaagtagcgtttcttgggggatactccttctcgccgggctgtgctgccttgtgccggtcagcctcgccgaagatcctcaaggcgatgcggcgcagaaaaccgatactagtcatcatgatcaagatcatcctactttcaataaaatcaccccaaatctggccgaattcgccttctccctgtaccggcagctggcacatcagtctaattccactaatatcttcttttccccagtttctatcgccaccgccttcgccatgctatcattgggcaccaaggccgatacgcatgatgaaatactggaaggactgaactttaaccttacggaaattcctgaagctcagatacatgagggctttcaggagctcctcagaactttaaaccagcctgactctcagctgcagctgactactggcaatggactgttcctcagtgaaggcctgaaattagtggataagttcttggaggacgtgaaaaagctttaccacagcgaggccttcacagtgaattttggcgacactgaagaagctaaaaagcagattaatgattacgtcgagaagggaacccaggggaagattgttgaccttgtcaaggagctagacagggataccgtcttcgcattggtgaattatattttctttaaggggaagtgggagcgcccatttgaagtgaaagacactgaggaagaagattttcatgtcgaccaggtgaccaccgtgaaagtccccatgatgaaaagactggggatgttcaacattcagcactgtaaaaagctgtctagttgggttctgctcatgaaatacttaggcaacgccaccgccatttttttcttacctgacgaaggtaagctgcagcacctggaaaatgaactgactcatgatattataacgaagttcttggagaacgaggaccgacggtccgcgtcactgcatctgcccaagttgtccataacaggcacatacgacctgaagagcgtcttaggtcaactgggtattacgaaagtgttttccaacggagctgatctgtcgggtgtgaccgaggaggctccccttaagctgtctaaagcggtgcataaagccgtgctaacgattgacgagaagggaacggaagctgccggggctatgtttcttgaggccattcccatgagcatcccacccgaagttaagttcaacaaaccattcgtttttttaatgattgagcagaacactaaatcacccctctttatgggtaaggtggtcaatcccacccaaaagtag

SEQ ID NO: 2780 - DNA, 1257 bp, Artificial Sequence
  Description of Artificial Sequence: Synthetic coding sequence
atgcctagcagcgtgtcctgggggatccttctactcgccgggctttgttgtctggtcccggtgagtcttgccgaggatccccagggcgatgctgcccaaaaaactgatacctcccaccacgatcaagaccaccccacatttaataagatcacacctaatttggcagagtttgcattctcgctttatcggcagctggcccatcagtctaacagcactaacatattcttctcacctgtctcaatagccacggcctttgctatgctgtcactcggtacaaaggcggacacacacgatgaaatcctcgagggcctcaatttcaatcttaccgaaatcccggaagcccagattcatgaaggtttccaagaactgctcaggaccctcaatcagccagattcacaactgcaattgacaacaggaaatggactattcctgagtgaaggccttaaactggtcgacaagttccttgaagatgtcaaaaaactctaccatagcgaggccttcaccgtgaactttggtgacactgaggaggctaagaagcagatcaacgattatgttgagaagggaacacaggggaagattgtggatctagtgaaggagcttgaccgggacactgtcttcgcgctggtaaactacattttctttaagggcaaatgggagagaccgtttgaggtgaaagatacggaggaggaagacttccacgtggaccaggttaccactgtgaaggtgccgatgatgaagaggctggggatgttcaacatccagcactgcaagaaactatcctcttgggtccttctgatgaagtacctaggaaacgctacagcgatattttttttgcccgacgaaggtaaactgcagcatttggaaaacgagcttactcatgatatcattacaaagttcctcgagaatgaagataggcgatccgctagtctgcaccttccaaaactcagcattaccgggacctatgatctaaagtcagtcctggggcagctagggatcactaaggtcttctccaacggagcagatctgtccggcgtcaccgaggaagcgccccttaagttgagtaaggccgtgcacaaggcagttctcacgatagacgagaaagggacagaggccgcaggcgccatgttcctagaagccattcccatgtctataccccccgaggtcaaatttaacaaacccttcgtttttctgatgatcgaacaaaatacaaaaagtccgttgtttatgggcaaggtcgtgaaccccactcagaagtag

SEQ ID NO: 2781 - DNA, 1257 bp, Artificial Sequence
  Description of Artificial Sequence: Synthetic coding sequence
atgcccagttctgtgtcctggggcatcctgctgctcgctggtctgtgttgtctggtgccagtttctctggccgaagacccccagggcgacgccgcccagaagacagatacgtctcaccacgaccaggatcatcccactttcaacaaaatcactcctaacctggctgaatttgccttcagtctctatcgacaactggcgcatcaatctaactcaaccaatatctttttctcgcctgtatccatagccaccgcttttgccatgttgagtctggggaccaaagccgacactcacgacgagatactggagggcctgaatttcaacctcaccgagattcccgaggctcagatccatgaaggtttccaagagctcttaaggaccctgaatcagccagactcccagctgcagctgacaaccggaaacggattattcctgagcgagggactgaagttagtagataaattccttgaggatgtcaagaaactgtaccactccgaagcgttcaccgtcaattttggagacacagaggaggccaagaagcagatcaacgactacgtggaaaaggggacccagggcaaaatcgtcgatttggtgaaggaactcgacagggacaccgtttttgccctggtgaattatattttctttaagggaaagtgggagcggcctttcgaggtgaaggacacggaggaagaggattttcacgtggatcaggtcacaaccgtgaaggtgccaatgatgaaacgcctcggaatgttcaacatccagcattgtaaaaagctctctagctgggtgctccttatgaaatatctggggaacgctaccgcaatcttctttctgcccgacgaggggaaacttcagcacctcgagaacgagctgacgcacgacatcattactaagtttctggagaacgaagacagaagaagcgcctccctgcatttacccaagctatcgattacagggacctacgacttaaaaagcgtcctgggccagttgggaatcacgaaagttttcagcaacggtgccgacctctcaggggtgactgaagaagccccgctgaagctttccaaggcggtacacaaagcggtgctgaccattgatgaaaaaggcacggaagctgctggcgctatgttccttgaggcgattcccatgagcatcccacctgaagtcaaatttaataagcccttcgtgttcttgatgatcgaacagaacaccaagtcaccactgtttatgggaaaggtggtgaaccccactcagaaatag

SEQ ID NO: 2782 - DNA, 1257 bp, Artificial Sequence
  Description of Artificial Sequence: Synthetic coding sequence
atgccgtccagcgtctcctgggggattttattattggccggcctctgttgtctggtcccagtaagcctggcggaagacccacaaggcgacgctgctcagaagaccgatacatcacatcatgatcaggatcatccaacctttaataagatcaccccaaatctcgccgagtttgcctttagcctgtataggcagttggcacaccagtctaactccactaacatttttttttcgcccgtgtcaatcgcaaccgccttcgcgatgctcagcttaggtacaaaagcggacacgcatgatgagatccttgagggccttaacttcaatctgacggagattcctgaggcccagattcacgaagggttccaggaactacttaggacgctaaaccagcccgattcccagttacaactgacaaccggcaacggtctctttttgagtgaaggcttgaagctcgtcgataaatttttggaggacgtgaaaaagctataccattccgaggcttttactgtcaactttggcgatacagaggaggccaaaaagcagatcaatgattacgtagagaaaggcacacagggcaaaatagttgatctcgttaaagaactggaccgagatacagtgtttgcgctggtcaactacatcttcttcaaagggaagtgggaacgccctttcgaggtcaaggacaccgaagaggaggatttccatgtagatcaggtcactaccgtcaaggtgcccatgatgaagaggctcgggatgtttaacatccagcactgtaagaagctctcttcttgggtgcttctcatgaagtacctgggaaacgcaaccgctatttttttcctgcccgacgagggcaagctgcagcacttggagaatgagctgacacacgatatcattaccaagtttttggaaaatgaagaccggaggtccgcgagcctgcatctgcctaaactgtcaataacaggcacgtacgacctaaagtccgtgttgggacagctagggataacgaaggtattttccaacggggccgaccttagcggagtgaccgaagaggcccccctcaagctgtccaaggcagtgcataaggccgtactgacgatcgacgagaagggcacggaggcggcgggcgcaatgttcttggaggcaatccctatgtcaatacctcccgaggtgaagttcaacaagcccttcgtgttcctgatgatcgagcaaaacaccaaatctccactttttatgggcaaggtggtcaaccccacgcagaagtag

SEQ ID NO: 2783 - DNA, 279 bp, Artificial Sequence
  Description of Artificial Sequence: Synthetic coding sequence
atgccatctagtgtgtcttgggggatcctgctccttgccggactctgctgtctggtcccggtttccctcgccgaagacccacagggagatgcggcccagaaaacggacacgtctcaccatgaccaggatcacccaactttcaataaaataacacccaacttggctgagtttgcattttcgttgtataggcagttggcccatcagtccaacagcactaatatctttttttccccagtttctatagccacagcttttgctatgctgtccctaggtacatag

SEQ ID NO: 2784 - DNA, 471 bp, Artificial Sequence
  Description of Artificial Sequence: Synthetic coding sequence
atgccgtctagcgtctcgtgggggattcttttactggccgggttgtgctgtctggttccagtctccctggccgaagatcctcagggagacgccgcacagaaaacagacacctcccatcatgaccaagatcacccaacatttaacaagattactcccaatctcgcagaatttgcgttttccctgtataggcagctggcccatcagagtaattcaaccaatatctttttcagtccggtgagcattgctaccgccttcgcaatgttgtccctcggcaccaaggccgatacccacgacgagattcttgagggtttgaatttcaatttaaccgagattcccgaagcacagatccacgaaggctttcaagaactgctcagaaccctcaatcagcctgattctcaactccaactgactaccgggaacgggcttttcctttctgagggcctgaaactggtggacaaattcctggagtag

SEQ ID NO: 2785 - DNA, 354 bp, Artificial Sequence
  Description of Artificial Sequence: Synthetic coding sequence
atgcccagctctgtgtcttggggcatcctcttgctggccggcctgtgttgtctcgtaccagtctcgctggctgaggatcctcagggggacgccgctcagaaaacagacacaagtcaccatgatcaggatcatcccacttttaataagatcactcctaacctcgccgagttcgcattctctctctaccgccaactggcacaccagtccaacagtacgaacatctttttcagcccagtgtccatcgccaccgcttttgctatgctgtccttgggcacgaaggcggatacccacgatgagatacttgaaggcctaaacttcaatctgacagaaattcctgaggcccagatccactag

SEQ ID NO: 2786 - DNA, 69 bp, Artificial Sequence
  Description of Artificial Sequence: Synthetic coding sequence
atgccaagtagtgtgtcctggggaatcctgctgcttgctggcttgtgctgcctggtacctgtgtcttag

SEQ ID NO: 2787 - DNA, 435 bp, Artificial Sequence
  Description of Artificial Sequence: Synthetic coding sequence
atgccgagcagcgtgagctgggggatattactgctggcgggactgtgctgcctggtgcctgtatctctcgcagaggacccacagggagacgcggctcaaaagacggacacctctcaccatgaccaggaccaccccacattcaacaagatcacccctaacctggcagaatttgcttttagtttatatcgccagctcgcacatcaatctaactctaccaacatcttcttttccccagtttctattgccaccgcttttgccatgctgagcttgggaactaaagctgatacgcacgatgaaatcttggaagggcttaattttaatctgaccgagatccccgaagcacagattcatgaagggtttcaggaactgctacggacgttgaaccaaccagactcacaactgcagctgaccaccgggaacggtctgtttctctag

SEQ ID NO: 2788 - DNA, 780 bp, Artificial Sequence
  Description of Artificial Sequence: Synthetic coding sequence
atgtacagcaacgtcattgggactgtgacctccggaaaaaggaaggtatacctgctgtcgctgctcttgattgggttttgggattgtgttacatgccacggcagtccagtcgacatatgcactgctaaaccacgcgacatacccatgaacccgatgtgcatatacagaagtcctgagaagaaggcgacggaggacgagggaagtgagcagaaaatccctgaggcaacaaatcgccgcgtgtgggaactgagcaaagcaaatagcaggtttgcaactacattttaccagcacctggccgacagtaagaacgataacgataacatcttcctgtcccccttgtccataagcacagctttcgcaatgacaaagttaggcgcttgcaacgacactctgcagcaattgatggaggtctttaagtttgacacgatctctgagaagacctccgaccagatccactttttcttcgctaagttaaattgtagactatataggaaggcaaacaagtccagtaaactggtaagcgctaatagattgttcggtgacaagagccttacgtttaatgatttgtatgtcagcgatgcattccacaaggcctttctcgaagtgaacgaggaggggtccgaagccgccgcctccactgccgtcgtaatcgccggtcgcagcctgaaccccaatcgagtgaccttcaaagctaatcgtccctttctcgtcttcatcagggaagttccactcaataccatcatcttcatgggaagagttgctaacccatgcgtaaaatag

SEQ ID NO: 2789 - DNA, 1395 bp, Artificial Sequence
  Description of Artificial Sequence: Synthetic coding sequence
atgtactctaacgtcatcggtacagttacgtctggtaaacggaaagtttatctactgtctctcctcctcattggcttctgggattgtgtgacctgccatggaagccctgtggatatctgtaccgctaaacccagagacattcccatgaaccccatgtgcatttaccggagccctgaaaaaaaggctacggaagatgaaggtagtgagcaaaaaattccagaggcaacaaatcgccgcgtatgggaactctctaaagcaaattctcgcttcgccaccactttttatcagcacctggcagattcaaaaaatgacaatgacaatattttcttgtccccgttgagcatttcaaccgcctttgccatgaccaagctgggcgcctgtaatgacactctgcaacagctcatggaggtatttaagttcgacaccattagcgaaaaaacgagcgatcaaattcacttcttctttgcaaaactgaactgtcgcttgtataggaaagcaaacaagtccagcaagctggtcagtgctaacaggctctttggagacaagagcctgacctttaatgaaacttaccaggacatatccgagttggtgtatggggcgaaattgcaacccctcgacttcaaggagaatgccgagcagagcagggccgctatcaacaagtgggtttccaataagacagaggggagaattactgatgtgataccttccgaggcgatcaatgaattaactgtgctggtcctcgtcaataccatatattttaagggactgtggaaaagcaagttttctcccgagaacacacgcaaggagttattctacaaggctgacggtgaatcttgctccgcgtcaatgatgtatcaggagggcaaatttcgatataggcgggttgctgaggggactcaggtactcgagctgcctttcaagggcgatgatattacgatggttctgatccttccaaagcccgagaagtccctggccaaggttgagaaagagctgactcccgaagtacttcaggaatggctcgatgagctggaagagatgatgctagttgtgcacatgccccggtttagaatcgaagacggcttctccctcaaagagcagctccaggatatggggctggttgatctcttcagcccagagaagtctaagctgccgggaatcgtggctgagggccgcgatgacctctatgtatcagacgctttccacaaggccttcctagaggtcaatgaagagggctcagaggctgctgcctctaccgctgtggtaattgctggaaggagcttgaaccccaaccgtgtgacgtttaaggccaaccgtccctttctcgtattcatccgcgaagtaccactcaacaccattattttcatggggcgtgtggccaatccctgtgtcaaatag

SEQ ID NO: 2790 - DNA, 1476 bp, Artificial Sequence
  Description of Artificial Sequence: Synthetic coding sequence
atggccctcctgtggggattgctcgtgctctcttggtcttgcctgcaggggccctgttctgtgttctctcccgtgagtgctatggagcctctggggaggcagctaacctcaggccccaaccaagagcaggtttctcccctgaccctactgaaactcggaaatcaggagcccggcggacagacagctctgaagtcccctcccggagtttgctcacgggaccccacacccgagcagacccataggctggcccgggcaatgatggcgttcacagccgacttattctcattggttgcccaaacgagcacttgcccgaacctcattctctctccgttgtctgtagcactggctctatctcaccttgcactcggcgcccaaaaccacacccttcagcgacttcagcaggtgctgcatgcggggtctggtccatgcctgccccacctgttgtctcgcctgtgtcaggacctgggtccaggggcgtttagactggcagctagaatgtacctccagaagggcttcccgatcaaagaagattttctggagcagagcgagcagctgttcggtgctaaacctgtgagtttgaccggcaaacaggaagatgaccttgctaatataaaccagtgggtgaaagaggctacagaaggaaagatccaggagttcctgagcggtctgcccgaggacactgtcctgctcctcctcaacgctattcatttccagggattttggcgtaacaaattcgacccgtcacttactcagagagactcattccacctggacgaacagtttacagtacctgttgaaatgatgcaggcacgaacctatccactgcgatggttccttctggagcagcccgagatccaggtagcccatttcccattcaagaataacatgtcctttgtcgtattagtgcccacccattttgagtggaatgtatctcaagtcctggcgaatttgagctgggacacccttcatccgccgctcgtctgggaacgtcctaccaaggtgcgactgcccaagctctatcttaaacatcaaatggatctggtggccaccttgtcacaactggggcttcaagaactttttcaggctcctgaccttcgaggaatcagcgaacagtccttggttgtgtcgggagtgcagcaccagagcaccctggagctttcagaagtcggagtcgaggccgccgcagcaacctccatcgcgatgagccgaatgtccctgtcctctttcagcgtgaatcgcccatttctgttcttcatctttgaagacacgactggcctccccctctttgtaggatctgtgaggaatcctaatcctagtgctcctagagagctgaaggagcagcaggactcccccgggaataaggatttcctgcagtccctgaaggggttcccccggggcgataagctgtttggccctgacctgaagctggtgccacctatggaagaagattatcctcagttcgggagcccaaagtag

SEQ ID NO: 2791 - DNA, 1476 bp, Artificial Sequence
  Description of Artificial Sequence: Synthetic coding sequence
atggctttactctggggcctccttgtgctaagctggtcctgcctacaggggccctgctctgtgttttccccagtgagtgccatggagccactgggaagacagctgactagcggcccgaatcaggagcaggtgtccccgcttaccctgttaaaactagggaaccaggagccaggcgggcaaaccgcgctgaagagtccaccaggagtatgttcgcgggatccaacccccgaacaaactcaccgcctggctagagcaatgatggcattcaccgcagatctattctcactggttgcacagacaagtacatgccccaatctgattttaagtcctctgagcgtcgcccttgccttgtcacatctcgccctgggagcacaaaatcatactctgcagagattacagcaagtcctgcatgcgggttcagggccatgtctgccacatctgctgagccgcttgtgccaagacttggggcccggagcatttaggttggccgccaggatgtatctgcaaaagggcttcccaatcaaggaggattttcttgaacagtcagaacagctgttcggggcaaaaccagtgtcgttgactggaaaacaggaagatgacttagctaacattaatcagtgggtcaaggaagccacggaggggaagatacaggagtttctctccggtcttcctgaggataccgtgcttctcttattgaacgcaattcacttccaggggttctggcgaaacaagtttgatccttccttaacacagagagatagttttcaccttgatgagcagtttaccgtgccagtagagatgatgcaggccaggacctaccccctgaggtggttcttgctcgagcaacctgagatccaggttgcccacttccctttcaagaataatatgtccttcgtggtgctggttcctactcatttcgagtggaatgttagccaggtgttagccaacttatcatgggacaccctgcacccccccctggtttgggaacgtcctaccaaggtccggctgcccaaattgtacttgaagcatcaaatggatctggtggccacacttagtcagctaggactgcaggaactctttcaggctccagacctgagaggcattagcgaacagagcctggtagtcagcggagtccagcaccagtcgacattagagctctctgaagtcggggtggaggccgccgctgccaccagcatcgcaatgtctcggatgagtctttcttcatttagcgttaataggccattcttgttcttcatcttcgaggacacaaccggactccccttgtttgtgggatccgttcggaatcctaatccgtctgcgccacgcgaactcaaagagcagcaggacagcccaggaaataaggattttctgcaatcccttaaaggtttccctagaggggataagctcttcgggccggacttgaaactcgtccctccaatggaggaggattatccccagtttggctctcctaaatag

SEQ ID NO: 2792 - DNA, 1284 bp, Artificial Sequence
  Description of Artificial Sequence: Synthetic coding sequence
atggcgctgctgtggggcctcctcgtcctgagttggtcctgcctacagggtccatgttcagtgttttcccccgtttcagccatggagcctttgggtcgacagctgacctcgggccctaatcaggaacaggtgtcgcctcttaccctcctcaagctagggaatcaggtgcagccaggcgctcagaaccacacactgcaacgcctgcagcaggtgcttcacgctggttctggaccgtgtctgcctcacctgctgtcacgcctctgtcaggacctgggcccaggcgcctttaggttggccgcgcggatgtacctgcagaaagggttcccaatcaaagaggatttcttggaacagtcagagcagctgtttggagccaagccggtatccttgaccggtaaacaggaggacgatttggcaaacatcaatcaatgggtgaaggaggctacagaaggcaaaatccaggagttcctgagtgggttgccggaggataccgtcctgctcctgttgaacgctattcacttccagggcttttggcgaaacaaattcgacccctctttgacccagcgcgatagctttcacctcgatgaacaatttacagtgccagtggaaatgatgcaggcgcgtacctacccccttcggtggtttttgctagaacaacccgaaatacaggtggcacattttcctttcaagaataatatgtcatttgtggttttagtgcctacgcattttgagtggaatgtgagccaggtgctggctaatttgtcttgggataccctacacccccctctggtgtgggaaagacctacaaaggtgagactgcctaagctgtatctcaaacaccagatggatctcgtcgccactctctcgcaacttggtctccaggagttatttcaggcacccgacctaagaggaatttctgagcagtcgttagtggtttctggcgtgcagcatcagagtaccctcgagctctcggaggtgggcgtagaggctgccgctgccactagtatcgcgatgagcagaatgtccttaagttcgttcagcgtgaacaggccgtttcttttcttcatttttgaggacacaacggggttaccgctgtttgtcggttcagtcaggaaccccaatccgtctgccccccgcgagctgaaagaacagcaggactcgccagggaataaggatttcctccagagtctgaagggatttccccggggggacaagctgttcggcccagacctgaaacttgtcccaccaatggaggaggattacccacagtttgggagccctaaatag

SEQ ID NO: 2793 - DNA, 768 bp, Artificial Sequence
  Description of Artificial Sequence: Synthetic coding sequence
atggcattgttatggggactgttggtcctgtcctggtcttgcctccaggggccgtgcagtgtattctcccccgtaagcgccatggagcccctgggtaggcagttgacttctggccctaaccaggagcaggtgtcccccctgaccttgctgaagctcggcaatcaggagcctgggggccagactgctttaaagtcccccccgggcgtgtgcagcagagatcccacaccagagcagacacatagattggcccgcgccatgatggcatttaccgctgatctcttctcacttgtcgcacagacatctacctgccctaacctgattttgtcccccttgtccgtggctctcgctctgtctcatttagcacttggcgcccagaaccatacactgcaacggctgcagcaggtactgcacgcagggagcgggccttgcctgcctcacttgctgagcaggctgtgccaggacctcggccccggcgcctttaggctggctgcgcgcatgtatctccagaagggattccccattaaagaagacttcttggagcaaagcgagcagttattcggagccaagcctgtgtctctgactgggaagcaggaagatgacctggcgaatatcaatcaatgggtcaaggaagccaccgagggcaagatccaggagttcttgagcggattaccagaggacacagttctactccttctcaacgcgatccatttccagggattctggagaaacaagtttgatccctctctcacacagagagactcattttag

SEQ ID NO: 2794 - DNA, 1503 bp, Artificial Sequence
  Description of Artificial Sequence: Synthetic coding sequence
atggcatctcgcttgactctgttgactttgctgctgctcctgcttgctggcgaccgtgcaagcagtaatccaaacgctacctcctcctcttcacaggaccccgaaagcctgcaagaccgcggcgaggggaaagtggctacaaccgtcatcagcaagatgctgtttgtggaacccatcttagaggtgagtagcctccccacaaccaactccacaaccaattcagcgacgaagataacagcaaataccactgatgagcctaccacgcaacctaccactgagcccacaacccagccaacgatacagcccacccagcccaccacacagctccctacagattcccccacgcaaccaaccaccggctccttttgtccaggccccgtaactttgtgctccgacctggagagccacagcaccgaagcagttctgggcgacgcgctggtggattttagcctgaaactgtaccacgccttctctgcaatgaagaaggttgagacgaatatggcattttcacccttctcgattgcctctcttctcacgcaggtgcttctgggcgccggtgaaaacactaagacaaacctagaatctatcctcagctacccaaaggatttcacgtgcgttcaccaagccttgaagggatttaccacaaaaggcgttactagcgtcagccagatcttccacagccccgatttggccattagagacacgtttgttaatgcttctcgtacgctctattccagttctccacgcgtcctctccaacaattctgatgcgaatttggagctgattaatacttgggttgccaagaacaccaataacaagatttcaagactgttggattccttgccatccgatacacggctggtcctcttgaacgcaatttacttgagtgccaaatggaaaactacatttgaccctaaaaaaacgcggatggaaccatttcactttaagaacagcgtgatcaaggtgcccatgatgaacagcaaaaagtaccccgtcgcccacttcatagaccagaccctgaaggccaaagtcggacagctccaactgtctcacaacctgtcactggtcatcttggttccccagaatctcaagcaccggctggaggacatggaacaggctttgagccctagtgtctttaaagccatcatggagaaactggagatgtccaagtttcaaccaacactcctcacacttcctagaatcaaagtcactacatcgcaggatatgctatccatcatggaaaaactggaatttttcgatttcagctacgaccttaacttatgcgggctcacagaggatcccgaccttcaagtgagcgcaatgcagcaccagaccgtactggagctcaccgaaaccggcgtggaagctgccgccgcttcagccatctccgtggcgcgcacccttcttgtgttcgaagtacagcagccattcttgttcgttctatgggaccagcagcacaagttccctgtgtttatggggcgagtgtacgaccccagagcctag

SEQ ID NO: 2795 - DNA, 1518 bp, Artificial Sequence
  Description of Artificial Sequence: Synthetic coding sequence
atggcctcaaggttaacattgttgaccctgctgcttctgctgctggcaggcttcttggaacctcaagatcgggcttccagtaatccaaacgctacctccagttcctcacaagatcccgagagcctccaggacaggggagagggaaaagtggccaccactgtgatcagtaagatgctgttcgtggagcctatactggaggtctcttctcttcccacaactaactccacaactaatagtgcaactaaaatcactgccaacactacagatgaacctacaacccagcctaccactgaacctaccacccagccaaccattcagcccacccagccaaccactcagttgccaacagactcccccacccaacctaccaccggctccttttgtcctgggccagtaactctttgttctgatctggagtcacatagcactgaggccgtgttaggcgatgcattagtggatttcagtcttaagctgtatcatgctttttctgctatgaagaaagtagaaactaacatggccttctcccctttctctatcgcttccctgctgacccaagtccttctgggagctggcgagaacactaaaaccaatctggaaagcatcctctcatacccgaaggattttacttgcgtacatcaggctttgaaaggctttactacgaagggtgtaacttccgtctcccagatatttcactcacccgatcttgctattcgggatacattcgtgaacgcatcccgcactctatacagttccagtccacgcgtgctgtcgaacaactctgatgctaatctggagctgatcaacacttgggttgcaaaaaataccaacaacaagatcagtcgtctacttgactcgcttcctagtgatacgcgcctggtcctcctcaatgcaatttacctgtccgcgaagtggaaaaccacattcgacccgaagaaaactaggatggaaccttttcatttcaagaactcggttatcaaggtcccaatgatgaattcaaaaaagtacccagtggcgcattttattgaccagaccttgaaagctaaggtgggtcagcttcaactgtcccataacctctcgctggtcatcctggtgcctcagaaccttaagcacagactggaagatatggaacaggcgctgagcccatcagtgtttaaggccattatggagaaactggagatgtccaagtttcagccgactctgctgacactgcccagaattaaggtgacgacctcgcaggacatgctaagtatcatggagaagctcgaattctttgactttagctatgatctaaatttgtgcggactgaccgaggaccctgacctccaggtctcggcaatgcagcatcagacggtactggagctaactgagaccggtgtagaagctgccgctgcaagtgccatcagtgtcgccaggaccctgctcgtgttcgaggttcaacagccctttttgttcgtgttgtgggatcaacagcataaattccctgtctttatgggaagggtttatgatccccgcgcgtag

SEQ ID NO: 2796 - DNA, 1347 bp, Artificial Sequence
  Description of Artificial Sequence: Synthetic coding sequence
atgttatttgtggagcccatcctggaggtgagttcactccctacaactaattctactacaaattcagccaccaagataactgccaataccactgacgaacctactacgcagcccaccacagaacctacaacacagcccactatacagccgactcaaccgacgacccagcttcctacagactcacccacacagcccacaaccggatccttctgtccagggccagttaccctgtgttctgacttagaaagtcactccaccgaagcagtgttaggcgatgcccttgtggacttctctctcaaactctaccatgcgttctctgcaatgaagaaagttgaaactaatatggctttctcaccctttagcatagccagcctgctgacacaggtgctgcttggggctggcgaaaatacaaagaccaacctagagtccattttgtcctacccgaaggattttacgtgcgtgcaccaggccttgaagggcttcaccacaaagggagtgacaagcgtgtcccaaatatttcactctcctgaccttgccattcgggacactttcgtaaatgcctccaggacgctgtacagttcgagtcccagggttttgtcaaataactctgatgctaacctggagttgataaatacctgggtcgctaaaaatacgaacaacaagatctcaaggctgctggacagcttgcctagtgacaccaggctggtccttctcaacgcaatctacctgagtgcgaagtggaaaacaacgtttgatcctaagaaaactcgcatggagcccttccacttcaaaaactcagtgatcaaggtgcctatgatgaacagtaaaaagtatcccgtggctcacttcatagaccaaactctgaaggccaaagttgggcagctgcagttatcccataatttgagcctggttatcctcgtgccacagaatcttaaacatagacttgaagatatggagcaggctttatcacccagtgttttcaaggctatcatggaaaagctggagatgtcaaagtttcagccaactttactgacactgcctcgtatcaaagttaccacgtcccaggacatgctctctatcatggagaagctagagttctttgacttcagttacgatctgaacttatgtgggctgaccgaggatcccgatctgcaagttagcgcaatgcagcaccaaacagttctggagctgaccgaaacgggcgtggaggcagcagcagcaagcgcaatatcagtggccagaaccctgctggtttttgaggtccagcagcccttcctttttgtcttgtgggaccaacagcacaagtttccagtgtttatggggcgcgtttacgaccctcgagcttag

SEQ ID NO: 2797 - DNA, 483 bp, Artificial Sequence
  Description of Artificial Sequence: Synthetic coding sequence
atggcctccaggttgacgctgctcacacttttactgctgctgcttgctggtgatagggctagcagtaatcctaatgccacaagctcaagctctcaggatccggagtcccttcaggaccgcggcgaaggcaaagttgcaacaaccgtgatctccaaaatgctgtttgtggaacctatactggaggtgagcagtctgcctacaaccaacagtactacgaatagcgccacaaaaattacagctaacaccacagacgaaccaaccacacagcccacaaccgaaccaactacacaaccaaccattcagcccacccagccgaccacccagttacctactgattccccgactcagcctacaacagggtctttctgccccggcccagtcacactatgctccgacctggagtcccactccactgaagccgtgcttggagatgcacttgtggacttttctctgaaactctatcatgctttcagcgcgatgtag

SEQ ID NO: 2798 - DNA, 402 bp, Artificial Sequence
  Description of Artificial Sequence: Synthetic coding sequence
atggcctcacgcttgaccctgctgacccttcttcttctgctgctcgctggggacagggcttcaagtaacccaaacgcgaccagtagtagttcccaggaccccgagagcctgcaggacagaggtgaagggaaagtggctactaccgtcatttctaagatgctcttcgtggagccaatcttagaggtgtcaagcctccccacaaccaacagcacgaccaattcagccacaaaaatcaccgctaacaccaccgacgaacccaccacccaaccaactactgaacccactacccagccaaccattcaaccaactcagccaactacacaactgcccaccgacagcccaacccagcctggatacgccctcaatcacggagagatcggcatcctgaggttctttctatag

SEQ ID NO: 2799 - DNA, 3405 bp, Artificial Sequence
  Description of Artificial Sequence: Synthetic coding sequence
atgccagtgtttcacacacggaccatcgaatccatcctggaacccgtggcacagcagattagccacctcgtcatcatgcatgaggaaggagaggttgacggaaaggccatccctgatctgactgcgcctgtggccgccgtgcaggccgcggtctctaatctcgttcgggttggcaaggaaaccgtgcagacaactgaggaccaaattctaaaacgggatatgccccctgctttcatcaaagtcgagaatgcctgtacaaagctggtgcaggccgctcagatgttgcagagcgacccgtactccgtgccggcaagggactatcttatcgacggctcccgcgggatcctgagcggcacctctgacctgctcctcactttcgacgaggccgaggtcaggaagattatcagagtgtgcaaaggaattttggaatacctcacagtggctgaagtggtggaaaccatggaggatctggtgacctacaccaaaaatctagggcccggcatgacaaagatggctaaaatgatcgacgagcgacagcaggagcttactcatcaggagcacagggtgatgctcgtcaatagcatgaacaccgtgaaagagctgttgcccgtcctgatttccgctatgaaaatttttgtgactaccaaaaactctaaaaatcagggcattgaagaagcactgaagaatcgaaattttaccgttgaaaagatgagcgcggaaatcaatgagataatcagggttctccaattgacaagctgggatgaagacgcatgggctagtaaagatacggaagccatgaagcgcgctcttgcctctattgatagtaaattaaatcaagctaagggttggctgagggacccatccgcgtcgccaggcgacgcaggggagcaggccatccgtcagattctggatgaagcgggaaaggttggggagctatgcgctggcaaggagcgccgcgagatcctgggcacttgcaagatgctgggtcaaatgaccgatcaagttgccgatttacgagccaggggccagggctcctctcccgtggccatgcagaaggcccaacaagtgtcacaagggctggacgttctcactgctaaggtcgaaaatgccgcccggaagttggaagccatgaccaatagtaagcaatcaattgctaagaaaattgacgcggcccaaaattggttagcggacccaaacgggggccccgaaggggaagaacagatcaggggagccttagctgaagcacgcaagatcgccgagctttgcgacgaccccaaagaacgggatgacatcttacgctcacttggagagatctccgcgctcacaagcaagctggccgatctgagaaggcagggtaaaggagattcccccgaggcccgagcattagcgaagcaggtcgcgactgccctccaaaacttgcagacaaagactaatagggccgtggcaaattccagaccagcgaaggccgcagtgcacctggaggggaaaatcgagcaagcacagaggtggatcgacaatcccacggtggatgaccgtggggtgggccaggcagccatccgcggtctggtagcagaaggtcaccggttagcaaatgtgatgatggggccataccgtcaggatctgttggctaagtgcgatagagtggaccaactgacagcacaacttgccgacctcgccgcccgtggagagggggagtccccacaggcccgcgctctggcaagccagctgcaggacagtctgaaagacctcaaggcccggatgcaagaggcgatgacacaagaagtaagcgatgtatttagtgatactaccacgccaatcaaactactcgcagtggcagcaacagcgccgcctgatgcccccaatcgggaagaagtctttgatgaacgggcggcaaactttgagaaccacagcggaaagctcggtgctaccgcagaaaaggccgctgctgtgggtaccgccaataagtcaactgtcgaagggatacaagcatcagtcaaaacagcccgagaattgaccccacaagtggtgtccgctgctcggattctgctcagaaaccctggtaaccaggcggcctacgagcatttcgaaactatgaagaaccaatggatcgataatgtggagaaaatgaccgggttggtggacgaagctatcgacacaaagagcttgctagacgcttctgaagaagcaatcaaaaaggatctggataaatgcaaagtcgctatggctaacattcagcctcaaatgctggtagctggggcgacttctatcgcaaggcgcgccaaccgcatcctacttgtcgccaaaagagaagtagaaaacagtgaagaccctaagtttcgcgaggctgtcaaagccgccagcgacgagctgtcgaaaaccatctcacctatggtgatggatgccaaagctgttgcgggaaacattagtgatcctggactccagaagtcttttctggattcgggataccgcatcctcggggctgtggcgaaggttcgcgaagcgtttcaacctcaggaacctgatttcccacccccaccgccggatctagagcagttgcgacttaccgacgagctggccccccctaaacctccccttcctgaaggggaagtgcctccaccaagaccgccgcctcccgaagagaaggacgaggagttcccagagcagaaagcaggtgaggttatcaatcagcccatgatgatggctgccagacagctacacgatgaagcacggaagtggagctcaaaacccggcatcccagcagcggaggtgggcattggagtagtggcggaggcagatgcggctgacgccgcaggatttcccgttcccccagacatggaagatgactacgagcctgagctgctgctcatgccatcaaatcagcccgtcaaccagccaatcctggccgctgcacagagccttcatcgggaggctacgaaatggtccagcaagggtaatgatataattgccgccgccaagcgcatggccttactgatggcagagatgtcacgactggtgagaggggggagcggcactaaacgagctttaatacagtgtgctaaggatattgctaaggcgtcggatgaagtgacaaggctcgccaaggaagtagccaagcagtgcaccgataagcgaatccgcacaaacctcctgcaggtgtgcgagcgaatcccaacaatatcaacgcagctgaaaattttgtctacagtgaaggcaacgatgttaggcaggacaaatatctccgacgaagagtctgaacaggcaacagaaatgctggttcacaatgcccagaatcttatgcagagtgtgaaagaaactgtcagggaggccgaggctgcctcgatcaagattcggaccgacgctggctttacgctccggtgggtccggaaaactccttggtatcagtag

SEQ ID NO: 2800 - DNA, 1335 bp, Artificial Sequence
  Description of Artificial Sequence: Synthetic coding sequence
atgtgtctgtgctctggccgcaagaccattctggaaatttaccccggacagtttcagccgtccctgtgtcacaaatttatcgccctgtccgacaaggagggtaaactgctgaggaattatacgcagaacatcgatacactcgagcaggtcgcgggcatccaacgcataatccagtgccacggaagcttcgcaaccgccagctgtctcatatgcaaatacaaggtcgattgcgaagctgttagaggtgatatattcaatcaggtggtgccacggtgccccagatgcccagcagacgagccactagctattatgaaaccggagattgtcttttttggcgagaatttgccagaacagttccaccgagccatgaaatatgacaaagatgaagtcgatctgctgatcgttattggcagtagtctcaaagttagacctgtggcattgataccatctagtattccacacgaggtgccccaaatactcattaacagagaaccccttccccatctccacttcgacgttgagttgcttggggactgcgacgtaatcattaatgagctgtgtcacagactggggggggagtatgcaaagctgtgttgcaatcctgtgaagctgagcgaaattaccgaaaagcccccccgcacccagaaagagcttgcatacctcagcgagctccctcctacacccctccacgtttccgaggacagctccagccccgagaggaccagcccacctgattcttcagtgattgtcacgcttttggatcaggctgctaagtcaaacgatgacctggatgtgtctgagtccaaaggttgcatggaggagaagcctcaagaggtgcagacgagcaggaacgtggaatccattgcagagcagatggagaaccctgatcttaaaaacgtgggtagttccacgggggagaagaacgagagaacttccgttgccggcaccgtgcgtaagtgctggccgaatcgcgttgcaaaagagcagatttctcgcagactcgatggaaaccagtacctgttcctgcccccaaatcgctacattttccacggggccgaagtgtattctgacagcgaagacgacgtactttcatcaagttcctgtggcagcaatagcgactccggaacctgccagagcccaagcctggaggagccaatggaggatgaatccgagattgaggagttttataatgggctggaggacgagcccgatgtgcccgaacgagccggaggagccggtttcgggaccgatggggacgaccaggaagccatcaacgaggcaatctccgttaagcaggaagtcaccgacatgaattacccctccaacaagtcctag

SEQ ID NO: 2801 - DNA, 1335 bp, Artificial Sequence
  Description of Artificial Sequence: Synthetic coding sequence
atgtgcctctgctcaggcaggaagacaattctcgaaatctaccctggacagttccaaccttcgctctgccataagtttattgctttgtctgacaaggaggggaaactcctcagaaattacacacagaacatagataccctggagcaggtcgctggcatccagcggataattcagtgccatggatcattcgcaactgcaagttgcctgatctgcaaatacaaagtggattgcgaggcagtgcgcggggacattttcaaccaagtcgtgccgagatgtcctcgctgtcctgcagatgagccactggctattatgaagcctgagattgtcttttttggcgagaatcttcccgagcagtttcaccgagccatgaaatacgataaagatgaagtcgacctactgatagtgatcgggtcctctcttaaggttaggccagtggcattgatcccttctagtatcccacacgaggtcccacaaatcttaatcaatcgggagcccctcccccatttgcactttgatgtggagctactgggggattgcgatgtcattattaacgagctgtgccatagactgggtggtgaatacgctaagttgtgttgcaatcctgtgaaactcagtgagatcacggagaaaccccctaggacacagaaagagctggcgtatttgagcgaactgccacctactcccctccatgtaagtgaggattcgtccagccccgagcgtacgagcccccccgattcctctgtcatcgtcacactgcttgaccaggctgctaaaagcaacgatgacctggatgtctccgaatctaagggctgcatggaagaaaagccccaagaagttcaaacctcccgtaatgtggagtccattgccgaacagatggagaaccccgatctcaaaaatgttggatcatccacgggggaaaaaaacgagagaacatctgtggccgggacagtacgaaaatgctggcctaaccgagtggcaaaggaacaaattagcagaagattggacgggaaccaatacctcttcttgcctccaaacagatacatctttcacggcgccgaggtttactctgactcggaggacgacgtcctgagctcctcaagttgcgggtccaattctgattctggcacatgtcaatctccttcgcttgaggagcctatggaggatgagtctgaaattgaggaattttacaatggcttagaggatgaaccggacgtgcccgagcgagctggcggagccggattcggtacagacggagatgaccaggaagcgataaacgaggccatttccgttaagcaggaggttactgacatgaattacccttcgaacaagtcatag

SEQ ID NO: 2802 - DNA, 1359 bp, Artificial Sequence
  Description of Artificial Sequence: Synthetic coding sequence
atgtttgatatagagtatttcagaaaagatccaagacctttcttcaagttcgcaaaagagatctaccctgggcagtttcagccctctctctgccacaaattcatcgcactctctgacaaggaaggcaaactcctgagaaactacactcagaatattgacacactggaacaagtggcaggtatccagagaattatccaatgtcacggtagtttcgcaacagctagttgtctaatctgcaagtacaaggtggactgtgaagccgtaaggggagacatctttaatcaggtcgtccctaggtgcccgaggtgccccgcagatgagccgctggccataatgaaaccggaaattgtgttttttggcgagaaccttcctgaacagtttcaccgtgccatgaagtacgacaaggacgaggtggatttgctgattgttatcggctccagccttaaagtacgtccagtggctctgatcccatcctctatccctcatgaagtgccccagatactcattaacagggagcccctccctcatctccattttgacgtggaactcctcggtgactgtgatgtcattataaacgaactgtgtcacagactgggaggtgagtacgcgaagctgtgctgtaacccagtcaaattgtccgaaatcaccgagaagccaccgagaactcagaaggaattagcatatctgtccgagctccccccgacacccttgcacgtttccgaggactcatcaagccccgaacgaactagtccgcctgactcgagtgtgatagtcactctactggatcaggccgctaaatcgaatgacgacctcgatgtgagcgagtcgaaaggttgtatggaggagaagccacaggaagtacagacatcacggaatgttgagagcattgcagagcagatggagaatccggaccttaaaaatgtgggatcctcaacaggcgagaaaaacgagcggacctccgtggctggaactgttcggaagtgttggcctaatcgcgttgctaaggagcagatatcccgtaggctggatgggaaccagtatctgtttctgccaccgaaccgatacatcttccatggggccgaagtttactctgactctgaagacgatgtcctcagtagttcctcctgtggaagcaattcagattcggggacatgccagagtccctcgctggaggagcccatggaggacgagagcgagattgaggaattctacaatggtctggaggatgagccagacgtccccgagcgggccgggggcgcaggtttcgggaccgatggcgacgatcaggaggccatcaacgaggctatctccgtgaagcaggaagtgaccgacatgaactatccaagcaataagagttag

SEQ ID NO: 2803 - DNA, 987 bp, Artificial Sequence
  Description of Artificial Sequence: Synthetic coding sequence
atgtcagtgaactatgctgcaggactgagcccttatgcagataagggtaaatgcgggttacctgaaatttttgatccacccgaagaactggaacggaaggtgtgggagcttgcgaggttagtgtggcagtcttcttctgtggtctttcacaccggggctggaatctctactgcctccggaatacctgactttagaggcccccatggcgtctggacaatggaggaaaggggtctggcgcccaagttcgatactactttcgaaagcgctcggcccacgcagacacacatggccctggtgcaattggagcgggttggactgcttagatttctggtttcccaaaatgtggatggtttgcacgtgaggtctggtttccccagggataaactggccgagcttcatggtaatatgtttgtggaggagtgcgccaaatgtaagactcagtacgtgcgagatacagtggtgggcactatgggcctgaaagcaactggacgcttgtgtactgtcgccaaagcccggggccttagggcctgccgcaacgcagaccttagcataacgctggggacatctctgcagataagaccctctggcaacttaccgcttgccacaaaaagaagaggaggaagacttgtgattgttaatctccagcctacaaagcacgaccggcacgccgatctccgcattcatggatacgtcgacgaggtgatgacgagactcatgaagcacctggggttggaaatacccgcctgggatggtccaagggttctcgaaagggccctaccgccattaccacgcccgcccacgccaaagctcgagcccaaagaggagtctcccacgcggattaatggctctattcctgccggacctaagcaggaaccttgtgcacagcacaatggtagcgaacccgcttccccaaagcgcgagagacctacttcccccgccccacatcgcccacccaaaagggttaaggctaaagccgttcccagctag

SEQ ID NO: 2804 - DNA, 1068 bp, Artificial Sequence
  Description of Artificial Sequence: Synthetic coding sequence
atgtctgtcaactacgcggctggtctgtcaccatacgctgataagggaaagtgcggactgccagaaattttcgacccacccgaggagctcgaacgcaaggtatgggaattggctagacttgtgtggcaaagcagcagcgtggtctttcacactggggctgggatcagcacagcgtcaggaatccctgatttccgaggacctcatggcgtatggactatggaggagcgcggactagctcccaagttcgacacgacttttgagagtgcaagaccaacccagacacacatggcattggtacagttagagcgagtgggactacttcggttccttgtttctcagaacgtcgacggactccacgtacgaagcgggttcccccgagacaagctggccgaactccacggaaacatgttcgtcgaagaatgcgccaaatgtaagacccaatacgtccgggatacggttgtgggtacaatgggattaaaagccaccggtagactgtgtaccgtggcgaaagcccgggggctcagggcatgtaggggggaacttcgggataccattctagattgggaagactctctgcctgacagggacctcgccctggctgacgaagcaagcagaaatgcagacctgagtattacactcgggacttcactgcaaattaggccgtccggcaatcttcctctagccacaaaacgaagaggcggtaggcttgtgattgtgaatctccaacccacaaagcacgaccggcacgcagacctgcggatacacggctacgtggacgaagttatgacacggctgatgaagcacctaggactcgagattccggcttgggacggccccagggtgctagaaagagcccttccccccctaccgcggccccccacaccgaagctagaacccaaagaggagagccccacccgaattaacggatctatccccgcaggtccaaaacaggagccatgtgcacagcacaatgggtctgagccagcctcaccaaagcgggagcggccgacctcacccgctccccaccggcctccaaaacgcgtaaaggcgaaggctgtacccagctag

SEQ ID NO: 2805 - DNA, 852 bp, Artificial Sequence
  Description of Artificial Sequence: Synthetic coding sequence
atggaagaaagaggcctggcccctaagttcgacaccacattcgaaagcgcccgcccaacacaaacccatatggcactcgtccagctcgaaagggtagggctcttgcgattcctcgtctctcagaacgtagacgggctacatgtgcgaagtggattccctagagataagctggccgaactccacggaaatatgttcgtcgaagagtgtgccaaatgcaagacgcagtacgtcagggacacagtagtgggaacgatggggctgaaggccactggaaggctctgtaccgttgcgaaggccaggggcctgagagcatgtcgaggagagctgagggatactattctggattgggaggacagcttgcctgaccgcgatctcgccctggcagacgaagcaagccgtaatgccgacctgtccatcacactggggacctctctgcaaatcagacccagcgggaatctccccctggccaccaagcgacgcggggggagactggtcattgtgaatcttcagcctactaaacatgatagacacgccgatctgcgcattcatggatatgtggatgaagtgatgactcgcctgatgaagcatctaggcctcgagattcccgcgtgggacggtccccgggtcttggaaagagcactgccccctctgcctcggccacctacccctaagctggagccaaaagaagaatctcccactagaatcaacgggagcatccctgccggacctaaacaagagccatgcgcacagcacaatggctctgagcccgcttccccaaaaagggagaggcccacttcacccgctccacaccgtcctccaaagagggtgaaagctaaggcggtgcctagctag

SEQ ID NO: 2806 - DNA, 1575 bp, Artificial Sequence
  Description of Artificial Sequence: Synthetic coding sequence
atgactgaggataaggtcactggaacactggtgttcaccgtgatcacagctgtgctgggaagtttccagttcggctacgacattggtgtcattaacgcccctcagcaggtgatcatttcccactaccgccatgtgctcggagtaccactggacgaccggaaagcaatcaacaactatgtcattaactctaccgacgagctaccgaccatctcttattctatgaatcccaaaccaacaccttgggctgaggaagagactgtggccgccgcacagttgattacaatgctctggagtttaagtgtgagcagcttcgctgtgggcggaatgacggcctcctttttcggcgggtggctgggcgatacacttggtcggattaaagccatgctggtcgccaacattttaagcctagtgggagctctgcttatggggttttctaagctgggaccctcccatatcctgatcattgcaggaaggtctatatccgggttgtattgcggcctgatttccggcctggttccaatgtacattggtgaaatagccccaactgctctgcgtggcgccttgggaaccttccaccagctggccattgtcaccggaatactcatttcccagattatcggtctggaattcatcctggggaattatgatctttggcacatcctactcggcttatccggagtcagagccattctgcagtccctgcttttgttcttctgtccagagtcccctcgctacttgtatatcaagcttgatgaggaggtcaaggccaaacaatctctaaagaggctgcgcggatatgatgatgtgacaaaagatatcaatgagatgcgaaaagagcgtgaggaagcctctagcgagcaaaaagtcagtattattcagctctttacgaactcctcataccgtcaacccattttagtcgccctaatgttacatgtcgcccagcagttttcaggcattaacgggattttttactattcaacgtccatcttccagactgcggggatctccaagcctgtttacgctaccatcggggtgggagcggtaaacatggtttttactgcggtctcagtgtttctcgtagaaaaggccggtcggcgttctctgttcctcattggaatgtccggcatgttcgtgtgtgctatcttcatgtcggtgggtctggttctgctgaataagtttagctggatgagctacgtctcaatgatagccatctttctgtttgtaagcttctttgagattggccccggtcctataccatggtttatggtggccgagttttttagccagggcccacggcctgcagccctggctattgccgccttctccaactggacatgcaacttcatagtggcattgtgttttcagtacatcgccgatttctgcggaccgtacgtcttcttcctgtttgctggcgtgctcttggccttcaccctgttcacgttcttcaaagtgcccgaaactaaaggtaagagcttcgaggagatcgctgctgagttccagaagaaatccggttcagctcataggccaaaggcagccgtggagatgaagtttctgggagctacagagactgtgtag

SEQ ID NO: 2807 - DNA, 1218 bp, Artificial Sequence
  Description of Artificial Sequence: Synthetic coding sequence
atgcacctcaatcggatcaaggccatgctcgtcgccaatattctgagcctcgtgggtgccctactcatggggttttccaaactggggcctagccacatcctcattattgcaggccgctcaatttccggactctattgcggattgatttctggacttgtcccgatgtatatcggtgaaatcgctcccacagcattacgaggtgctctcggtaccttccatcagctggccatcgtaaccggaatcttgatcagccaaattatcggtttagagttcatcctgggaaactatgacctttggcacattctgctggggttgagtggggttagagctatcctgcaaagtttactgctcttcttttgtcccgaatcccccaggtatctgtacataaagctggacgaagaggtgaaggctaaacagtcactgaagcggctcaggggctatgatgacgttaccaaggatatcaatgagatgcggaaggagagagaagaagcatcatctgagcagaaggtgagcatcatccagttattcactaactcaagttaccgacaaccaatcctggtggcactgatgctccacgtcgcgcaacagttctcagggattaacggtattttctattacagtaccagcatattccagactgccggtatctccaaaccagtgtacgccaccattggtgtcggcgcagtgaatatggtgtttacggccgtgagcgttttcttggtggaaaaggccgggcgtcgatccctcttcttaatcggaatgtccggtatgttcgtttgcgccatattcatgtctgtgggactggtcctgctgaataagtttagttggatgtcatacgtatctatgattgctatctttttatttgtgtcgtttttcgaaatcggccccggacctataccctggtttatggtcgccgaattcttcagccaaggacctagacccgcggcgctcgcaatagccgccttcagtaactggacgtgcaacttcattgtggctctgtgctttcagtacatcgctgatttctgtggaccttacgtgttcttcctgttcgccggcgtgctgctcgctttcacacttttcacatttttcaaagtgcccgagactaaagggaaatcattcgaggagatcgccgccgagtttcagaagaaatccggttctgcacatcggcctaaggctgccgtcgaaatgaaattcctcggcgctacggaaacagtgtag

SEQ ID NO: 2808 - DNA, 1290 bp, Artificial Sequence
  Description of Artificial Sequence: Synthetic coding sequence
atggcggcccaaggctacggttactacagaactgtaatattctctgccatgttcggcggctacagcctgtattacttcaacaggaaaaccttttcatttgtcatgccttcgctggtggaggagatccccctagacaaagatgatctcggctttattacatccagccaatcagcagcatacgcgattagcaaattcgtcagcggagtattgtcagatcagatgagtgccaggtggctgttctcctctggactgctgttggtgggcctagtgaacatctttttcgcttggtcatccaccgttccagtcttcgcagctctttggtttttaaatggactggcccaaggactgggttggccaccctgtgggaaggtactgcggaaatggttcgaaccatctcagttcgggacctggtgggccatcctctctacgagtatgaacctggccgggggcctaggacctatactggccactattttggcccagagctactcctggcggtccacgttggctttgtcaggggcgttatgcgtggtcgtgtctttcctgtgcctgctgttgatccacaacgagccagcggacgttggccttagaaacctggatccgatgccatccgagggcaaaaaggggtccctgaaggaggagagcacacttcaagagctgctgctgtctccatatttgtgggtgctctcaacaggttacctggtcgtgtttggagtgaagacgtgctgcacagactgggggcagttcttcctgatccaggagaaagggcagtctgcactagtgggatctagttacatgagcgctctggaagtgggcggcctggtggggtccatcgccgcaggatacctgtccgaccgcgccatggccaaggccggtctctccaactatggaaatcccaggcacggcctgctcctgtttatgatggccgggatgaccgtgagcatgtatctgtttcgtgtgaccgtcacatcagactcaccgaagctgtggatattggtcttgggagcggtattcggcttctctagctacggacccatcgctttattcggcgtgatagctaacgagagcgcccctcccaatctctgcggaacgtcacatgccatcgtagggctgatggccaatgtggggggattcctggctgggttgccgttttccacaatcgcaaagcactattcttggagtactgcgttctgggtagcagaagttatttgcgcagcgtcgactgccgcttttttcttgctgaggaacataagaaccaagatgggcagggtctctaaaaaggctgagtag

SEQ ID NO: 2809 - DNA, 1356 bp, Artificial Sequence
  Description of Artificial Sequence: Synthetic coding sequence
atggccgctcagggttacggctattaccgcaccgtgatcttttctgccatgtttggcgggtattctctgtactatttcaaccgtaagacattcagtttcgtgatgcccagtcttgtggaggagatcccactggacaaggacgatctgggattcatcaccagttctcagagcgctgcttacgccatttccaaattcgtgtctggtgtcttgagcgatcaaatgtccgccagatggctgttctcatcaggcctgctcctggttgggctggtgaatatcttttttgcctggagctctaccgtcccagtgtttgctgcgctgtggttcctcaacggactcgcgcagggcctgggctggcccccgtgtggcaaagtcctgcgtaaatggttcgaacctagccagtttggcacatggtgggccatcctctctacatctatgaatctcgccggcggcctgggccctattttggccacaatcctggcccaaagctattcctggcgctccactttggccctttccggggcactctgcgtggttgtgtccttcctgtgcctgctcttgattcacaacgaaccagccgacgttggtttgcgaaatctggatcccatgcccagtgaaggtaaaaagggatccctaaaagaggagtcaaccttgcaggaattactactgagcccctacctatgggtactgtcaacaggatatctggtcgtgtttggggtcaagacctgttgtactgattggggacagttctttctgattcaggagaagggtcagtccgctctggtgggttctagttacatgtccgcattggaagttggtggactggtcggaagcatagccgctggatatctcagcgaccgggccatggctaaagccggtctgagcaactatggcaatccccgccatggcctgttgctatttatgatggcaggcatgaccgtgagcatgtacctgttccgcgtgaccgtcaccagcgactctcctaaggatgtagcgttctggacccttgcgcttcacccactggccgaactgacagggtttactgaacatgaactctggattctggtccttggcgcagtctttgggttcagtagctatgggccaatcgctctgttcggagtcatcgccaacgaaagcgctcctccaaacctctgcgggaccagccatgccatcgtgggattgatggccaacgttgggggctttctagctggattgcctttttccaccatcgcaaagcattactcctggagcactgctttctgggtggcagaggtgatatgtgctgctagtacagctgctttttttctgctccggaacatcagaacaaagatggggagagtctctaaaaaggccgagtag

SEQ ID NO: 2810 - DNA, 1716 bp, Artificial Sequence
  Description of Artificial Sequence: Synthetic coding sequence
atgacccgggccggggaccacaaccgacaacgtggttgctgcggcagtcttgcagattatctcacttctgctaagttcctcctgtatctaggtcactccctctccacttggggcgaccgcatgtggcatttcgccgtctccgtgttcctggtcgaactctacggcaacagcctgcttctgaccgcagtatacggcctcgtagtggccggtagcgtgctggtcctcggcgcaatcatcggggactgggtggacaagaatgcaagactgaaagtggcacagacaagccttgtggtccagaacgtctctgtcatcctatgtggtatcattctaatgatggtgttcttgcataagcatgaactgttaaccatgtatcatgggtgggttctgacatcttgttacattctgataataacgattgccaatatcgccaatttggcttccaccgcgacagccatcaccattcagcgcgactggattgtggtcgtcgcaggcgaggacaggagcaagctggcaaatatgaatgccaccatccgaagaatcgaccaattaaccaatatactggcacccatggccgtagggcagatcatgaccttcggctcaccggtgatcggttgcggtttcattagcggctggaatctggtgagtatgtgtgttgaatacgtcctgctgtggaaggtgtaccagaaaacgcctgccctggctgtcaaagcagggcttaaggaggaagaaacagaacttaaacagctgaatttacataaagataccgaaccgaaacccctggagggaacgcatctcatgggcgttaaagattcaaatatccacgagctcgagcatgagcaagagccgacatgtgctagccaaatggccgagccattccgcaccttccgggatggctgggttagttattacaatcaaccagtttttctggctgggatgggcctcgcatttctgtatatgaccgtactgggcttcgattgcatcaccactggctatgcctacactcagggcctgagcggctcaattctttctatcctaatgggggcttccgcaattaccggcatcatgggtacggtcgcatttacttggctgcgtcgcaagtgcggtctggtgaggactggcctcatctccggcctagctcagctctcctgtctcatcctctgtgtaatcagcgtttttatgccgggttcccctctggatctgagcgtcagccctttcgaggacatcagaagtcgattcattcaaggggaatccatcacacccaccaaaattccagaaatcacaaccgagatttacatgtctaatgggagtaatagcgcaaatatagttccagaaacctcacctgaaagcgtccccatcatttctgttagcctgctgtttgctggtgtaatcgctgcacgcatcggcctgtggtcattcgacttaaccgtcacacagttgttgcaggagaacgtcatagagtccgagcgaggtattataaacggcgtacagaacagcatgaactacctactggatctccttcacttcattatggttatcttagctcctaacccagaggccttcgggctgcttgtccttatatctgtgtcctttgtagccatgggccacatcatgtacttccgatttgctcaaaacactttgggcaacaagctgttcgcctgtgggccagatgcaaaggaagtgcgaaaggagaatcaagccaacacatctgtcgtatag

SEQ ID NO: 2811 - DNA, 603 bp, Artificial Sequence
  Description of Artificial Sequence: Synthetic coding sequence
atgaccagagccggggaccacaatcgtcagagggggtgttgtgggtcactcgcggactacttaacaagcgccaaattcttattgtatttagggcattcgctttctacatggggcgacagaatgtggcactttgcagtctctgtctttctggttgagctgtatggcaacagtctccttctcaccgcggtgtatggtctggtggtcgccgggtctgtgctagtcctcggagcaattattggcgactgggttgacaagaacgccaggctgaaagttgcccagacgagcctggtagtacaaaacgtcagcgtaatactctgtggtatcatcctgatgatggtgttcctccacaagcacgaactgctgaccatgtatcacggatgggtgctgacctcctgttacatccttataatcaccattgctaacatcgccaacctcgcaagtactgccaccgcgattacaattcagcgagattggatcgtcgtggtggcgggggaggaccgaagcaaactcgccaatatgaacgccacgatccgacgaatcgaccagttgacaaacatcctcgcccctatggctgttggccaaatcatgactttcgggtcttag

SEQ ID NO: 2812 - DNA, 78 bp, Artificial Sequence
  Description of Artificial Sequence: Synthetic coding sequence
atgaccagggccggcgaccacaaccgccagcgcggctgctgcggcagtctcgctgactaccttacttcagccaaatag

SEQ ID NO: 2813 - DNA, 78 bp, Artificial Sequence
  Description of Artificial Sequence: Synthetic coding sequence
atgaccagagctggggaccataatcgccagcgggggtgctgcggaagtctggccgactatttgacctccgctaagtag

SEQ ID NO: 2814 - DNA, 168 bp, Artificial Sequence
  Description of Artificial Sequence: Synthetic coding sequence
atgacccgggcaggagatcacaacagacaacggggttgttgcggaagcttggcagattacctaacatccgccaagtttctgctgtacctgggacactcactgtcaacctggggcgacaggatgtggcactttgccgtgagcgtattcctggtggagctgtacggatag

SEQ ID NO: 2815 - DNA, 300 bp, Artificial Sequence
  Description of Artificial Sequence: Synthetic coding sequence
atgcgagcctcgattcacaaaaaacttagaaaatctagcggaatcgttacgatcttgtatagcgcttttgtcctcgtcagcacatccgatatggctgaggaaacagaggacgcctggcctcgctgctatttgcagtttctggccttgctgttgacaagcacctccgctagggccgcggcagcgatcgcggccgctgaggaacctgccggttctccttcggtaatgacccgcgctggcgatcacaaccggcagcgcggctgttgcggatctctcgccgattacctgacctctgctaagtag

SEQ ID NO: 2816 - DNA, 504 bp, Artificial Sequence
  Description of Artificial Sequence: Synthetic coding sequence
atgggcgtgaaggattcaaatatccacgagcttgaacatgagcaggaacccacatgcgctagccagatggccgagccttttagaaccttcagagatggctgggtgagctattacaaccagccagttttccttgctggtatggggctcgcattcctttacatgacggtgctggggttcgattgtataacaacaggatacgcttatacacaaggcctgtcaggttcaatactctcaattctgatgggcgccagtgccattaccggtattatgggcacagtggcttttacatggcttcgacgcaagtgtgggctggtgagaaccggattaatctccggtttagctcaactgagctgtttgattttgtgtgttatatccgtgtttatgcccggctcccccttagacctgtctgtgtcaccatttgaggatattcgctcacggtttatacagggcgaatcaattacccccactaagattccggagatcaccaccgaaatccacgtgtag

SEQ ID NO: 2817 - DNA, 2496 bp, Artificial Sequence
  Description of Artificial Sequence: Synthetic coding sequence
atggagagaccctggggtgccgcggacggtctgtctaggtggcctcacgggctgggtctactcctactcctacagctgctcccaccgtctacactcagccaggatcgccttgatgcccccccaccaccagccgcacccttacccagatggagcgggcctattggggtctcatgggggctaagagctgcagctgcgggaggggccttccctcgcggcggccggtggaggcgaagcgcccctggggaagatgaggagtgtgggagggtcagagacttcgtcgccaaactggctaacaacacacaccagcacgtgtttgacgatcttagaggttccgtaagcttgagctgggttggtgattctactggcgtgattctggtgctcactacctttcacgtgccactggttattatgactttcggccagtcaaagctgtacagatccgaagattatggcaaaaacttcaaagacattacagacctgatcaacaatacctttatcagaactgagttcgggatggctatagggcctgaaaattctggcaaagtggttctgaccgccgaagtctctggcgggagcagggggggcagaatcttcagaagctcagattttgccaagaatttcgtacagaccgatctgccttttcaccctctcactcagatgatgtactcaccccagaacagcgactacctgctggccttatcaaccgagaatgggctctgggttagcaagaattttggcggaaaatgggaagaaattcacaaggcagtatgcctggcgaagtggggttccgacaatactatcttctttacgacctacgccaacgggtcctgcaaggcagacttgggagcactcgagctttggaggacttcagacttaggtaaaagcttcaaaactatcggggtgaagatttactcctttggcctgggtggcagattccttttcgcctccgttatggctgacaaggacacaacacggcggattcacgtctccaccgatcagggggatacttggtctatggcccagctgccctccgtgggacaagaacagttctacagtattctagccgccaacgacgatatggtgttcatgcatgtggatgagcctggggacactggtttcggcaccatttttacgagcgacgacagggggattgtttattccaagagtctggataggcacctttacaccactacgggaggagaaacagacttcacgaatgtcacttcacttaggggagtttacataactagcgtcttaagcgaagacaactccatacagaccatgattaccttcgaccaggggggccgttggacacacctgcgtaaacccgagaacagtgaatgtgacgctaccgcgaaaaacaaaaatgaatgcagtcttcacattcatgcaagttattcaatatcccagaagcttaatgtccctatggctcctctgagtgagcctaacgcagttggaatcgtgatcgcccacggctcagttggggacgctatcagcgttatggtccctgacgtctatatctccgacgatggcggatatagctggacaaagatgctggaggggcctcattattacacgattctggacagtggtggcatcattgtggccatcgagcacagctcccgtcccatcaatgtaattaaattcagtacagatgagggacagtgttggcagacatacaccttcactcgcgatccgatctattttacaggcctagccagcgagcccggggccaggagcatgaatatttccatatggggcttcactgaaagcttcctcacaagccaatgggtgagctatacaatcgactttaaagacatcttggagcggaattgtgaagagaaagattacacaatatggctggcccactcgaccgatcccgaggattatgaggacggttgtatactgggttataaggaacagtttctcagactgaggaagtccagcgtttgtcagaatggacgggactacgtggtcaccaaacagccaagtatctgcctatgctctctcgaagactttctttgcgacttcggctattataggccagagaatgattccaaatgcgtggaacagccggagctcaaaggccacgaccttgaattctgcctgtacggccgcgaagaacatctcaccactaatggataccggaaaattcctggagacaagtgtcagggtggcgtgaaccctgtccgggaggtcaaagatctgaagaaaaaatgtacctctaactttctgtcccctgaaaagcaaaatagtaagtccaacagcgttcccattattttagcgattgtggggctgatgctcgtgacggttgtcgcgggggtattaattgtgaaaaagtacgtgtgcggtgggcggttcctggtgcataggtacagtgttttgcagcagcacgctgaggccaatggggtggatggagtggacgcactcgatactgcatcccatacaaacaagagcgggtatcacgacgattctgatgaggacctgttggaatag

SEQ ID NO: 2818 - DNA, 2085 bp, Artificial Sequence
  Description of Artificial Sequence: Synthetic coding sequence
atgacatttggtcagagcaagctctataggagtgaagactacggcaagaacttcaaagacatcacagacctcattaataatacattcattaggaccgaatttggaatggcaatcggccctgagaactccggcaaggtcgtcctcaccgcagaggtttctggcggctctagaggaggtaggatattccgcagctctgactttgctaagaacttcgtgcagactgatctgccctttcacccactaacacaaatgatgtacagtccgcaaaatagcgattatctgctggcattgtccaccgagaacgggctctgggtatctaagaattttggcggaaagtgggaggaaatccacaaagccgtgtgtctcgccaagtggggaagcgacaacacgattttttttacaacatatgctaacggcagctgcaccgatctgggagctttggaactatggcgtacaagcgacctcggtaaaagtttcaagactatcggagtaaaaatttactcctttggtctgggaggacggtttctcttcgcctcagtgatggcagataaagatacaacccgtagaatccatgttagtaccgaccagggagatacatggtccatggctcagctgcccagcgtaggacaggaacagttctacagtatcctggcagccaatgacgacatggtcttcatgcacgtggatgaacctggtgataccggcttcgggacaattttcaccagcgacgaccggggtatcgtctactctaaatccttggatcgtcatctctacacaaccaccggcggggagacggattttactaacgtgacaagcctacggggtgtatatataacctcagtgttatcggaggataactctatccagactatgatcacgtttgaccagggaggccgctggactcatcttcgaaagcccgaaaactcggagtgtgatgccacagcaaagaacaaaaatgaatgttcgctccacattcacgcttcgtattccatctcccagaaactaaacgttcccatggctcctttgtcagagccgaacgcggtgggaatcgtcatcgcacatggttctgtgggcgacgcaatttccgtgatggttcctgatgtttacattagcgacgacggtggctacagctggacgaaaatgctggaggggccccactattatacaattctggattctgggggtattatcgtcgccattgagcattcgtcacgaccaataaacgtcataaagttctccactgacgaaggccaatgctggcaaacctatacctttactcgagacccaatttattttactggcttagcgtcagagcctggtgcacggtctatgaatatttccatctggggattcaccgagtctttcctcaccagtcagtgggtgagctacaccatagactttaaggacattctggaacgaaattgcgaggagaaagactataccatctggttagcccattcaaccgaccccgaagactacgaagacggttgcatcctcggatataaggagcagtttctaaggctgcgtaaaagcagcgtgtgtcagaacggacgcgattacgtggtgacgaaacaacctagcatatgcttgtgttcactggaagatttcctctgtgatttcggatactacagacccgagaatgactctaagtgtgttgagcagcctgaacttaagggccatgacctggagttttgcctctatggaagagaggagcatctcaccactaatggctatcggaagattccgggggataaatgtcagggcggggtgaacccggtgcgcgaggttaaggatctgaaaaaaaaatgcaccagtaacttccttagccccgaaaagcagaattctaagtccaatagtgtgcccatcatactggcaattgtcggcctgatgctggtgacagtggtcgctggggtactgatagtcaaaaaatacgtttgcgggggccgattcctggtccaccggtactctgtcttgcagcaacacgccgaagcgaacggcgtcgatggtgttgacgccctcgacacagcaagtcacactaataagtctgggtaccacgatgactctgacgaagatctactcgagtag

SEQ ID NO: 2819 - DNA, 1446 bp, Artificial Sequence
  Description of Artificial Sequence: Synthetic coding sequence
atgaaagtgctgtctgaggggcagctgaaactatgtgtggtgcagcctgtgcacctgacatcgtggttgctcatttttttcattcttaagtccatatcttgtctgaagccagcgcggttgcctatttatcagcggaaacccttcattgccgcttggaacgccccaacagatcagtgcctgatcaaatataacttgcggctcaatctgaaaatgttccccgtgattgggtcccccctggccaaggcaagggggcagaacgtaacaattttctatgtgaacagactcggctattatccctggtacacatcgcagggtgtccctattaacggtggattgccgcagaacatttccttacaggtgcatttggagaaggcagatcaagatataaactactatataccagcagaagatttcagtggcttggcggtgatagactgggaatactggcgcccccaatgggctaggaattggaatagtaaggacgtgtatcggcagaaaagtaggaagctcatcagcgatatgggaaagaatgtctcagccaccgacatagagtatttggccaaggtgacttttgaagaatcggccaaggccttcatgaaagagacaattaaactcggcattaaatccagaccaaaaggactgtggggatactatttgtacccggactgtcacaattacaatgtgtacgcccccaactatagtggatcttgtccagaagacgaagtcctacgcaacaatgagttatcctggctgtggaactccagcgccgccctttacccgagtatcggggtatggaaaagcctcggggatagcgaaaatattctgcggttttcaaagttccgggttcatgaatccatgcgcatctctactatgacaagccacgattatgcgctgcctgtcttcgtgtatactagattaggctatagagacgaacccttgttcttcttgtccaaacaggatctggtgtccaccattggcgagtccgccgcactgggggcagcaggaattgtcatctggggcgacatgaatctgaccgcctccaaggccaactgtaccaaggtgaagcaatttgttagctccgatttgggctcctatatcgcgaacgtgactcgagccgcagaggtttgttcgttacacttgtgtcgcaataacggacgctgcatccgcaagatgtggaatgccccctcatatctgcacctgaaccctgcgtcttaccacatcgaggcgtccgaggacggggagttcaccgtgaagggcaaagcatccgacacagatctcgctgttatggctgacacattttcatgtcactgttatcagggctatgagggagccgactgccgtgaaataaagacagccgatggttgctccggcgtgagccctagcccaggcagcctgatgacgctgtgtctgctgctgctagcttcctacaggtccattcagctctag

SEQ ID NO: 2820 - DNA, 1536 bp, Artificial Sequence
  Description of Artificial Sequence: Synthetic coding sequence
atgggcgtgttaaagtttaaacacatcttcttccgatccttcgtaaaaagctcaggagtcagccagattgtcttcacctttttgctaatcccttgttgcctgacgcttaacttcagggccccccctgtgatccctaatgtgccattcctttgggcgtggaacgcccccagcgagttttgcctgggcaagttcgatgagccgctggatatgtccctgttctcttttatcggttctccaagaatcaacgccactggccagggcgtcacaattttctacgtggatagactggggtactacccttacatcgactcaattactggagtcactgttaatggagggatccctcaaaagatcagtttgcaggatcatcttgacaaggctaagaaagacatcaccttttatatgcccgtggataacctaggtatggctgtgatcgattgggaggaatggcggcccacctgggcgcgaaattggaaacccaaagatgtttataagaaccgcagcatcgagctggttcagcagcagaatgtgcagctatcattgactgaggccactgagaaagccaaacaggaattcgaaaaggccggtaaggactttctcgtggaaactattaaactcgggaagctactgagaccaaatcatttgtggggatattacctgtttcccgactgctataaccatcattataaaaaacccgggtataacggcagctgtttcaatgtagagatcaaaaggaacgacgatcttagttggctatggaatgagtcaactgccctgtatccatccatatatctcaatactcagcagagtcccgtagcagctaccctgtacgtacgaaaccgcgtgagagaagccattcgggtaagcaagatccctgacgctaagagcccactccctgtgtttgcatacactcgtatcgtgtttactgaccaagtgcttaagtttctgagtcaggacgaactggtgtataccttcggagaaactgtagcgttgggcgctagcggtatagtcatttggggaacgctgagtattatgcgctcaatgaagtcctgcttgttactggacaattatatggagaccattttgaatccctatattataaatgtgacgctcgcagcgaaaatgtgctcccaggtgttatgtcaggagcaaggggtttgcatcaggaagaactggaattcctcagattatttgcaccttaacccagataacttcgccatccagttagagaagggagggaagttcacagtccgcggaaagcctactcttgaagacctggagcagttttcagagaaattctattgcagctgctatagcacactgtcgtgtaaggaaaaggctgatgtgaaagataccgatgctgtggatgtgtgtattgctgatggcgtttgtatcgatgcattccttaagccccccatggaaaccgaagagcctcaaatcttctacaacgcctccccctctaccctgtctgcaactatgtttatttggcgacttgaggtatgggatcaagggatctctcgcattggcttcttttag

SEQ ID NO: 2821 - DNA, 1530 bp, Artificial Sequence
  Description of Artificial Sequence: Synthetic coding sequence
atgggtgtgctgaaattcaagcacatcttcttccggtcgtttgtcaagagtagtggggtatcccagattgtgttcacattcctgcttatcccatgttgtcttacgttgaactttcgcgccccgcccgttatacccaacgtgccttttttgtgggcttggaacgccccgtcggagttctgcctgggaaagttcgacgagccactcgacatgagcctgttttcttttatcggctcacccagaatcaacgccacgggccagggggtcacaattttctacgtggatcggcttgggtattacccgtacatcgacagtattacaggagttactgtgaacggggggatcccccagaagatttctcttcaagaccacttagacaaggctaagaaagacattaccttttacatgccagtcgataacctgggtatggccgtgatcgactgggaagagtggagacccacctgggcaagaaactggaagcctaaggacgtttacaaaaaccgttctattgaacttgtgcaacagcaaaacgtccagctatccctgacagaagctacagaaaaagctaaacaggaatttgaaaaagctggcaaagacttccttgtggaaacaattaaattgggcaagctgctgaggccgaatcacttatggggctattacctatttcctgactgctataatcatcattacaagaaaccggggtataatggatcatgttttaacgtggaaattaaaagaaatgacgatttgagctggctttggaatgagtctacagcgctctaccccagcatctatcttaacacccaacagagtcctgtcgccgccaccctctatgttaggaatcgggtgagggaggccataagagtctccaagattcccgatgccaagagccccctcccagtattcgcttacacacggattgtgtttactgatcaagtgctgaaatttctcagccaggatgaacttgtctacacattcggagaaacggttgcactgggggccagtgggattgttatctggggaaccctctccattatgagaagcatgaagtcttgcctccttctggataattatatggaaacgatcctgaacccctacattatcaacgtgacgctggctgctaagatgtgctcgcaggtgttgtgtcaggagcagggcgtgtgcatcaggaaaaactggaactccagcgactacctccacctgaatccagacaacttcgctattcagctagagaaaggagggaaatttactgtccgtggaaagccaacgctggaagacctcgagcagttcagtgagaaattctactgcagttgttactcaacgctttcttgtaaggaaaaagccgacgtcaaggataccgacgccgtcgacgtgtgtatcgctgatggagtctgcattgacgcctttctcaagccacccatggagactgaagagccgcaaatattttacaatgcttcacccagtacactgtcagctaccatgttcatagttagcatcctgttcctgattatttctagcgtggcctcgctgtag

SEQ ID NO: 2822 - DNA, 243 bp, Artificial Sequence
  Description of Artificial Sequence: Synthetic coding sequence
atgggagtactaaaatttaagcacatctttttccggagcttcgtcaagtcctcaggggtctcacagatcgtcttcactttcttgctgattccctgctgtttgacacttaacttccgcgcccccccggttatccctaatgttccattcttgtgggcatggaatgctccgtcagaattctgtctcggcaaatttgatgaaccgctggacatgagcctcttttcattcatcggcagcccccgatag

SEQ ID NO: 2823 - DNA, 1530 bp, Artificial Sequence
  Description of Artificial Sequence: Synthetic coding sequence
atgggcgtgctcaagttcaaacacattttttttcgctcatttgttaagtcatcaggagtaagtcagatagtcttcacgttcctcctaattccttgttgcctcactctaaacttcagggccccacctgtgatccctaatgtgccgttcttgtgggcctggaacgcacccagtgaattctgtttaggaaagtttgacgagcccctggatatgagtttgttcagtttcatcggctctcccagaattaatgcgacaggtcagggggttacaattttttatgtggatcgattaggatattatccgtatattgattccattactggcgttacggtcaatggaggcattccccagaaaatatctttacaggatcacttggacaaggccaaaaaggatatcactttctacatgccagtggacaacctcggcatggctgtgatcgactgggaggagtggcgcccgacctgggcaagaaactggaagcctaaagatgtgtacaagaaccggtccatagaactggtgcagcaacagaacgttcagctgtctttgactgaagcaacagagaaggccaaacaggagttcgagaaagccgggaaagatttcctggtggagaccatcaaattgggaaagctgctgaggcccaatcacctgtggggctactacctgttccccgactgttacaaccatcactacaaaaagcccggctataacgggtcatgttttaacgtggaaattaagcgaaacgatgacctttcctggctttggaatgaatccacagctttgtacccctctatttatctgaacacccagcagtcaccagtagctgcaaccctgtatgtgagaaaccgggtgagggaagccatccgcgtgagtaagatcccagacgccaagtccccattacctgtatttgcttatacaagaatcgtcttcactgaccaggtgctgaaattcctaagccaggacgagctggtatacaccttcggagagacagtcgctctgggggcttccggaattgtgatctggggaaccctaagcatcatgaggagcatgaagagctgtcttctgttggataactacatggagaccatactgaacccgtatattattaacgtgaccctggcggctaaaatgtgctcacaggtgctgtgccaagaacaaggcgtgtgtatcagaaaaaactggaactcaagtgattatctgcacctcaaccccgacaacttcgccatccagttggaaaagggcggaaagtttaccgtgcgggggaagccaaccctagaggacctagagcagttttccgaaaaattttattgtagttgctattccacgctttcctgtaaagagaaggctgacgtgaaagatacagacgcggtggatgtgtgtatcgctgatggcgtttgcatcgacgcctttctgaaaccacctatggagactgaagagcctcagatcttctacaatgccagtccttcaacattatccgcaaccatgttcatcgtgagtattctgtttctcatcatctcctcagtggcatccttatag

SEQ ID NO: 2824 - DNA, 1530 bp, Artificial Sequence
  Description of Artificial Sequence: Synthetic coding sequence
atgggcgtgctgaagttcaagcacatattttttcggtcatttgtaaaaagctctggggtgtctcaaattgtgttcacatttctgctgatcccgtgttgtctgaccctgaatttccgagccccaccagtgataccaaacgtgccattcttgtgggcctggaacgcaccatccgagttctgtctgggcaagttcgacgaacctctggatatgtctctcttttctttcatcggatcccccagaattaacgcaaccggacaaggcgtgaccatcttctatgttgatcgcctaggttactacccttacattgatagtatcaccggagttaccgtgaacggtggaatcccccagaagatttctctgcaagaccatctggacaaagctaagaaggatattacattctacatgccagttgataatctcggcatggctgtgatcgattgggaagagtggcggccaacgtgggctaggaactggaaaccaaaagatgtgtataaaaaccggagcatagaactggttcaacagcagaatgtgcaactgagtctgactgaggccacagaaaaagccaagcaagagttcgagaaagccggtaaagattttctcgtggagactattaaactggggaaactccttcggcccaaccatctgtggggctattacctgtttcccgattgctataaccaccactacaaaaagccggggtacaacgggtcctgttttaatgtggaaataaaaaggaacgacgacttgagctggctgtggaatgaatctaccgccctgtacccatctatttatcttaacacccagcagtctcctgtcgccgcaaccctctatgtccgcaatagagtgcgagaggccatccgcgtgtccaagatcccagatgcaaagagccctctgccggttttcgcctacacacggatagtgttcaccgaccaagttttaaagttccttagccaggatgagcttgtctatacctttggggagaccgttgcactgggagcatccggaattgtgatctggggaactctcagtattatgcgaagcatgaaatcatgcttgctgctggataactacatggagacaattctcaatccctatatcatcaacgtgacccttgccgcgaaaatgtgctcacaggtgttatgtcaggagcagggcgtgtgtattcggaaaaactggaattcttctgattacctgcacctgaatcccgataattttgctattcagcttgaaaaaggtgggaaatttacggtacgcgggaagccaacactggaagacctggagcagtttagcgaaaagttttactgctcctgctattcgacacttagctgtaaagagaaggcggatgtcaaggacactgacgccgtggacgtctgcatcgccgatggggtgtgtatcgatgcctttcttaaaccccccatggagactgaagagcctcaaattttttataatgcttcacctagcactctgtctgcgacgatgttcatcgtttcgattctgtttctgattatctcctcggtcgcctctttatag

SEQ ID NO: 2825 - DNA, 1764 bp, Artificial Sequence
  Description of Artificial Sequence: Synthetic coding sequence
atgcctagatatggtgcaagtttgaggcaaagctgtcccaggtcaggcagggagcaaggccaggatggcacagcaggcgccccaggtctcctatggatgggcctggtgctggcgctggccctggcactggcgctagccctggcactatccgactcgcgagtgttgtgggccccagccgaagcccaccctttaagtccacagggacaccccgcacgtctgcatcggatagtccctcgcctgcgcgatgtgttcggttgggggaacctcacctgcccaatttgcaagggcctgtttaccgcaatcaaccttggtctcaaaaaagagcctaacgtggccagggtaggctcggttgccatcaaactgtgcaaccttctgaagatagctcccccagcagtgtgccagtccatcgtccatttgttcgaggacgacatggtggaggtgtggcgtagatccgtgctctctcccagcgaggcttgcgggctgcttctcggcagtacttgcggccactgggatatattctcgtcgtggaacatctctctccccaccgtgcccaagcctccgccaaagcccccaagcccacctgcgcctggagcccccgtgagtagaattttattcctgactgatctgcattgggatcacgattacctcgaggggaccgaccccgactgtgctgaccccctgtgttgtaggcggggatccggactgccccccgcatctaggccaggcgctggctactggggagaatacagtaagtgcgacttgccacttcgcaccttggaatcactgctctctggacttggccccgccggaccgttcgatatggtttactggactggagatatcccggctcatgacgtctggcatcagactaggcaggatcagctgcgtgccctgaccaccgtgactgctctggttaggaaattccttggacccgtgcccgtgtaccctgccgtcgggaatcacgagtcaactcccgtcaattccttcccgccgcccttcatagaggggaaccatagcagtcgctggctctacgaggcaatggcaaaagcttgggagccttggctcccagctgaagcactcaggacacttcgatatctttccagtgtggagacacaggaggggaaaaggaaggtccacattatcggtcacatcccaccgggccactgcctcaagtcctggtcctggaactactataggatcgtggcgaggtatgaaaataccctcgcagcccagttcttcggacacacacacgtggatgagtttgaggtgttttatgacgaagagacattgagccgcccactcgcggtggctttccttgccccatcagccacgacgtacatcgggctaaatcctggctaccgtgtttatcaaatcgatggcaactactccggatcttcacatgtggtgcttgatcacgagacttatattttgaacttgacccaggcaaatatcccaggcgcaattccgcattggcagttactgtatcgggctcgggagacgtacggacttccaaatacgctgcctaccgcttggcataacctcgtgtataggatgcgtggcgatatgcagctgttccagacattttggtttctgtatcacaaaggtcatcccccgagtgagccctgcggcaccccttgtcgccttgcgacactgtgcgcccaattgagcgcacgagcagattctccagctctgtgtcgccatttgatgccggatggatccctcccggaggcacagtctctgtggcctcgccccctgttctgctag

SEQ ID NO: 2826 - DNA, 1896 bp, Artificial Sequence
  Description of Artificial Sequence: Synthetic coding sequence
atgcccaggtacggcgcctccctaagacagtcatgcccccgttcaggacgagagcaggggcaggacgggacagccggcgcccccggcctgctgtggatgggtttagtgctggccctcgccttggctctggcccttgctttggctctttccgacagccgggttctgtgggctccagctgaagcccaccccttgagtcctcaggggcatcccgcgagactgcatcgtattgtgcctcgcttgcgagatgtatttggctggggaaacctgacatgtccgatttgcaagggtctgttcacagcaatcaacttgggcctaaagaaggaaccgaacgtcgcgcgggtgggtagcgtcgccattaagctgtgcaacctgctcaaaatcgcgccccctgcggtctgccagtcgatcgtgcatctgtttgaagatgacatggtggaagtctggagaagatcggtcctttcaccctcagaagcctgcggtctgctcctcggatcaacatgcgggcattgggacatttttagcagctggaatatttctctacccaccgttccgaaaccaccccctaagccaccatcaccacccgcccccggggctcctgtttccagaatcctcttcctgacggatctccattgggatcatgactacctggaaggtacggaccctgactgtgccgatcccctgtgctgtcgcagaggcagcggcttgccgcccgcctctcgtccaggcgccggctattggggggagtactccaagtgcgatctaccgctgcggaccctggagtctcttctcagtgggctcggtcctgccgggccgttcgacatggtgtactggaccggtgacattcccgcccatgacgtctggcatcagacaagacaggatcagctgcgggccttaaccacagtgacggctctcgtccgtaagtttttaggacctgtaccagtctatccagccgtaggtaatcatgagtctacccccgtcaatagtttcccgcccccctttatagaggggaaccattcctccagatggctttatgaagccatggccaaggcatgggaaccgtggctgcctgccgaggccttacgtaccctccgtattggtggattctatgcgctgtccccctaccccgggctgaggctcatatcactgaatatgaatttttgctctagagaaaacttctggctcctgattaactccaccgaccccgctggtcagctgcagtggctggtgggagagcttcaggccgctgaagataggggagacaaagttcacattataggccatatcccccctgggcactgcttaaaaagctggtcctggaattactacagaattgtggcacggtatgagaacacgctggctgcccagtttttcggccacacccacgttgatgagttcgaggtgttttatgatgaggaaacactcagccggccacttgctgtggcattcctggcccccagcgcaacgacctacattggcctcaatcccgggtaccgtgtttatcaaattgatgggaactactccggaagctctcacgtcgtgctggatcacgaaacctatatcctgaacttaacacaggcaaacatccccggcgccattcctcattggcagctcctctatcgagctagagagacctacggcctgcctaacaccctgccaacggcatggcacaatcttgtgtataggatgcggggtgatatgcagctcttccagacattctggtttctgtaccacaaaggccacccaccttccgaaccgtgcggaaccccatgtagacttgctaccctctgcgcacagctgtctgctcgagccgacagtcccgcattgtgcagacacctcatgcctgacgggagcctccctgaggcccagtccctgtggccaaggccgttattctgttag

SEQ ID NO: 2827 - DNA, 1728 bp, Artificial Sequence
  Description of Artificial Sequence: Synthetic coding sequence
atgccaagatacggcgcatccttgcgccagtcctgtcctcgttcgggcagagaacagggccaggacggaacagccggggcgcctggcttattatggatgggccttgtgttagcactagctttggctctcgcgctcgcccttgcactttctgacagtcgcgtcctgtgggcacccgctgaggcacaccccctctctccacagggacaccctgcacgcctgcatcggattgtgccaaggctgcgggatgtcttcggctgggggaacttaacgtgcccgatctgtaaaggcctgttcaccgccattaatcttggcctgaaaaaggaacctaatgtggcacgtgtgggcagcgtagccattaagctttgtaatctactcaaaatcgctccgcctgccgtttgccagagcatcgttcatttatttgaggatgacatggtcgaagtctggcgaagaagcgtgctgtctccgagtgaggcttgtgggctgctcctggggagtacatgcggtcattgggacatcttttccagctggaatatctccctgccgacggttccgaagcctccgcccaagcccccgtccccaccggcccccggggcgcctgtctcacgcatcttatttctgacagacctccactgggatcatgattacctcgaagggaccgacccagattgcgcggacccactgtgttgtcggcgaggctcaggtttacctcctgcatctcgtcccggtgcaggttactggggtgagtacagtaaatgtgacctgcctttgcgcacgctggagtccctcttgagtggcctgggcccagccggcccttttgatatggtgtattggactggggacattcccgctcacgacgtgtggcaccagacgcggcaggatcaactcagagctcttactactgtcacagcgctagttcgtaaattcctgggacccgtcccagtctaccccgcggtgggtaatcatgaatcaaccccggtgaattcattcccccctcctttcatcgaaggcaatcattcgagtcgctggctgtatgaagcaatggccaaggcatgggagccctggcttcccgcagaagcactgcgcacactgagaaaggtgcatatcatcggccatatccctccgggacattgtctgaagtcatggagttggaattactatagaatcgtggctagatacgaaaacacactggccgcccagtttttcggtcacacacatgttgatgagtttgaagtcttttacgatgaagagaccctgagccggcccctggccgtggccttccttgctccttctgccacgacctatatcggcttgaatcctggatacagagtttaccagatcgatggtaactactctggctcctcccacgtggtactcgaccacgagacatacatcctcaacttaacacaggccaacattcccggagccattccacactggcaattactctaccgagcacgggaaacttacgggctccctaataccctcccaaccgcctggcacaacctcgtctatagaatgagaggcgatatgcagttatttcagacgttttggtttctgtaccacaaaggtcatcctcctagtgagccctgtgggacaccatgcagactcgcaaccttatgcgcacagcttagcgcccgcgcagactcgccggccctgtgccgacacctcatgccagacgggtccctgcctgaagcacagagtctttggccccgtcccctgttttgttag

SEQ ID NO: 2828 - DNA, 1893 bp, Artificial Sequence
  Description of Artificial Sequence: Synthetic coding sequence
atgccccgctacggcgcgtctctgcggcaatcttgcccgagatccggtagggagcaaggacaggatggtacggcaggcgcccccggccttttgtggatgggactggtgctggcattggctctggcattggcgttagctcttgccctgagcgatagtcgagtgctgtgggcccctgccgaggctcatcccctttctccacagggccatcctgctcggctgcaccgaatcgtgccacgcctgagggacgttttcggttggggaaaccttacctgtcccatatgcaaaggacttttcaccgcgatcaatctgggtctcaaggaacccaacgttgcccgggttggctctgtcgctatcaaactgtgcaatcttctgaaaatagctccccccgcagtgtgtcaaagcatcgtgcatctttttgaggacgatatggtcgaggtttggcgccgttccgtcctgagcccatccgaggcatgcggcctactgttgggctccacgtgcggacactgggatattttctcaagctggaacatctcactgcctactgtccctaagccccctcccaaaccaccgtcccctcctgcccctggtgcccctgtgagtcgaatcctctttttgacggatctgcactgggaccacgactacctggaaggaactgacccagactgcgccgacccactctgttgtcgcaggggatccggtttacctcctgcatcccggccaggcgcagggtactggggggaatattcaaagtgcgacctgcccctacgcacgctcgaaagtttgttgtccgggcttggccctgccggcccctttgatatggtctactggacaggcgacatccctgcgcatgacgtgtggcatcagacccggcaagaccaactccgggccctcactactgtaaccgcgcttgttcgcaaatttctggggccggttcctgtgtacccagccgtgggaaatcacgagagcaccccggtcaattcatttccacccccatttatcgaggggaatcactccagtagatggctctatgaagccatggccaaagcttgggagccttggctgccagcagaggcattacggacactcagaattggagggttctacgctctgtccccataccccggtctgcgcctgatatctctcaatatgaatttctgttccagagagaatttctggcttctaattaactcaacagacccagctggacagctgcagtggctagtgggcgagttgcaggccgcggaggaccgaggcgataaggtgcacatcattggacacattccccctgggcactgcctcaagagttggagctggaactactataggattgtcgctagatatgaaaacaccctcgccgctcagttcttcggtcatacacatgtggacgagtttgaagtcttttacgacgaggagacgctctcacggccactggccgtcgcattcctggcaccgtcagccaccacatatattggacttaatccagggtatagagtctatcagatcgacggcaattactctggatctagtcacgtggtgcttgaccatgaaacatacatactgaacctgacccaggccaatatacctggggctatacctcattggcagttgctgtaccgggctcgcgaaacttacggcctccccaacacattacccactgcttggcataacctggtttatcgtatgagaggagacatgcaactctttcaaactttctggtttctttatcacaaaggccacccgccaagtgagccttgtggaactccttgcagactggccaccctctgcgcgcagttgtcagcgagagcagatagtcccgccctttgccgacaccttatgcctgacggaagtctaccagaagcccaatctttatggccacgccccctcttctgctag

SEQ ID NO: 2829 - DNA, 1101 bp, Artificial Sequence
  Description of Artificial Sequence: Synthetic coding sequence
atgcccaggtacggcgcctctcttaggcagagttgcccacggtcgggccgcgagcaggggcaggacggaactgcaggggcacccggtctcctctggatgggtctggtgctcgccctcgcactagctctggctttagctttagctttgagcgatagccgcgttctgtgggctcccgctgaggcccaccccctgtctccacagggccatcctgctcgactgcacagaattgtccctaggctgagggatgtgttcggttggggcaacctgacatgcccgatctgcaaaggtttatttaccgctatcaatttaggcctgaagaaagagcccaatgttgctagggtgggatccgtagctataaagctctgtaaccttttaaagattgcgccccctgccgtgtgccaaagcatagttcacctgtttgaggacgacatggtggaagtctggcgccgctccgtcctctccccctccgaagcctgtggcctgctccttggctccacttgcgggcattgggacattttctcatcgtggaatatcagtctccccactgtcccaaaaccaccacccaagcctccctcgccacctgcacccggagcccctgtgtcccgcatcctgtttctaacagacctgcattgggaccacgactatctggagggtactgatccagactgtgccgaccctctgtgctgtaggcggggttccggtctgcccccggccagccggcccggtgccggttattggggtgagtactcaaagtgcgatctgccgttgagaacattagaaagtttgttaagcgggctgggtcctgcggggccgttcgatatggtgtattggaccggggacatcccagctcacgacgtgtggcaccagacaaggcaagaccaactgcgcgccctgaccacagtgaccgcattggtccgaaagttcctggggcctgtacccgtttatccagccgtgggtaatcacgaatcaacccctgtcaatagcttcccacccccatttatagagggcaatcatagttccagatggctctatgaggccatggcgaaagcctgggaaccctggctgcccgccgaggctctacggactctgaggtgcatttag

SEQ ID NO: 2830 - DNA, 1209 bp, Artificial Sequence
  Description of Artificial Sequence: Synthetic coding sequence
atgccaagatatggggcttcactgcgacagtcgtgcccccggagtggcagagaacaaggtcaggatggcaccgccggagctccaggacttctttggatgggattggtgctggctctagctctcgctctagcccttgcccttgcactaagcgattctcgtgttttgtgggctcctgctgaggcccatccactctcaccccaggggcacccagcacgtctccatagaatcgtaccccgcctgagggatgtgttcggctggggcaatttgacctgtcctatttgcaagggcctttttaccgccattaacctaggccttaagaaggagccaaatgtcgcgcgcgtcggatccgtcgcaataaagttatgtaaccttttgaagatcgctccaccagccgtctgccagtccatcgttcatctattcgaggacgatatggtagaagtttggaggagatctgtcctgtcacctagcgaagcatgtggcctcctgctgggctcaacatgtggtcattgggatatttttagctcttggaacataagtttgccaacggtccctaaaccccctccgaagccccccagcccccctgcccctggggcacccgtttctcgcatactgtttttgacagacttgcactgggaccacgattacctggaaggcactgaccctgactgcgccgatcccttatgttgccgtagaggctcaggcctgcctcccgctagccgacccggcgctggatattggggcgaatatagcaagtgcgacctgcccctgcgtacgttggaaagcctcctgagcgggctcgggcctgcaggacccttcgacatggtgtattggaccggcgatattccagctcacgatgtttggcaccagacgcggcaggaccagctgagagccttgacaacggttaccgctctggtaaggaaattcttgggccccgtaccagtgtaccccgctgtgggaaaccatgaaagcactcctgtcaattccttccctcccccctttattgagggcaatcactcatcccgatggctctacgaagccatggcgaaggcgtgggagccttggcttcccgcagaggcgctgcgcacattaagatacctgtccagtgtcgagactcaggagggcaagcggaaaaactggggcgtcctgtgttccttccccatcccacgctccccacctcacctgtcccagtatgaattcctcttcccctag

SEQ ID NO: 2831 - DNA, 954 bp, Artificial Sequence
  Description of Artificial Sequence: Synthetic coding sequence
atgtataatatgatggaaacagagctgaagccacccggacctcagcaaacttccgggggcgggggcggcaattccaccgccgccgctgctggtgggaaccaaaagaattcaccagatcgggttaagcggccaatgaatgcattcatggtgtggtcaagaggacagagaaggaaaatggcgcaagaaaacccaaaaatgcataattctgagatctccaagaggctgggagctgagtggaaactactgagtgaaaccgagaagcgtcctttcattgacgaagccaaaaggctgagagccctgcatatgaaggagcatccggactacaaatatcggcctcgtcggaagaccaagactctgatgaaaaaagataagtatacactgccaggaggtcttctagctccaggaggtaatagcatggcatctggggttggcgtaggagctgggctgggagcgggagtgaatcagcggatggactcatatgcacacatgaacggatggtctaatggcagctactccatgatgcaggaccaactcggttatccacaacatcctggactcaatgcccacggggcagcccagatgcagcccatgcataggtacgacgtgtcagctttacagtataactcaatgacctcctctcagacatatatgaacggatcacccacatattccatgtcctacagccagcagggaacgcctggaatggcactgggatctatgggctctgtggtgaagtcagaagcctcctcatccccaccagtggtcaccagttcaagtcatagcagagcgccctgtcaggcgggggatctccgggatatgatcagcatgtacttgccaggcgctgaggtgccagaaccagctgcaccgtctcgactgcacatgagccagcattaccaaagtggtcccgtgcccggcacggccatcaatggtactttgccactgtcacatatgtag

SEQ ID NO: 2832 - DNA, 954 bp, Artificial Sequence
  Description of Artificial Sequence: Synthetic coding sequence
atgtacaacatgatggaaacagagcttaagccaccagggccccagcagacctccggagggggaggagggaatagtaccgccgccgcagcaggcgggaaccaaaagaactctcccgatagggtgaagagaccaatgaatgcatttatggtatggagtagggggcagaggcgaaagatggcccaagaaaatcccaagatgcataattcagagatcagtaagaggctgggagcagaatggaagctgctgagcgagaccgagaagagacctttcattgacgaagctaagagactgagggcgcttcatatgaaagagcacccggattataagtaccggccaaggcggaaaaccaagactttgatgaaaaaggacaagtataccctccctgggggactgctagcgcctggaggaaatagcatggccagtggggttggagtcggggctggcttgggggcaggagtgaatcagcgcatggactcctacgcccacatgaacggatggtcaaatggctcatacagcatgatgcaggatcagctcggatatcctcagcatcccgggctaaatgcccatggcgctgctcagatgcagccgatgcaccggtatgatgtttccgctctacagtataacagtatgaccagctctcagacctacatgaacggaagtcctacgtacagtatgtcttactcccagcagggtacgcccgggatggccctgggctcaatgggaagcgtggtgaaaagcgaggcatcctctagcccaccggtggtaacatctagctcacacagtagagccccgtgtcaggccggggacctgagggatatgatttctatgtatctgccgggagcagaagtgcctgaaccagcagccccatcgcggctccacatgtcccagcactatcaatcagggcccgtgcctgggaccgccattaatggcaccctgccactgtcccatatgtag

SEQ ID NO: 2833 - DNA, 1182 bp, Artificial Sequence
  Description of Artificial Sequence: Synthetic coding sequence
atgcatcaggccgggtatcccggctgcaggggagcaatggctgagtctcacttgctgcaatggctgcttctgcttctgccaactttatgtggccctggcacagctgcttggacgactagttccctggcctgcgcccagggtcctgaattctggtgtcagtctctagagcaggcgcttcagtgcagggcattaggccattgcttgcaagaggtgtggggacatgtgggcgccgatgacctctgccaagaatgcgaggacatcgtgcacattctgaacaagatggctaaggaggcgatttttcaggatacgatgaggaaatttctcgagcaagaatgcaacgttctgccattgaagctgctcatgcctcagtgcaatcaggtgcttgatgactacttcccactcgtgattgattattttcagaaccagactgatagcaatggcatatgcatgcatctcgggctgtgtaagtcccggcagccagaaccagagcaggagccgggcatgtcagacccgctccccaagccactcagggatcctctccctgacccattactcgacaagcttgtgctcccagtgttacctggagctctgcaggccagaccagggccacacactcaggacttatccgagcaacagtttcccattccactcccatattgctggctctgccgggcattgattaaaagaattcaggccatgatcccgaagggggctctcgctgttgccgttgctcaagtttgccgtgtggtgcccttggtggctggcggcatttgtcagtgcctggcggagcgttattccgtcatcctgctggacacactcctgggtcggatgctcccacagcttgtttgtcggttagtgctaaggtgcagtatggacgattctgccggaccacgaagtcctaccggagaatggcttccccgcgactctgagtgccacctttgcatgagcgtaaccacccaggctggtaattccagcgagcaagccatcccccaggccatgctgcaagcttgcgttggatcatggctagacagagagaaatgtaaacagttcgtggaacagcatacccctcagctgctgaccttagttccgagaggatgggacgcccacacaacatgtcaggccctgggagtctgtggcacaatgtcatcccccttgcaatgtatacactcacccgatctctag

SEQ ID NO: 2834 - DNA, 1182 bp, Artificial Sequence
  Description of Artificial Sequence: Synthetic coding sequence
atgcatcaagctggatacccgggttgtcgtggtgccatggcggaatctcacttgctgcagtggcttctgctgctgcttcctactctctgtggccccggaacagctgcctggacaacttctagtctggcatgcgcccagggaccagaattttggtgccaatcactggaacaggcgctccagtgcagggctcttggccattgcctacaggaagtctggggacatgttggagctgatgatttgtgtcaggagtgcgaggatatagtacatattctgaacaagatggccaaggaggcaatattccaagataccatgcggaagttcctggaacaggaatgtaatgttctgcccctcaaattgctgatgccccaatgtaaccaggtgctggatgattattttccactcgttattgactatttccaaaaccaaaccgattccaacggaatttgcatgcatttgggattatgcaagagcagacaacccgagcccgagcaggaaccaggaatgtccgaccctctgccaaagccgctcagagaccccttaccagatcccttgctcgacaagcttgtgcttcccgtattgcctggcgccttacaggctcgccccggtccgcacacgcaggacctgagcgagcagcagtttccaatccccctcccgtactgttggctctgccgggcattgataaaacggatccaggccatgatcccgaaaggggcattagctgtggctgtagcgcaggtgtgtcgggtggtgccgttggttgcagggggaatctgtcagtgtctagccgaacggtattccgtcatcttattggatactttgctgggtcgcatgcttccacagctggtatgtcggctcgtgctccgctgttctatggacgatagcgctgggccaaggagtcctactggcgagtggcttccacgggacagtgagtgtcacctgtgtatgtcagtgactacacaggccggtaatagtagcgaacaagctattccgcaggcaatgttgcaggcttgcgtggggtcctggctggatcgcgaaaagtgtaagcaatttgtcgagcagcacactccccagctcctgaccctggtgccccgaggctgggatgcacatacgacttgccaagcactgggggtgtgcggaaccatgagctctcctttacaatgcattcacagtccagatctgtag

SEQ ID NO: 2835 - DNA, 1050 bp, Artificial Sequence
  Description of Artificial Sequence: Synthetic coding sequence
atggccgagagtcaccttctgcaatggctgttgctactcttacctactctatgtggccctggtaccgccgcctggacgaccagtagtctcgcatgcgcccagggccccgaattttggtgtcaatccctggaacaggccctgcagtgccgtgctctgggccactgccttcaggacaccatgcggaaatttcttgagcaggaatgtaacgtcttaccactgaagttattaatgccccagtgcaaccaagtgcttgatgattactttcccttagtcatcgattactttcagaatcaaactgactccaatggtatctgtatgcatctggggctttgcaagtctaggcaacccgaaccggagcaagagcctggaatgtctgaccccctccctaagccgttaagggatccgctccctgatcctttgctggataaattggttctcccagttcttcccggggcgctgcaagcgcgccctggtccccacacccaggatctgagtgaacaacagttccctatcccactaccttactgctggttgtgccgggccctcatcaaaagaatccaggccatgatccctaagggtgccctggccgtggctgtcgcgcaagtgtgcagggttgtgccccttgtggccggcggaatctgtcagtgcctggccgagaggtatagcgtgatcctactggatactttattgggcaggatgcttccacagcttgtctgcaggttggtgctgaggtgcagcatggatgactcagcagggcctcggtccccgaccggggaatggctgccgagagatagcgagtgccatctttgcatgagtgtcactacacaggccgggaattcctcagagcaggccatcccacaggcaatgctccaggcctgcgttggtagttggctggaccgggagaaatgtaaacagttcgtggaacagcataccccccaattgttgaccctggtaccaaggggatgggatgcacacacgacatgtcaggccctgggcgtttgtggcaccatgtcatccccgcttcaatgcatccattcaccagatctctag

SEQ ID NO: 2836 - DNA, 1152 bp, Artificial Sequence
  Description of Artificial Sequence: Synthetic coding sequence
ggagccatggctgaatcgcacttactccagtggctcttactcctgctgccaacactgtgcggccctggaacagcagcttggacaacgtcctcgctcgcgtgtgcccagggaccagaattttggtgccagagtctggaacaagcgttgcagtgtagagccctgggacattgcctccaggaggtatgggggcacgtaggcgccgatgacctctgtcaggaatgcgaggacatcgtccacatattgaataagatggccaaggaggctatctttcaggacactatgagaaagttcttagaacaggagtgtaatgtgctgccgttgaaacttcttatgccacagtgtaatcaggtccttgatgactacttccccctcgtgatcgattacttccagaaccaaaccgattctaatggcatttgtatgcatttgggtttgtgtaagagccgacagcctgagcccgaacaagaacctggcatgtccgaccccctccctaagcccctgagggatccactacctgatccattacttgataagctggtgctgcccgtcctgcccggggcactccaagctcggcccggtccacacacgcaggacctgtcagaacaacagtttcccatccctcttccgtactgctggctgtgcagagcactgattaaacggatccaggctatgatccctaagggggcccttgccgtggctgtggcccaggtgtgcagggtggtacccctagtggctggcggaatctgccaatgcttggctgaaaggtactctgtgatcctgctggatactctgctgggaagaatgctcccccagttagtctgccggctagttctgaggtgtagcatggacgacagcgctggaccccgttcaccaaccggggaatggctgcccagggacagcgagtgtcacctgtgcatgagcgtaacgacccaggccgggaactcctcagagcaggccataccacaggccatgttacaggcgtgcgtcggctcctggcttgatagggagaagtgcaaacaattcgttgagcagcatacaccacagttgcttacactcgtgcctcgtggttgggatgcacacaccacttgtcaagctcttggagtgtgtggcacaatgtcaagtccactgcagtgcatccactcccccgatttatag

SEQ ID NO: 2837 - DNA, 1728 bp, Artificial Sequence
  Description of Artificial Sequence: Synthetic coding sequence
atgctgggcgtattggtgctaggagccctagctcttgccggacttgggttccctgcaccagcagaaccccagcccggtggctcccagtgcgtggagcacgactgcttcgccctgtacccagggccagccactttcctaaacgcatcccagatctgcgacggcctacggggacacctgatgaccgtccgctccagcgtggctgccgatgtcatttccctccttctcaacggagacggaggagtcggacggcgcagactttggattggcctgcagttgcccccgggttgtggtgacccaaaacgcctgggcccacttagaggcttccagtgggtcaccggcgacaacaatacaagctactccagatgggcacgtcttgatctcaatggggctcctttatgcggccctttgtgcgttgcggtgtccgcagctgaggctaccgttccctccgagccgatttgggaagaacagcagtgtgaggtcaaggccgacggatttctgtgcgagtttcattttcccgctacctgtaggccacttgccgtggagcctggtgccgcagcagctgctgtgagtatcacatacggtacccctttcgcagctaggggagcagacttccaggcactccccgtgggctcctctgctgctgtcgcccccctgggtttacagctgatgtgcaccgcgccccccggagctgtacagggacactgggcccgagaagccccaggcgcctgggactgtagtgttgagaacggtggatgcgagcacgcctgcaatgcaatcccaggagcacccagatgccaatgcccagccggcgccgctttacaggccgatggtcggtcttgcacggcctctgcaacccagagctgtaatgatctgtgcgaacacttttgcgtccctaacccggaccagcctggcagctactcatgtatgtgtgagaccggttatcgcctagccgccgaccaacacagatgcgaggatgtggatgattgcattttagagccttccccttgcccacagcgttgtgtgaatacccagggcgggttcgaatgccactgttacccaaattacgacctggtggacggggaatgcgttgagcctgtcgacccctgttttcgggcgaattgcgagtaccagtgccagcctctaaaccagacctcttatttgtgtgtgtgcgcggaaggctttgcccccattccacacgagccacaccggtgccagatgttctgcaaccagacggcatgtcctgcagactgcgacccgaatactcaggcctcatgcgagtgccctgaagggtacatcctggacgacggtttcatctgcactgatatcgacgagtgtgagaatggaggcttctgcagcggggtgtgccataatttgccggggactttcgagtgcatctgcgggcccgattcagcacttgctcgacatatcggaaccgactgtgatagcggcaaggtggacgggggcgatagtggaagtggggaacctccaccgtcgccaactcctggctccacactcacgcctcctgcggtgggcctggtccatagtgggcttctgattggtatctctatcgcgagtctgtgcttggttgtggccttgctcgcattactgtgccacctacgcaaaaaacaaggcgccgccagggccaagatggagtataaatgcgcagctccctccaaagaagtagtgctgcagcacgttcgcacggagcgaaccccccagcgactatag

SEQ ID NO: 2838 - DNA, 1674 bp, Artificial Sequence
  Description of Artificial Sequence: Synthetic coding sequence
atgtctgaagctgcaagtcagggtttgcgagcagccgctaggagtgtatgggcgggaacagatagacgcggttgtcgccatcgcaggccagtgcctctgtgtagtgggacagccctctctcagtgcccccgtttcccgagaagattgcacgcggcgcgtttgggtaacatgctcggggttcttgtgctgggagccctggccctcgccggattgggctttcccgcacccgggtgtggcgatcctaagcggctgggacctttacgcggcttccaatgggtaactggagataacaatactagctacagtcgctgggcgagacttgacttgaatggggcgccgctttgtggtcctctgtgtgttgcggttagtgctgccgaagccacagttcctagtgaacccatttgggaagagcagcagtgtgaggtcaaggcagacgggttcctgtgcgaattccacttcccagcaacatgcagacctctggctgtggagcccggagcggccgccgctgccgtttcaatcacctacggcacaccttttgcggctcgtggagcagactttcaggctcttccagtgggcagttcggccgctgtagctcccttggggctgcagttgatgtgcacagccccacccggagcggtgcaggggcattgggctagagaagcaccaggggcttgggattgcagtgtggagaatgggggatgtgaacacgcatgtaacgccattcccggggcccctcggtgccagtgtcctgctggagccgcgctgcaggcagatggacgttcctgtaccgcatctgctacgcaatcatgtaacgatctgtgcgagcatttctgtgtgccaaacccagaccagccgggttcatacagctgcatgtgcgagacaggctatcgcctggctgcggaccagcacagatgcgaggatgttgacgattgcatcctggagcccagcccctgccctcagcggtgcgtcaatacccagggcggtttcgagtgccattgttatccaaactacgacctggtcgatggagagtgcgtcgaacccgtggacccctgcttccgcgcaaactgcgagtaccagtgccagcccctcaatcagactagttacctgtgcgtgtgtgcagaaggatttgctcccatcccacacgagccacacagatgtcagatgttctgtaaccagacagcctgtccggcagattgtgatcctaatacacaggcatcttgcgaatgtccagaaggctatatacttgacgatgggtttatttgcacagacatcgacgagtgcgagaatggtggtttctgcagcggcgtctgccataacctgcctggcacctttgagtgcatctgtggccctgacagcgccctggcccgccacatcgggacggattgtgacagcggaaaggtagatggcggagattccggtagcggcgaaccccccccttcacccacccccggtagcactctgacaccccccgctgtggggttagtgcactcaggcttgttgatcggaatttcaatcgcgtccctttgtcttgttgtggccctcctggccctgttgtgccacttacgcaaaaagcagggggccgcgcgcgccaagatggagtacaagtgcgcagcaccgagtaaagaggtggtgttgcagcacgtccggactgaacggactccccagcgcctgtag

SEQ ID NO: 2839 - DNA, 1062 bp, Artificial Sequence
  Description of Artificial Sequence: Synthetic coding sequence
atggagctcactgaattgctgttggtggtgatgttgctactcacagcccgtttgactctttcttcacctgccccccccgcatgcgacttgagggtcctctccaagctgctgagggatagccacgttctccacagtcggctatctcagtgtcccgaggtccacccgctacctactcccgtcctgctaccagccgttgacttcagcttgggcgagtggaagacacagatggaggaaaccaaagcccaggatatcctgggcgccgtcaccctgctcctggagggcgtgatggcagctaggggtcaactcgggcccacatgcctctccagtctactgggtcagctcagcggacaggtgagacttttactcggcgccttacaaagcctgctgggcacacaactgcctcctcaggggagaacaactgcgcataaagatcccaatgctatctttctcagctttcaacacttattgcgggggaaggttcggttcttaatgctggtgggaggaagcacgctatgcgtacggagagcccctcctactacagcagtcccttcacgcacttcacttgtcctgacattgaacgagctgcccaataggactagcggcctcttagagacaaactttactgcttccgctcgcactacaggttccgggctgctgaaatggcaacagggcttcagggccaagatccctggtctgctaaatcagaccagtcggtccctcgaccaaatccctgggtaccttaatcggattcacgaactacttaatggtacgcggggcttatttcctggaccctctagaagaacgctaggtgctccggatatttcgtctggcactagcgacaccggaagtcttcctcccaacctgcagccagggtactcacccagtccaacccatcctccgactggccagtacaccttattcccattgcccccgactctaccaacccccgtggttcaactgcaccccctgttacctgaccccagtgctcccacgccaacaccaaccagccccctcctgaacactagctatacccactcccagaacctgtcacaggaaggctag

SEQ ID NO: 2840 - DNA, 945 bp, Artificial Sequence
  Description of Artificial Sequence: Synthetic coding sequence
atggagctcacagagctcctcctcgttgtgatgttactgctcaccgctcgcttgaccctaagtagcccagctccccccgcttgtgacttgagagttctgtcaaaactactgagagactctcatgtgctgcatagcagactgagccaatgtccagaggtgcacccactgcccacacccgtgttgctcccagccgtggactttagcctcggagagtggaaaactcaaatggaggaaaccaaagcccaggacatactgggggcagtgactctcctgcttgaaggagtgatggcggcccgaggccagctgggccctacatgtctgtcctcgttactgggtcagcttagcggtcaagtgagactgttgctaggagctctgcagagtctcctggggacccaactgcccccacaagggaggaccactgcccataaagacccgaatgccatctttctgagttttcagcacctgctgcggggtaagacatctggtcttcttgaaacgaattttactgcgagcgcacggacaaccggatctgggctgttgaagtggcagcagggctttcgggcgaagattcctgggttgcttaaccagactagccgcagcttggatcaaatcccaggatacctgaatagaatccatgaacttctgaacggtacccgggggttgttccctggaccaagccgtcgaaccctgggagcgcccgacattagttcaggcactagcgacaccggaagtttaccacccaatttgcagcctgggtattctcctagccctacgcatccaccaactgggcaatatactctatttcccctccctcctactcttccgacacccgttgtgcagcttcatcccctcctcccagatccatccgctcccactccaaccccaacctccccattgctgaacacttcatacactcacagccagaatctgtcacaggaaggctag

SEQ ID NO: 2841 - DNA, 861 bp, Artificial Sequence
  Description of Artificial Sequence: Synthetic coding sequence
atggagcttacagagctcctgctggtggtaatgctcctcctgactgcgcgtcttacattgagcagtccggcacctccagcttgcgacctccgggtgttgagcaaactgctcagagactcgcacgtactgcacagtagactgtcccagtgccccgaggtgcacccgctgcctacgcccgtgttgttaccggcagtggacttctctcttggggaatggaaaacccagatggaagagactaaggcccaggacatattgggcgctgtaaccctgttgctcgagggcgtgatggcagctcgaggccaactgggccccacttgtctgtctagcctgctggggcagttgtccggacaggtgagactgctgctcggagcactgcagtccctgctgggtacccagctgcccccacagggtcggacaactgcacacaaggacccaaacgctatttttctctcctttcagcacctgctgagagggaaggacttctggatcgttggcgacaagctgcactgcctctcacagaattactggctctgggcttcagaagtggctgccggtattcagagccaagatagctggtccgcagagcccaacctccaggtgcctggccccaatccaagaattccggagcaggataccaggacccttgagtggaatagttggactctgtcttggacattaactcaggatccacgttcacccggacactttctacgaaatatcaggcacaggcttcccgcaacgcaacctcctgcctggatcttcagttttcccaatcccagctcatactggaccgtgtacgctcttccctcatcaacgcacctggctcacccttgcgggcccgctccaccacccgcatcctag

SEQ ID NO: 2842 - DNA, 1050 bp, Artificial Sequence
  Description of Artificial Sequence: Synthetic coding sequence
atggaactgaccgagctgttactcgtcgttatgttgctcctgacagccaggctgactctcagctcgccggctccgccagcttgtgatctgagagtgctgtctaagctgctgagagactctcacgtcttgcattccagactgtcacagtgcccagaagttcaccctctccccacaccagtcttgttgccggcggttgacttcagcctgggggagtggaagactcagatggaggagacaaaggcccaggatattctgggggctgtgaccctcttgctcgaaggtgtgatggcagcgcgtggtcagctgggcccgacatgtctatcctctctgctcgggcagttgagcggtcaagtgcggctcctactgggtgccctccagtctcttctcggtactcagggaaggacaactgcccacaaggaccctaacgcaatatttctttcttttcagcacttgctgagagggaaagtgcgcttcctaatgctcgtggggggctctaccttgtgcgtgaggcgggctcctccaacaacagccgtgccctctcggacgtccttggtcttgacactcaacgaactgcctaatagaacctcaggactgcttgagactaatttcactgcttccgcccgtaccacagggtccggcctcttgaagtggcagcaaggttttcgggccaaaataccaggactgcttaaccagacgtcacgcagcctagatcagatccctggatacctgaatcggatccatgaacttctcaatggaactcgcggcctttttcccggccccagcagacgaacattgggagccccagacataagttccggcacgagtgacaccggaagtctcccccctaacctgcaacctggctacagcccatccccaacgcacccacctacggggcagtacaccctcttcccactcccacccacacttcccactcccgtcgtgcagctgcaccctctgctgcccgacccatctgcgccaaccccaacaccgacatcacccctgttgaacacgtcctatacccacagccaaaatttatctcaggagggctag

SEQ ID NO: 2843 - DNA, 963 bp, Artificial Sequence
  Description of Artificial Sequence: Synthetic coding sequence
atgcctatgtatcaggttaaaccctatcatggcggtggtgctccactccgggtggaactgccaacttgtatgtatcgtctgcccaacgttcacggtaggtcatacggccccgctcctggagctggacacgtccaggaggagagcaacctaagcctccaggcccttgaaagtcggcaagacgacatacttaagcgcctctatgaactgaaggcggcggtagacggcttgtcgaaaatgatccagacacccgacgccgacctagacgttacaaacatcatacaggcagatgaacctaccaccctcactaccaatgctcttgacctcaattctgttctgggtaaggattacggcgccctcaaggacatcgtcattaacgcaaaccccgctagccccccgctgagtctcctggtactgcaccggctcctctgtgaacacttccgcgtcctgtccactgtgcatacacattcatctgtgaagtctgttcctgaaaacttattgaaatgcttcggcgagcagaataaaaagcagcccaggcaggactatcagttgggcttcactctcatctggaaaaatgtgcctaaaacccagatgaaattcagcattcaaactatgtgtcctatcgagggggagggtaatattgccagatttctgttctccctcttcggccagaagcataatgcagttaatgccactctgattgactcctgggtggacatagcaatcttccagttaaaagagggcagcagcaaagaaaaggcggccgtgttcaggagcatgaatagtgccctaggaaagagcccctggttggctggcaacgagttgacggtcgccgacgtggtgctgtggagcgtgctgcagcagatcggcggttgcagcgtcaccgttcccgccaatgtgcagcgttggatgcgctcatgtgagaacctcgctcctttcaacactgcgctgaagctgttaaagtag

SEQ ID NO: 2844 - DNA, 1068 bp, Artificial Sequence
  Description of Artificial Sequence: Synthetic coding sequence
atggaaaggctgtggggcctctttcaacgggcacagcagctttcaccccgtagcagccagacggtctatcagcgagtagaagggcctcgtaaggggcatctcgaggaggaagaagaagacggagaggaaggcgccgaaacgctcgctcacttttgtcctatggaattgaggggtccagagcccctcggctcccgaccacgtcagccaaatcttatcccttgggctgcagctggacggagggccgccccgtacttggtgctaacagcactcctgatttttacaggagctttcttattgggatatgtggccttccggggatcttgccaggcttgcggagattccgtgttggtcgtctcagaggatgtgaattatgaacccgacctcgactttcaccagggccgcctgtactggtctgacctgcaggccatgttcttacagttcctcggcgagggtaggctcgaggatacgatacggcagacttcactgcgggagagggttgcaggcagcgcaggcatggcagcgctaacccaggacatccgggcggccctcagtagacaaaagcttgatcacgtgtggacggatacgcactatgttggactgcagttccctgatcccgctcatcccaacactttgcactgggtagacgaggctgggaaagtaggcgagcagctgccactggaagatcccgacgtgtactgcccatactccgctataggcaatgtcactggagagctggtgtatgcccattatggaagaccagaggacctgcaggaccttcgggctcgtggagtggaccctgtgggcagattacttctagtcagagtgggcgttatctcttttgctcagaaggaagcacagagaccgtgcggaccacctaggatggcaggcgagccacccagactgcctctgagtccaggacctagggccacaacagcggcaagcggtcagcagagccaggacctgcacccccatcagcagcatctgcgactgcacaggagacccttaagggcccggtccctcagatgccatagaggccctgaaggttgtatgggaccaaggtcctcgtag

SEQ ID NO: 2845 - DNA, 2406 bp, Artificial Sequence
  Description of Artificial Sequence: Synthetic coding sequence
atggaacggctctggggtctatttcaacgggctcaacagctgtctcctcgcagtagccagacagtgtaccaaagggtggaagggcccaggaaagggcacctggaggaggaggaggaagatggagaggagggtgccgaaacattagcgcatttctgtcctatggagctccgcggtccagaaccgctcgggtccagacccaggcagcctaatctgatcccctgggcggcagctggcaggagagccgccccttatcttgtcttgacagctctgctcattttcactggggctttcctgcttggctacgtggcctttcggggctcatgccaggcctgcggggattccgtacttgtggtttcagaggacgttaactatgagccggacctggatttccatcagggaaggctctactggtctgatctgcaagccatgttccttcagtttctcggggaggggcgactagaggatactattcgccagacttctctgagagagagggtcgccggcagtgctggcatggctgccttgacccaggacatacgagccgcgctgtcacgacagaaactagatcacgtttggaccgacacccactacgtcgggttgcagtttcccgaccccgcacatcctaacacccttcattgggtggacgaggcgggaaaggttggggaacagctgcccctggaagatccagacgtctactgtccttactctgctatcgggaatgtgacgggtgaattggtgtacgcccactacggtcgaccagaggacctccaagacctgagagctcgaggcgtggatcccgtcgggcgattgctgcttgtgagggttggcgtgattagcttcgcccagaaggttaccaatgcccaggatttcggggcccagggtgtcctgatctatcccgaacccgccgatttcagtcaggatccccccaaacccagcctctcctcccagcaggcagtgtacggtcacgtacacctcggaacaggcgatccgtacactcctggcttcccctccttcaatcagacacaattcccccctgtggcgtcatctgggctgcctagtatccccgcacaaccgatctccgcagacattgcctctagactgctgagaaagctcaaaggccctgttgccccccaggaatggcagggtagcctgctgggctccccgtaccacctgggccctggtcccaggcttagactagtggtgaataaccatcgcactagcacccctatcaacaatatttttggctgtatagagggcaggtcagaacccgaccattatgttgtcataggggcccagagagacgcatggggccccggcgcagcgaagagtgccgtcggcaccgccatacttctggagctggtccgtacttttagctccatggtgagtaacggcttccggcccaggagatcactcctcttcatctcctgggacggcggcgattttggcagtgtggggagtactgagtggctcgaagggtacctatctgtactacatcttaaagctgtggtgtacgtgtctcttgataacgccgtcttgggcgatgacaagtttcacgccaaaacaagcccactccttacgagcttgattgagtctgttctcaagcaggtggactcacctaaccactctgggcagaccttatatgaacaggtggtattcacgaacccgtcatgggacgccgaggtgatccgccccttgcctatggattcttcagcctacagcttcacggcattcgtcggggttcccgctgtagagttttcatttatggaggacgaccaggcttatccttttctgcatacaaaggaggacacctatgagaacttgcacaaggtactgcaaggacggttacccgcagtggcacaggcggtggctcaattggccggacagctgctgatccgactgtcccacgatagactattgcctttggattttggcagatatggggatgtggtcctgcgccatattgggaacctcaatgaattttcaggggacctgaaggcccgggggctgaccctgcagtgggtctacagcgcgcgaggcgattacataagagcagctgaaaagctgcgccaggagatatactcgtcagaagagagagacgagcgacttaccaggatgtacaacgtgcggattatgcgggtggaattctacttcctttcccaatacgtgtctcccgctgactccccttttagacacatctttatgggaaggggcgatcacactctgggcgccctactggaccatctgcgccttctgagatcaaattcatctggcactcccggcgcaacctcaagcacggggttccaggagtcacgttttaggagacagctcgcgttacttacctggaccctgcaaggggctgcaaatgcccttagtggagacgtctggaacattgacaataatttctag

SEQ ID NO: 2846 - DNA, 1029 bp, Artificial Sequence
  Description of Artificial Sequence: Synthetic coding sequence
atggtatctaacggtttccgccctcgaagaagcctgctcttcatttcatgggacggcggagacttcggctccgtaggctctactgaatggctggaggggtatctgagtgtattgcacttgaaagccgtagtatatgtctccttggacaacgccgtgctcggggatgataagttccacgctaaaacatcccctctactgacgtctttaatcgagagcgtgctgaagcaggtggactctccaaaccattccggccaaactctctacgagcaagtcgtattcaccaacccttcctgggatgccgaggtgatccggccactgccgatggactcaagtgcctattcttttacggcctttgtgggcgttcccgctgtggaattttctttcatggaagatgatcaagcttaccccttcctccataccaaggaggatacctacgagaatctgcacaaagttctgcaggggcgtttgcctgcagtcgctcaggcagttgcacaattagccggccagttactgatccggctgtctcacgacagattactacctctcgattttggacgctatggtgatgtcgttctccgccatataggtaacctcaatgagtttagtggtgatctcaaagctcgcggcctgaccctccagtgggtatactcggcacgaggcgattacatccgggctgcagagaaactgcgtcaggaaatatattccagcgaggaacgggatgagcgattgactcgcatgtataatgtgcgtataatgagggtagagttttacttcctgtctcagtatgtcagccccgcagacagtccattccgccatatctttatgggtcgcggcgaccacactctgggcgcactactggaccatcttcgtttgctgagatccaattcatcaggaacccccggcgctacaagcagcactggttttcaggagtcgaggtttcgtcggcagttggccttgcttacttggactttacaaggcgctgccaacgccctgagcggcgatgtgtggaatatcgacaacaacttttag

SEQ ID NO: 2847 - DNA, 1596 bp, Artificial Sequence
  Description of Artificial Sequence: Synthetic coding sequence
atggccgccaccctggacttaaagtccaaggaggaaaaagacgccgagctagataagcgcatcgaggctctgcgaagaaagaatgaggcgttgattagacggtaccaggagattgaagaggaccggaaaaaggccgagcttgaaggcgtggccgtgacggcccctaggaaggggagaagtgttgagaaggaaaacgtggccgtcgaaagcgaaaagaatctgggacccagccggcggtctcccggcacaccccgcccaccgggcgcgtccaagggaggtcgaactcccccacagcagggtggacgtgcaggtatgggccgagcgagtagaagctgggagggctcccccggcgagcaaccgcgaggtggcggcgcgggagggcggggtcgaagaggaagaggtcgcggaagtccccacttgtctggcgccggcgacacatccattagtgacagaaagtccaaggagtgggaggaacgcaggcgtcagaacatagaaaagatgaacgaggaaatggaaaagattgctgaatacgaacgcaatcaacgggaaggcgtcctggaaccaaatcctgtgcgcaacttccttgatgatcctagacgccgttcaggcccgttggaagaaagtgagcgggatagaagggaggagtccaggcgccacggtcgtaactggggcggccccgacttcgagagggtgagatgcgggctcgaacacgaaaggcaaggaagaagggccggcttaggatcagccggtgacatgacactgtctatgaccggcagagagaggagtgagtatttgaggtggaaacaggagcgagaaaagattgaccaggagaggctgcagcgccatagaaaaccaaccggacagtggcgccgagaatgggatgccgaaaagacagacggcatgttcaaggacgggcccgtgcctgcccatgagccctcccacagatatgacgatcaggcttgggctagaccccccaagccaccaacgtttggtgagtttctgagccagcacaaggcggaggcgtcgagccgtcgaagaaggaagagctcccgccctcaggctaaagccgctcctagggcttactcagatcacgacgatcgctgggaaacaaaagaaggagcagccagtccagcgccagagacgccgcagccgacctccccggaaacatccccaaaggagacgccgatgcaacctcccgaaattcccgctcccgctcacagaccaccggaagacgagggtgaggaaaatgagggtgaagaggatgaggagtgggaagatatatccgaggacgaggaggaagaagagattgaagtggaggagggagatgaggaggagcctgctcaggatcatcaggccccagaggccgcccctaccggaatcccatgtagcgaacaagctcatggcgtgcccttctcaccggaggagccgctgctcgaaccacaggcgccgggaaccccaagcagtccgttctctcctccctctgggcaccagccagtcagcgactggggagaggaagtggagctgaacagccctagaactacacacctggctggggcgctctcccccggggaggcatggccgtttgaaagcgtctag

SEQ ID NO: 2848 - DNA, 1329 bp, Artificial Sequence
  Description of Artificial Sequence: Synthetic coding sequence
atgcattactgcgtcctttcagctttccttatcctgcatttggtgacagtggccctttctctgtctacctgctctactttagacatggatcagtttatgaggaagagaatcgaagccatcagaggtcagattttaagcaagctgaagctcacatcccctccagaggactaccctgaacccgaagaggtgccaccggaagtcatctccatctacaatagcactagggacctgctgcaggaaaaggccagcagacgcgccgctgcgtgtgaaagagagcgctctgatgaggagtactacgccaaggaagtatacaagattgacatgcctccgttttttccttctgagacagtgtgccccgtagtcaccaccccaagtgggagtgtgggatccctgtgcagccgacaatcccaggtgctgtgcggatacctggatgccattcctcctaccttctatcgaccttacttccggatagttcgctttgacgtgtccgctatggagaaaaacgcctcaaacctggtcaaagctgagttccgagttttcagacttcaaaatccaaaagcccgagtgccggaacagaggatcgagttgtaccagatcctgaaatccaaggacctaacaagtcctacacagcggtacatcgattccaaggtcgttaagacccgagctgaaggggagtggctctcttttgacgtgactgacgcggtacacgaatggttgcatcacaaagaccgaaacttaggattcaagattagtctccactgtccctgctgtaccttcgtcccgagcaataactatattatccctaacaaatccgaagaattagaagcccggttcgccggcatcgatggtactagcacctacacgagcggcgaccaaaaaactatcaagagcaccaggaaaaaaaattcgggcaagacaccgcacctgcttctgatgttgctcccctcttatcggctagagagtcagcagaccaaccggcggaagaaacgtgcacttgacgcggcatattgctttcgcaatgtgcaggataattgttgtctccgccccctttacatcgattttaagagagatctcggatggaagtggattcacgaacctaaaggatacaatgctaacttctgtgccggtgcttgtccttacctgtggagttccgacacccagcatagcagggtccttagcctgtataatacaataaacccagaggctagcgccagcccctgctgtgtgagccaagacttggaacctcttactattctttactacatcggcaaaacacctaaaatcgaacaattaagtaacatgattgttaaaagctgcaaatgcagctag

SEQ ID NO: 2849 - DNA, 1245 bp, Artificial Sequence
  Description of Artificial Sequence: Synthetic coding sequence
atgcattattgtgtcctgtcggccttcctcatcctgcatctagtaactgtagcgctaagcctgtctacatgcagcacactggacatggatcagtttatgcgcaaaagaatcgaggccattagaggccagatcctatccaagttaaaactaaccagtccccctgaagactacccggaaccagaggaagtcccacctgaagtcatttccatttataattccactagagatctgctgcaggagaaggcctcaaggcgtgcggccgcctgtgagcgcgagcgaagcgacgaggaatattacgcaaaggaggtttacaagattgatatgccccccttcttccctagtgagaacgccattcccccgacattttacaggccctattttagaattgtgcgtttcgacgtctccgctatggagaaaaatgcgagtaatctcgtgaaagctgagttccgtgtgtttagacttcaaaatcctaaagcacgcgtaccagagcagcgcattgaactgtatcaaattctgaaatctaaagatctgacctccccgactcagagatacattgattctaaagtggtcaaaacacgggcggagggggaatggctcagctttgacgttactgatgctgttcacgagtggctccatcataaggatcgaaatttgggttttaaaatttcactgcactgcccctgttgtacctttgtgccgagcaacaattacatcatccctaataagagcgaagagctagaagcccggtttgcagggattgacggtactagcacatacacctccggggatcagaagacaattaagagtacccggaaaaaaaattcagggaagaccccacacctgctcctcatgctgctcccaagttatcgccttgaaagtcaacagacaaatcgtcgcaaaaaacgggcccttgacgccgcatattgctttcgcaatgtgcaggataattgctgcctgcgacctttgtacatcgattttaagcgggatctgggctggaagtggatccatgaaccaaaaggctacaatgcgaatttctgtgccggtgcatgcccatacctgtggagtagtgatacgcagcactctcgcgttctgagtttgtataacaccatcaaccctgaagcctctgcgagcccttgttgtgtttcccaggatcttgagccccttaccatcctttactatattggcaagactccgaaaattgaacagctatcaaatatgattgtaaagtcttgtaaatgctcgtag

SEQ ID NO: 2850 - DNA, 1239 bp, Artificial Sequence
  Description of Artificial Sequence: Synthetic coding sequence
atgaaaatgcatttgcagcgagcactggtggtactggcgcttctcaacttcgcaactgtgagtctcagcttgagcacatgcacaactcttgacttcggacacattaaaaagaagcgggtggaggcgatccggggacagattctatcaaagctgcgactaactagtccccctgagcccacagtgatgacccacgttccctatcaggtgctagctctctacaacagcactagggagcttcttgaagaaatgcacggcgaaagagaggaagggtgcactcaagagaacactgagtccgagtactacgcgaaggaaatacacaaattcgatatgatccagggtctcgctgagcataacgagctggccgtgtgcccgaaggggattacatccaaagtcttccgatttaatgtgagtagcgttgagaagaatcggactaatctttttagggcagaattccgcgtgctccgtgtacccaacccatcttctaaacgaaatgaacagcgaatcgaactctttcagattttgcgccctgatgagcacatagctaaacaaaggtacatcggaggcaagaatctaccgaccagaggaactgccgaatggcttagcttcgacgttactgatacagtaagagagtggctgctccggagagaaagtaacctcggtcttgagatctcaattcattgcccatgccacacttttcagcccaacggtgatatacttgaaaatattcacgaggtcatggagattaaattcaaaggggtggataacgaggatgaccatggtcgcggggatctggggcgacttaagaagcagaaagatcatcacaatccacacctgatcctgatgatgatccccccccatcggctagataacccagggcaggggggacagagaaagaagcgggccctggacaccaattattgtttcagaaacttagaggaaaattgctgcgtacggccattgtatatcgatttcaggcaggacctggggtggaagtgggtacacgagcccaagggatactacgcgaacttctgctccggcccttgtccctatcttcgttccgccgatactactcacagcacagtgctggggctttataatacccttaaccccgaggcctccgcttcaccctgctgcgtgcctcaggacctggaaccgctgactatcttgtactatgtagggagaacacccaaggtggagcagttgtctaacatggttgtcaagagctgtaaatgctcttag

SEQ ID NO: 2851 - DNA, 930 bp, Artificial Sequence
  Description of Artificial Sequence: Synthetic coding sequence
atgaagatgcacctgcagcgtgcgttggtggtgctggcactgcttaattttgcaaccgtatctcttagcctctctacctgtacgaccttggattttggtcatataaagaagaagagagttgaagcgattagaggacagatcttaagtaagctgagattaacaagtccgcctgaaccgaccgtcatgacccatgttccgtatcaggttttggctttgtacaatagtaccagagagctgttagaagagatgcatggagagcgcgaggaaggttgcactcaggaaaacactgaaagcgaatattacgcaaaggagatacacaagtttgacatgatccaggggctggccgagcataacgagctcgcagtctgcccaaaaggcatcacatccaaggtatttcggtttaatgtctcctccgtcgaaaaaaaccgaactaacctgtttagagccgagttccgtgtactgcgcgttcctaatccctctagcaaaaggaacgaacagcgaattgaattgtttcagatactgcggccggatgaacatatagcgaaacagcggtatattggcgggaagaatcttcccacgcgaggcaccgccgagtggctgtcctttgacgttactgataccgttcgggaatggctcctgcgccgcgagagtaacctggggttagaaatctctatccactgcccgtgtcatactttccaacccaatggcgatattttagagaacattcatgaggtgatggagatcaagtttaagggagtcgataatgaggatgaccacgggcggggtgaccttggacgacttaaaaagcagaaagaccaccacaacccccatctgatattgatgatgattccgcctcaccggctggacaacccggggcaagggggacaacgcaagaagagggcactggacaccaattactgcttcagatag

SEQ ID NO: 2852 - DNA, 444 bp, Artificial Sequence
  Description of Artificial Sequence: Synthetic coding sequence
atggccagtcataggcttctgctgttgtgtctggccgggctggtgtttgtttctgaggctgggcctacaggaactggggagagtaagtgcccattgatggtgaaagtgttggatgctgtgcgcggctcccccgccatcaatgtggctgtccatgttttccgcaaggccgccgatgacacgtgggagccatttgcttccggcaaaacttcagagagtggcgagctgcacgggctcactactgaggaagaattcgtcgagggaatttataaagtggaaatcgacactaagtcgtattggaaagccttaggcatttccccattccacgagcatgcagaagtcgttttcaccgccaatgactccggccccaggcgctacacaatagcggcattattatccccgtactcgtacagcaccactgccgtggtgaccaaccctaaggagtag

SEQ ID NO: 2853 - DNA, 555 bp, Artificial Sequence
  Description of Artificial Sequence: Synthetic coding sequence
atggcgagccataggctactgctgctttgtctggcgggactggtcttcgtttcggaagccgggccaactggtaccggcgagtccaagtgtcctctgatggtaaaagtgctagatgcggtcaggggctctcccgctattaatgtggctgtgcatgttttccggaaagccgcagatgacacctgggagcccttcgccagcgggaagacctcggaatccggggagctccatggtctaacaaccgaagaggagttcgtggaggggatctataaagtggaaatcgatactaaatcttattggaaagctctaggaattagcccgttccacgaacacgcagaagtgtcaatccagacattcgaggcttttcaggaaatcctgtacaagaagaaatttaccacactgtggcattggaccagcggcggccagtcattcttcagggctcttgtggaagtggttttcacggcgaatgactccggtccccgtagatatacaattgcggcgcttcttagtccctatagctatagcaccactgctgtggttaccaatcctaaggagtag

SEQ ID NO: 2854 - DNA, 420 bp, Artificial Sequence
  Description of Artificial Sequence: Synthetic coding sequence
atggcttcccaccggttgcttctgttgtgcctcgctggactggtatttgtgagtgaggctggtcctactgggacaggcgaaagtaaatgtcctctgatggttaaggttctcgatgccgtgcgtggctcgcccgcaatcaatgtggctgtgcatgtatttaggaaggctgctgacgatacatgggagccgtttgccagcggcaagacttctgagtcaggggaactgcacgggttaactacagaagaggaattcgtagaaggaatctacaaagtcgagatcgacaccaaatcctattggaaggctttgggcatctctccgtttcacgagcatgcggaggtggtgttcaccgccaatgatagcggaccacgtcggtactacagttactccaccaccgcagtggtgacgaacccaaaggaatag

SEQ ID NO: 2855 - DNA, 996 bp, Artificial Sequence
  Description of Artificial Sequence: Synthetic coding sequence
atgaacggcacacgcaactggtgcaccctcgtagacgtgcaccccgaagatcaagccgcggtctatctcaaggggagatctggagataaaatgattcacgaaaagaacattaaccagttgaaatctgaggttcagtatatccaggaggcccggaactgcctgcagaaacttagagaagatatctcatccaaactcgaccgaaacctgggagacagtctgcatcggcaagagattcaggttgtcctggagaagccaaatggtttctcacagagcccaacagcactctacagctcccccccagaggtagatacatgcatcaacgaagacgttgagtcactgcggaaaaccgtgcaggacctgttagcgaagctgcaagaagctaagaggcagcaccaatctgactgtgttgcattcgaggtgaccctgtcgcggtatcagcgagaagccgagcagtctaacgtggcacttcagagggaagaggatagggtggagcagaaggaagcagaggtcggagagttacagagaagactgctgggcatggagaccgaacatcaggctttactcgcaaaggtgagggagggggaggtagcacttgaagaacttcgctccaacaatgctgattgccaggccgagcgcgagaaggccgcaacccttgaaaaagaggtcgctggtctgagggaaaagattcatcacctggacgatatgctgaaaagccaacagcgaaaggtgcgacagatgattgaacaactccagaactcaaaagccgttattcagtccaaggacgcgacgattcaggaattgaaagaaaagattgcatatttggaagcagagaatttggagatgcatgatcggatggagcacctaatcgaaaaacagatcagtcatgggaatttttccacacaggccagggccaaaacagagaacccaggttcaatcaggatttctaagccaccttcacccaaacccatgcccgtcatccgtgtagtcgagacgtag

SEQ ID NO: 2856 - DNA, 1098 bp, Artificial Sequence
  Description of Artificial Sequence: Synthetic coding sequence
atgaacgggactcgcaattggtgcacgctcgtcgacgtgcacccagaggaccaagcagccgccgggcgtaaaacctatgctatggtctccagccactctgcaggacattccttagccagcgagctcgtagagtctcacgacgggcatgaggagatcatcaaagtatacctgaagggtagatcaggcgataaaatgatccatgaaaagaacattaatcagctgaaatctgaagtgcagtacatccaggaagctcgaaactgcttacagaaacttagagaagacattagctccaaactcgatcgcaatttaggcgatagtctacacaggcaggagatacaagttgtgttggagaagccaaatggcttctcccagagccctacggctctctacagctccccacctgaagtggacacctgcattaatgaggatgtcgaatccttgcggaagacagtgcaggacctcctggctaaattgcaagaagctaagaggcagcatcaatctgattgcgttgcctttgaggtgaccctgtccagatatcagcgcgaggcagagcaaagcaatgtggctcttcagcgggaagaagatcgggtcgagcagaaagaggccgaagtgggagaactgcagcggcgacttttaggaatggagactgagcatcaggctttgctcgctaaagtacgggaaggagaagtggccctcgaagagcttaggtcaaataatgctgattgtcaagcagaaagggaaaaagccgccaccctggagaaagaggtggctggcctccgtgaaaagatacaccacttggacgatatgctgaagtctcagcagcggaaagtgcggcagatgatagaacagttgcaaaatagcaaagccgtaattcagagcaaggatgccacaattcaagagctaaaggaaaaaatagcctatctggaagcagagaatctcgaaatgcatgatcgtatggaacacctgattgagaagcagattagtcatggcaactttagtacccaggcccgggctaagaccgaaaacccagggtcaatccgcataagcaagcccccctcgcctaaaccaatgccagtgatcagggtggttgagacttag

SEQ ID NO: 2857 - DNA, 1173 bp, Artificial Sequence
  Description of Artificial Sequence: Synthetic coding sequence
atgaacggaacacgtaactggtgcaccctggtcgacgtgcatcccgaagaccaggctgcagggagcgtagacatcctgcgacttaccttgcagggcgagctcaccggtgatgagctcgagcacattgcacaaaaggcgggtcgcaaaacctacgccatggtttcgagccacagtgctggacactcactcgcgagcgagctcgttgaatcccacgatggacacgaggagattatcaaagtgtacctgaagggcagaagtggcgacaaaatgatccacgagaaaaacatcaaccagctgaagagcgaggtgcagtatattcaggaagcccggaattgtttacaaaagttgcgcgaggacatcagctctaagctggaccgtaacttgggcgattctttacacagacaggagattcaggttgtcctcgaaaagcccaacggcttctcccagagcccaacagctctgtactcctccccccccgaagtcgacacctgtattaatgaggacgtggaaagtcttaggaaaaccgttcaggatcttctcgccaagttgcaagaggcaaagcgtcaacaccagagtgactgcgtggccttcgaggtgacactttcacgatatcaacgcgaggccgagcagtccaatgtggcgctgcagcgggaggaggacagagtcgagcagaaagaggcggaagtgggtgagctccagagaaggcttttgggtatggaaacagaacatcaggccctcctggccaaagtccgtgaaggagaagttgctctcgaggagttaagaagcaataacgctgactgccaggcagaacgagagaaggccgccactctggagaaggaagttgcggggttgcgggagaaaatccaccacctggacgatatgctcaaatcccagcagcgcaaagtgcgccagatgatcgaacaactccagaattctaaagccgtcattcaaagcaaggacgcaacaatccaggagctgaaagagaagatcgcatacctggaagcggaaaatctggagatgcacgatagaatggagcatttaattgaaaagcagatctctcacggaaatttcagcacacaagcacgagctaagactgagaacccaggtagcatccgaatttcaaaaccaccctcccccaaacccatgccagtgattcgtgtggtggaaacttag

SEQ ID NO: 2858 - DNA, 600 bp, Artificial Sequence
  Description of Artificial Sequence: Synthetic coding sequence
atgaatggcaccagaaactggtgcaccttggttgatgtccatcccgaggaccaggccgcagccggtcgcaaaacctatgccatggtcagcagccatagcgcagggcacagtctggcgagtgagctggtggagtcccatgatggccacgaagaaatcattaaagtttacctgaagggcagaagtggagataaaatgatccacgaaaagaatatcaaccagctcaagagcgaggtacagtacatacaggaagctagaaattgcttgcagaaactgagggaagacatttccagcaagcttgatcgtaatctcggggactctctccaccgccaagaaatccaggtggttctggagaaacctaacgggtttagtcaatcccctacggctctttattcatccccccctgaggtcgatacatgtatcaacgaggacgttgagagcttgcggaaaacagtccaggatctcctggccaagctccaggaggccaagcgtcagcaccaaagcgactgtgtggcgtttgaggttactctttcccggtatcagcgggaagctgagcagagcaatgtggctctgcagcgggaggaggatcgttgtccagaatag

SEQ ID NO: 2859 - DNA, 1230 bp, Artificial Sequence
  Description of Artificial Sequence: Synthetic coding sequence
atgtcttcccctggtatgacgtccctgcagctggagaaggaggaatgtatgcaatgtgtgccctgcagcccaagaacaagagttgctctgttggagttgtaccgcgcaatgtgccagggatctgttgacatcctaagactgactttgcaaggagaattgacgggagatgaactggaacacatcgcacagaaggccggacgcaagacgtatgctatggttagctcacacagtgctggccattcgcttgcgagtgagctggtcgaatcacacgatggccatgaggagataatcaaagtctaccttaagggccgcagcggcgataaaatgatccacgagaagaacatcaaccagctgaagtcagaggtccagtatatacaggaagcgcgcaactgtcttcagaagctgagagaggacatttcctcaaaactggatagaaatctcggagattctctgcatagacaagaaatacaagtcgttcttgaaaaacccaatggcttctctcagtcaccgactgccctttacagctctccacccgaggtggatacctgtattaacgaggatgtggagtctctaagaaaaaccgtgcaggatctgctagcgaaattacaagaagcgaagaggcagcaccagtccgactgcgtggccttcgaagtgacgctgtccaggtaccaacgtgaggccgagcagtctaacgtcgctctgcaacgggaagaagatagagtcgaacagaaggaagccgaggtcggcgagcttcaaagacggctcttgggcatggagacagaacatcaggctcttctggcaaaagtccgcgagggagaagtcgcactcgaagagttgcggtctaacaatgccgattgccaagccgagcgggagaaagccgctacactcgagaaggaggtcgctggactgcgagagaagatccaccacttagatgacatgctgaaaagtcaacaaaggaaggtccgccagatgattgagcagctccagaattcaaaagccgtgatccaaagcaaggacgcgaccatccaagaactgaaggaaaagatagcgtatttggaggcggagaaccttgaaatgcacgataggatggaacacctgatcgaaaaacagatcagtcatgggaattttagcactcaggccagggccaagaccgagaatcccggatctatccggatctccaaacctccttcacccaagccaatgcctgtcatccgggtcgtggagacatag

SEQ ID NO: 2860 - DNA, 543 bp, Artificial Sequence
  Description of Artificial Sequence: Synthetic coding sequence
atgaatggtactagaaattggtgcacgctggtcgatgtgcatcccgaggaccaggctgctgccggacggaagacctacgcaatggtgtcttcccattccgccggacactccctggcctctgaattggtggaatctcacgatggccacgaggaaatcatcaaggtttatctgaaaggaaggagtggcgataagatgatccatgaaaagaacatcaaccagttaaagtccgaggtgcagtacatccaggaggcccgcaattgcctccaaaaattgcgcgaggacatatctagtaagttagacaggaacttgggggattctttgcataggcaggagattcaggttgtgcttgaaaaacccaacggtttttcccaaagcccaaccgcactgaaggctggcgatactgacgtccaatccgattggagaatgagctgggggaatgaggttccttctaccaacacggcgcagtttctcgcaacaaactgtctgttcttctatcttcttcatctccagcctacgctcccatggccgcccgctgacaggtag

SEQ ID NO: 2861 - DNA, 1182 bp, Artificial Sequence
  Description of Artificial Sequence: Synthetic coding sequence
atggaggagcctcagtccgatccttcggtggagcctcctctgagtcaggagacattcagcgacctttggaaattgcttcctgaaaacaatgtgctatcacccctgccttcgcaggctatggatgacctgatgttgtctccagatgatatcgagcagtggtttacggaagaccccggcccagatgaagcacccagaatgcctgaggcagctccgccggtagcccccgcccccgcagctcctacaccagctgccccagcacctgcaccttcttggccgctctcctccagcgtcccctcacagaagacttaccagggcagctacggattcaggctgggtttcttgcactctgggacagccaagagtgtgacttgtacatactctccagccctcaataagatgttttgtcagctggcaaaaacttgccccgttcagctgtgggtggactcgactccacccccaggcacacgagtacgagccatggctatatacaaacagtcccaacatatgacggaggtagtgcgcaggtgtcctcatcatgaaaggtgctctgacagtgacggtctggcacctcctcaacacctgattcgagtcgaaggcaaccttagggtggagtatcttgacgataggaatacttttcgccactctgtcgtagtgccctacgaaccgcctgaagtgggcagcgattgtaccacgatccactacaactatatgtgcaatagttcttgcatggggggtatgaaccggcgtcccatcctcacgattataactctcgaggattccagcggaaaccttctaggccgcaactctttcgaggtgcgagtgtgtgcatgccccggtcgggatcggaggacagaggaggagaatcttcggaaaaagggtgagcctcaccatgagttgccaccaggcagcaccaagcgagccctccctaataatacttcctctagcccacagcctaaaaaaaagcccttagacggcgagtattttactttgcagattcggggacgagaacggtttgagatgttcagagagttaaatgaggctcttgagttgaaggatgcacaggcaggcaaagagcccggcggatcacgcgcacactcctcacacctgaagtcaaagaaggggcagtctacctctaggcataaaaaactgatgtttaaaaccgaaggtcccgatagcgattag

SEQ ID NO: 2862 - DNA, 1032 bp, Artificial Sequence
  Description of Artificial Sequence: Synthetic coding sequence
atggaggagccccaatctgacccgtctgttgagcctccgttgtcacaggaaaccttctccgacctctggaagctgctgcccgaaaacaatgtgctcagcccactcccttcccaagcaatggatgacctaatgttgtctcccgatgacatcgaacagtggtttacagaagaccccggccccgatgaagcccctcggatgcccgaggccgctccccccgttgctcccgcccctgccgcacccaccccggccgctcccgcacctgccccatcttggcctctgtcaagttccgtcccttcacagaagacatatcagggctcctacgggtttcggctgggttttctgcacagcggcacagctaaaagcgttacctgtacttactctccagccctcaacaaaatgttctgtcagctcgccaagacatgtcccgttcaattgtgggtggactcaacccccccgccaggaacaagggtgagagccatggctatctataaacagagccagcacatgaccgaggtggtgagacgctgtccccatcatgagcgctgtagcgattccgatgggcttgctcccccacagcacctcatccgtgttgaggggaacctcagagtggaatatctggatgaccgaaatacgttccggcatagtgtggtcgtgccttacgagccacccgaggttggatcagactgtaccacaatccattacaactatatgtgtaatagtagctgcatgggcggaatgaatagaaggcctatcctaaccatcattaccctggaggactctagtggcaacttgctcgggagaaactctttcgaggttcgggtctgtgcttgccctgggcgggacaggaggacggaggaagagaatctgcggaagaagggtgagccccatcatgagctccctccaggcagcaccaaacgcgcgcttcctaacaatacctccagcagcccacagcctaaaaagaaacctctggatggagagtactttactcttcagaaaacattccctgccaggcacgggggctcgcacctttag

SEQ ID NO: 2863 - DNA, 1149 bp, Artificial Sequence
  Description of Artificial Sequence: Synthetic coding sequence
atggaggagccgcagtcggacccgtctgtcgaaccaccactgagccaggagacatttagtgatctgtggaaacttctgccagagaataacgtcctgtcccccttaccctctcaggcaatggacgatctcatgttgtccccagatgacatcgaacagtggttcacggaagatcccgggccggacgaagcgcctcgaatgcccgaggctgctccacctgtggctccagctcccgctgctcccacacctgcagccccagcacccgctcctagttggcccctatcgtcttccgtgccttcacagaagacataccagggatcctacgggtttcgcctgacatgtacctattctcctgccctgaacaaaatgttttgtcagctggcaaagacctgtcccgtgcaactctgggtggacagcactcctccccctggtacccgagtgcgagcaatggctatctacaaacagagtcagcatatgaccgaggtggtgagaagatgtccccaccacgagcgctgctcggactcagatggacttgccccaccccagcatcttatccgtgtggaaggcaacctgagagtggagtacttggacgacagaaacacgttccggcactcggtagtggtcccctacgaaccgcccgaggtcgggtccgactgtacaaccatccactacaactacatgtgtaacagttcttgtatgggaggcatgaatcgaagacccatcctcaccattattactctggaagattcctccggtaatctccttggaaggaactcgtttgaggtacgggtgtgcgcctgccctggccgggacagaaggactgaggaagagaacctgagaaagaaaggcgaaccccatcatgaacttcctccaggttctacaaagagggctttgcctaacaatacttcgtcatccccacagcctaaaaagaagccccttgacggcgagtactttacccttcagattcgcggacgagagcgctttgaaatgtttcgagaactgaacgaggccctcgaacttaaggacgcacaggccggcaaagaacccggaggctctcgtgctcactcaagccatcttaaaagcaagaagggacaaagtacaagtagacacaagaagctgatgttcaaaactgagggacccgactctgactag

SEQ ID NO: 2864 - DNA, 858 bp, Artificial Sequence
  Description of Artificial Sequence: Synthetic coding sequence
atggaagaaccgcagagtgacccaagtgttgaacctcccctgtcccaggagaccttctccgacctctggaagctcctccccgagaataatgtgctttcccccttaccctcccaggccatggacgatctcatgctgagcccagatgatattgagcagtggttcaccgaggatccggggccagatgaggctcctcgtatgcctgaagctgcccccccagttgcgcccgcccccgcagcacccacccccgcagcacccgctccggcacccagttggcctctgtccagctctgtgccaagccagaagacctaccaggggtcttacggcttcagactcggttttctccattcagggaccgctaaatcagtcacatgtacttactcaccagctttgaataaaatgttttgccagttagcaaagacctgtcccgttcagttgtgggtagatagcacaccccccccaggcacaagggttcgagccatggcgatttacaagcagtcgcagcacatgacggaggtggtgcggcggtgtccccaccacgagaggtgcagcgactccgacgggttggctcctccacagcacctgattcgcgtggagggaaatctgcgcgtggaatacctggacgatcggaatactttcaggcattctgtagtggtgccctatgagccaccagaggtgggctctgattgcaccaccattcactacaactacatgtgtaattcatcctgtatgggagggatgaacagaagacctatcctgactataatcacacttgaagatagtcgtccacgacaggtcgaccacctgagaagcggggtgcaagattcactagccaacattgcaaaaagccatctgtactag

SEQ ID NO: 2865 - DNA, 273 bp, Artificial Sequence
  Description of Artificial Sequence: Synthetic coding sequence
atgttttgtcagttggctaagacttgcccagtccagctctgggtggactccacccctccacctggaacccgcgtgagagccatggccatttataaacaaagccagcatatgacagaggttgtgcgtagatgcccccatcacgaaaggtgctccgactccgacgggctcgctccgcctcagcacctgatcagagtggaaggcaatctgagggtggaatatctggacgaccggaacacctttcggcatagcgtggtgtctggtcggagggggtag

SEQ ID NO: 2866 - DNA, 135 bp, Artificial Sequence
  Description of Artificial Sequence: Synthetic coding sequence
ccactgccttctcaaaggagaaatcattggatggaaaatatttctcctttctcacacttaaagtccaagaaaggccaatccacgtcccgccataaaaagctgatgtttaagaccgaaggccccgacagtgattag

SEQ ID NO: 2867 - DNA, 1026 bp, Artificial Sequence
  Description of Artificial Sequence: Synthetic coding sequence
atggaggagccgcagtctgatccctccgtcgagcctcctctatcccaggagaccttcagtgacctgtggaagctgctacctgaaaacaatgttcttagccctctgccaagccaagctatggatgacctcatgctcagtcccgatgacattgaacagtggtttacagaggatccgggacccgacgaggctccccgcatgcctgaagctgcacctcccgtcgctcccgcccccgccgcccccactcccgccgcgccggctcccgccccttcttggccgctgagctcatctgtgcccagtcaaaagacataccaaggaagctatgggttcagactcggcttcttgcatagcggaaccgcaaaatctgtgacctgtacatacagcccagctctgaacaagatgttttgtcagttggccaaaacctgtcccgtgcagctgtgggttgactccactcccccgcctggtacccgagtccgcgccatggctatttacaagcagtcgcagcacatgaccgaagttgtacggcggtgccctcatcacgagcgctgctctgactccgacgggctggccccaccccagcaccttattagagtggaaggaaatttacgcgtcgaatacctggatgacagaaacacgttccgccactcggtcgttgtgccttatgagccacccgaggttggtagcgattgcacaaccatccattacaattacatgtgcaacagttcttgtatgggaggtatgaacagaagacctatcttgacaatcattactctggaggattcgtctggcaacctgctggggcgcaattcttttgaagtccgggtctgcgcctgcccgggcagggacagacgcaccgaagaagaaaacctgcgcaagaagggcgaacctcaccacgaactgcctcccggaagcacaaaaagggcactgcctaacaataccagcagctctccccagccaaagaagaagccacttgacggcgagtacttcacgttgcaggatcagacgtcctttcagaaggagaattgttag

SEQ ID NO: 2868 - DNA, 1182 bp, Artificial Sequence
  Description of Artificial Sequence: Synthetic coding sequence
atggaggagccccagagtgatccttcagtcgaacctcccctaagccaggagacctttagcgatttatggaagctccttcctgagaataacgtactttcgccattaccgtctcaggccatggatgatcttatgcttagcccagacgatatcgagcagtggttcactgaggatcccggcccggatgaagccccacgtatgccagaagccgctccccccgtcgcccctgcacctgccgcccccaccccagcagctcccgcacccgcgccctcctggccgctgtcctccagtgtcccatctcaaaagacttaccaagggagctacgggttcagactgggctttctgcattccgggactgcaaagtctgtgacatgtacttattcccccgctctgaataagatgttttgtcagcttgccaagacttgcccagtgcagctctgggttgatagcaccccccctcccggaactcgggtgagagcgatggctatttataagcagagccagcacatgactgaagtcgtgcgcagatgtccgcatcatgagcgctgctcagacagtgatggcctggctcctcctcaacatctgatccgtgtggaaggtaacctgagggtggagtatctggacgaccgcaacacatttcggcatagcgtggtggtcccatatgagccacctgaggtgggcagcgactgcactaccatacactacaactatatgtgcaattcctcttgcatgggaggtatgaaccgccgcccgatcctgacaataatcaccctcgaggactcttccgggaacctgcttggccgcaactcctttgaagtgcgcgtgtgcgcatgcccgggcagggacaggcggacagaggaagaaaacttacgaaaaaagggggagccacaccacgagttaccaccaggtagcaccaaaagagcactgccaaacaacacgtcctccagcccgcagcccaagaagaaaccactcgacggggagtattttaccctccagattagaggccgagagagattcgaaatgttccgagaactaaacgaggcactcgagctgaaagacgcacaggccgggaaagagcctggcggatctcgagcccactcatctcacctgaaaagcaaaaaaggtcagagcacttctcgacataaaaagttaatgtttaagacagagggtcctgatagcgattag

SEQ ID NO: 2869 - DNA, 1041 bp, Artificial Sequence
  Description of Artificial Sequence: Synthetic coding sequence
atggaagaaccacagtccgatccctctgtggaaccacccctgtcccaggaaaccttcagcgacctttggaagctcttgcccgagaataacgtactctcacctcttccctcacaggccatggacgacttaatgttgtcccctgacgacatagagcagtggttcaccgaggatcctggacctgacgaagctcctcgaatgcccgaggcggcgccaccagtggccccagccccagcagcacccactcccgccgcccccgctcctgcaccatcgtggccactgtcgagcagcgtaccctctcagaaaacctaccagggatcgtacggattccgcctgggatttctccacagcggcaccgccaaatctgtgacgtgtacctactccccagcattgaataagatgttctgccagcttgcgaagacctgtccagtgcagttatgggtcgacagcacacctcccccagggacacgtgtgcgagctatggctatatacaagcaaagccaacacatgacagaggtcgtgagacggtgtccacaccatgagcggtgttcagactccgacggacttgcacccccccagcacctcatcagggtcgagggtaacctgcgcgttgagtacttggacgataggaacaccttccggcactctgtcgttgtaccttatgaacccccagaagtgggcagcgactgtactactatccactacaattatatgtgtaatagctcatgcatgggcgggatgaatagaaggcctatcctaactatcattacgttggaggatagcagcggaaacttacttggaagaaattctttcgaggtgagagtgtgcgcctgccccggccgggacagaaggactgaggaagagaatctccgcaaaaaaggtgagccccatcatgaattaccacctgggagcaccaaacgggcactcccaaacaacacctcatcatcacctcagcccaagaaaaagcccctcgacggggagtacttcaccctgcagatgctcctggatctccggtggtgttatttcctcatcaattcgagttag

SEQ ID NO: 2870 - DNA, 387 bp, Artificial Sequence
  Description of Artificial Sequence: Synthetic coding sequence
atggaggagccacagtcagacccctcggtagaaccacccctgtcccaggagaccttttcagacctctggaaactattacccgaaaataatgtgctgtcaccattgccatcacaagccatggatgatctcatgctctcccctgacgatattgagcaatggttcaccgaggaccccgggcctgatgaggccccccggatgccagaggctgcgccaccggtcgcacctgctccagctgcaccaactcctgcggccccagctcccgccccaagctggccactaagcagcagcgttccgtcccagaagacctaccaggggtcctacgggttccgccttggcttcctgcatagcggaaccgctaagagcgtcacatgtacgtatagcccttag

SEQ ID NO: 2871 - DNA, 498 bp, Artificial Sequence
  Description of Artificial Sequence: Synthetic coding sequence
atggaggagccccaaagcgatccatcagttgaacccccactatcccaagaaactttctcagacctgtggaagctgttgcctgagaataacgttctgtcccccctaccttcccaagccatggatgacctgatgttgagtccagacgacatcgaacaatggttcactgaagacccaggacctgatgaggcacctaggatgccggaggccgcaccccccgtggcccctgccccggccgcccccacgcccgctgcccctgcccctgcccccagctggccattaagtagctccgtgccatcgcagaaaacttatcagggaagctatgggtttcggctgggtttcctgcatagcggcacagccaaaagcgtgacctgtacctactccccggcccttaacaaaatgttttgccagcttgctaaaacatgtccggtccagttgtgggtcgacagcactccacctcccggcacacgtgtgcgcgcaatggctatttacaagcaatag

SEQ ID NO: 2872 - DNA, 600 bp, Artificial Sequence
  Description of Artificial Sequence: Synthetic coding sequence
atgttctgccaacttgccaagacctgccctgtgcaactttgggtggacagcactccgcctccggggactagggtgagggcgatggccatctataagcaatctcaacatatgaccgaggtcgttcggcggtgcccccaccatgaacggtgctccgactcagacggccttgcccctcctcagcatctgatccgggtggagggaaacctgagggtggaatatttagacgaccggaacactttccggcacagcgttgttgtcccctatgaaccacccgaagtcggcagtgattgcacaacaattcactataactatatgtgtaatagttcttgtatggggggtatgaaccgaagacccatcttgacaatcatcacactggaggactcctcaggaaaccttctggggcgtaactcattcgaggtccgagtgtgcgcctgtcccgggcgcgatcgtaggactgaagaggagaatcttcggaaaaaaggcgaaccgcaccacgaattgccaccagggagcaccaaaagggcattaccaaacaataccagcagttccccccaacccaagaagaaaccactggacggcgagtattttaccctgcagtag

SEQ ID NO: 2873 - DNA, 468 bp, Artificial Sequence
  Description of Artificial Sequence: Synthetic coding sequence
atggaagagccccaaagtgacccctcagtggagccacccctcagtcaggagaccttctctgacctgtggaagctgctcccagagaacaatgtgctctatagcccagctctgaataagatgttctgccagctcgctaagacatgtcctgtccaactgtgggtcgactccacaccccctccaggcaccagggtgcgggcaatggcaatttataagcagtctcagcatatgacggaggtggtccgaaggtgccctcaccacgagaggtgttcagacagtgatggattagccccaccacagcacctgattcgggtcgaaggaaatctgcgggtcgagtacctagacgacaggaacacatttaggcacagcgttgtggtgccatacgagcctcctgaagttggctccgattgtacaaccattcattataattacatgtgcaatagctcttgcatgggaggcatgaatcgctag

SEQ ID NO: 2874 - DNA, 468 bp, Artificial Sequence
  Description of Artificial Sequence: Synthetic coding sequence
atggaggagccacagagtgatccttccgtggaacccccactgagtcaggaaaccttcagtgacctatggaagcttcttccagagaataatgttctctacagccctgccctcaacaaaatgttctgtcaactggctaagacctgtcctgtccagctttgggtggactcaacacccccgccaggtacaagagtgcgggctatggcgatctacaagcagtctcagcacatgacagaggtggtaaggcgatgtccgcaccacgagcgctgctccgattcagacggactagcccctccacaacatctgattcgcgtcgaaggtaacttgcgagtcgagtacctagacgatcggaacacctttaggcactccgtcgtggttccttacgaaccgccggaagtgggctctgactgtaccacaatccattacaactatatgtgcaactcgagctgcatgggcggcatgaatcgttag

SEQ ID NO: 2875 - DNA, 1590 bp, Artificial Sequence
  Description of Artificial Sequence: Synthetic coding sequence
atgctactggcagtgctgtattgcttactctggagtttccaaacatcagctggccatttcccaagagcctgtgtctcttcgaaaaacttgatggaaaaggagtgctgccctccctggagcggagaccgctctccctgcggccagctgagcggccgcgggtcatgtcagaatatcttactgagtaacgcaccactcggtccccaattccccttcactggagtggacgatagagaatcttggccatctgtcttttacaatagaacctgtcagtgctctggaaattttatgggtttcaactgcggaaactgcaagttcgggttctggggccctaattgtaccgaacggaggctgctggttcggaggaatatctttgatctcagtgctcctgagaaggacaagttcttcgcctacctgacgctcgcaaaacatactatttctagcgactatgtcatcccaattggtacatacggccagatgaaaaatggctcaacccctatgtttaatgatataaatatttacgatttatttgtgtggatgcactactatgtcagcatggacgccctactggggggctcggaaatctggagggacattgattttgctcatgaggctccggcttttttaccttggcatcgcctcttccttctccgctgggaacaagaaatacagaaattgacaggggacgagaatttcaccataccctactgggactggcgggacgctgagaaatgtgacatctgcacggatgaatacatgggcggccagcaccccaccaatcccaatctcctgtcgcccgcatctttttttagttcttggcagatagtgtgtagtcggcttgaggagtacaacagccaccaatcactctgcaatggtacacctgagggccccctgcgcagaaacccaggcaatcacgacaaatccagaacaccacggttgccttcttctgccgatgtggaattttgtctgtccctcactcagtatgaatcgggaagcatggataaagcggccaacttttcttttagaaacaccttagagggcttcgctagcccactgacaggaatcgccgatgcatcccaatcatccatgcacaatgctttacatatttatatgaacggaacaatgtcgcaggtgcaggggtctgctaacgaccctattttcttgctacaccacgcgtttgtggattccatcttcgaacagtggttgagaagacacagaccactgcaggaggtctatcccgaagccaacgcgcctatagggcataacagggaatcatacatggtgccgttcattcctctttataggaacggggatttcttcataagtagtaaggatcttggttatgactacagctacctgcaggactctgatcctgattcgttccaggattacatcaaaagttacctggaacaagccagccgcatctggtcctggctgcttggcgccgcaatggttggggccgtccttactgccttgctggcaggacttgtcagcctgctctgtagacataagcgcaaacagctcccagaagagaagcagcccctcctgatggaaaaagaggattaccactcactctaccagagccacctgtag

SEQ ID NO: 2876 - DNA, 1365 bp, Artificial Sequence
  Description of Artificial Sequence: Synthetic coding sequence
atggatccctacatgattcaaatgtctagcaagggcaacctccctagcattttggacgtacatgtgaatgtgggcggtagatctagcgtgccagggaagatgaaagggagaaaagcacgttggagcgtgcgaccgtcggacatggccaaaaagacgttcaacccaatccgagctatcgtggataatatgaaagttaaacccaatcccaacaagacaatgatatccctgtcaattggggatcccacggtgttcgggaacctgcccaccgatccagaagtgacacaagcgatgaaggatgccctggattcaggcaaatacaacggctacgcccctagcatcggcttcctgtcatctcgagaggagattgcctcctactaccactgcccagaggccccactcgaagccaaagatgtgattctcacctccggatgttctcaggccattgacttgtgcttagcagttctggctaacccggggcagaacattttggtgcccaggcctggattcagtctgtataagaccctggccgagtcaatggggatcgaagtaaaactgtacaatctcctgccggagaagtcctgggagattgacctcaaacagttagaatatctgatagacgaaaaaaccgcctgcctgatcgttaataaccccagcaatccatgtggatccgtgttctccaagcgtcacttgcaaaaaatcttggccgtggcggccaggcagtgtgtaccaatactggctgacgaaatttatggggacatggtattctcggattgcaaatatgaacctttagctaccctcagtaccgacgtgcccatcctgtcatgcggaggactggcgaagcgctggctcgttccaggatggcgcctgggctggattctgatccatgatcgcagggacatttttgggaacgagattagagacggtctggtgaagctgagccaacggatcctgggtccctgtaccatagtccagggcgccctgaagtctatactctgtagaaccccaggggagttctaccataatacactaagttttttgaaaagcaacgccgatctttgttatggtgccctagccgccattcccggcctgcgcccagtgagaccttctggcgcgatgtacctcatggtgggtatagagatggagcactttccagagttcgagaacgatgttgagtttacagagcgcctcgtcgcagaacagagtgtacactgcctccccgctacctgcttcgagtaccccaactttatccgagttgtcattactgtcccggaggtaatgatgcttgaggcttgcagcaggatacaggagttttgcgaacaacactaccattgcgccgaaggctcgcaggaggaatgtgataaatag

SEQ ID NO: 2877 - DNA, 1602 bp, Artificial Sequence
  Description of Artificial Sequence: Synthetic coding sequence
atggctgttgagtcgcaaggtgggagacctctcgttctgggactccttctctgtgtgctcggtccagtggtgtcccatgcaggcaagatcctcctgataccagtggacggatcacattggctaagcatgcttggagcgatccagcagctccaacagcgcgggcatgagattgtagttttagctcctgacgctagcttgtatatccgcgatggggccttttacaccttaaagacttatcccgtgccgtttcagagggaggacgttaaggagagcttcgtgtccttaggccacaatgtcttcgagaatgacagtttcctccaacgcgttatcaagacatacaagaaaattaagaaggatagtgccatgctgctctcagggtgttcccatctgttacacaacaaggagcttatggcatccctggcagaaagctcattcgatgtgatgctcaccgatcccttcttaccctgctcaccaatagttgcccagtatctttcattacctacagtattttttctccacgcccttccatgttcactagaatttgaggctactcaatgcccgaaccccttctcctatgtcccccggccgctgtcatctcacagtgaccacatgaccttcttacagcgggtgaagaacatgcttattgcgtttagtcagaattttctctgcgacgtggtctactccccctatgccacgctggcaagcgaattcctccaaagggaagtgaccgtccaggatctgctgagtagcgctagtgtatggctgtttagatctgattttgtgaaggactacccccgtcccatcatgcccaacatggttttcgttggcggaatcaactgcctgcaccagaacccactgagccaggaatttgaagcatatatcaacgccagcggggaacacggcattgtggtgtttagtctaggcagcatggtttcagagattcccgagaaaaaggccatggcgatcgccgatgctctgggtaaaatccctcagaccgtcctctggagatacaccggcacacggcccagcaatctcgccaataacacaatccttgttaaatggcttccacaaaacgatctgctggggcatcctatgacacgcgcttttatcactcacgcgggctcccatggagtgtacgaaagcatctgtaatggagtgccaatggtgatgatgccgctctttggcgaccagatggacaatgcaaagcgcatggagaccaaaggggctggagttaccttaaacgtgctagagatgacttccgaggatctagagaatgcccttaaggcggtgatcaatgacaagtcatacaaggaaaatattatgaggctgagctccctgcacaaggaccgccctgtggagccactcgacctggccgtgttttgggtcgaattcgttatgaggcacaaaggggccccccaccttagacctgccgctcatgatctgacttggtaccagtaccatagtctggatgtgatagggttccttctggctgttgttctgacagtcgcgtttattacatttaagtgctgtgcctatggctatcggaagtgtttgggcaaaaaaggcagagttaaaaaagctcataagtctaagacgcattag

SEQ ID NO: 2878 - DNA, 1335 bp, Artificial Sequence
  Description of Artificial Sequence: Synthetic coding sequence
atggccgtagagagccagggcggtaggcccctcgtgctggggcttctgctctgcgtgctggggccggttgtatcacacgccggcaagattttgctcatccctgttgacggtagccactggctctctatgctcggcgccatccagcaattgcagcaaagagggcacgagattgttgtcctagccccggatgccagcctgtacattcgagacggggccttttatacgctcaaaacctaccccgtaccgttccagcgcgaagatgtaaaggagagctttgttagtctggggcacaatgttttcgagaacgactcctttttgcagagggttattaagacttataaaaagattaagaaggactcagctatgctcctctcaggctgcagccacctgctgcacaacaaagaactgatggccagcctggctgaaagtagcttcgacgttatgcttaccgatccattcttgccttgttccccaattgtagcccagtacctgtccctccctaccgtgtttttcttgcacgctctcccttgctcgctagagttcgaggcaacccagtgtcctaaccctttcagctacgttccgagaccattgagctcacatagtgatcacatgacatttctgcaacgcgtcaagaacatgttgattgcctttagccagaattttctgtgtgacgtagtgtattccccttatgccaccctggccagcgagtttctccagcgggaagtcaccgtgcaggatcttctgagtagtgccagcgtctggctttttagaagcgatttcgtcaaggactaccccaggccaataatgcccaacatggtcttcgtgggcggaattaactgtctccatcagaaccccctgagccaggaatttgaagcctacatcaacgcaagcggagaacacggcattgtagtatttagcctcgggagtatggtgagcgagattcctgagaagaaggctatggccatcgccgatgccctgggcaagattccccagacagtgctctggagatacacaggcactcgtccgtcaaaccttgcaaataataccattctggtgaaatggctgccccagaatgatcttctaggtcatccgatgacaagggcattcatcactcacgctggatcccatggggtctacgaaagtatttgcaacggtgtgccaatggttatgatgcccctgttcggcgaccagatggacaatgcaaaaaggatggagactaagggagccggggtgacgctcaatgtattggagatgactagcgaagatctggagaacgctcttaaggccgtaataaacgataaaaggaagaagcagcagagcgggagacagatgtag

SEQ ID NO: 2879 - DNA, 1593 bp, Artificial Sequence
  Description of Artificial Sequence: Synthetic coding sequence
atggcacgagccggttggacatcacccgtccctctgtgcgtgtgccttcttctcacctgcgggtttgccgaggccggaaagctgcttgtggtgccaatggatggatcccactggttcacaatgcagtcagtggttgagaaactgattctccggggtcatgaggtcgtggtggtgatgccggaagtgtcctggcaattggaacggtcactgaattgcaccgtgaagacttatagtacatcttatacccttgaggaccagaatagggagtttatggtgtttgcacatgcacagtggaaggcccaggcccagtccatcttctcgctgttgatgtcttcaagctcaggcttcctggacttgttcttttcccattgccgctccttgttcaatgacagaaaactggtggagtacttgaaagagagctccttcgacgctgtgtttttggatccatttgacacctgcggccttatcgtggccaagtatttcagcctcccttcagttgtctttacacgggggattttctgtcatcacctggaggaaggtgcccaatgtcccgcccccctgtcatacgtgcccaatgaccttctgggattctctgatgccatgaccttcaaggaacgtgtgtggaatcacattgtgcacctggaggaccacttattttgtcaatacctctttagaaacgctttggaaatagcatccgagatcttgcagactccagtcaccgcatatgacctgtattcccacacttctatatggctcctgagaacagatttcgttttggactacccaaaacctgtcatgccaaacatgatcttcattggaggcataaactgtcatcagggcaagcctctacctatggagtttgaggcatacatcaatgccagcggcgagcacggaattgtggtgtttagtttaggtagcatggtctccgaaattccagaaaagaaagctatggccatcgccgatgccctcggcaagatcccacagacagtgttgtggcggtatactggtaccagacctagcaacctggccaataatactattcttgtgaagtggttaccgcagaacgacctactggggcatccaatgactagagccttcatcactcacgccggtagtcatggcgtctacgaaagtatatgtaatggagtacccatggtgatgatgcccctgtttggggaccagatggacaatgccaagcgcatggagactaagggggctggcgtcacactgaatgttctggagatgacctccgaggacttggagaatgcactcaaggccgtaatcaatgacaaaagttacaaggaaaacatcatgagactgtcaagtctccataaggatcgaccggtagagcccctggacttagccgtgttctgggtagaatttgtgatgcgacataaaggggcaccacaccttagacccgcagcgcatgacctgacttggtaccaataccattccttagacgtgatcggttttttgctggcggtcgttctcaccgtcgcatttataacctttaaatgctgtgcttatggttaccgcaagtgcttgggaaagaagggccgagtaaaaaaggcacacaaatctaagacccattag

SEQ ID NO: 2880 - DNA, 1605 bp, Artificial Sequence
  Description of Artificial Sequence: Synthetic coding sequence
atggccaccgggctgcaggtgccactgccatggctggcaactggtttactactgttgctttccgtgcagccttgggccgagtcgggaaaggtgctggtggtcccaatcgacggaagccactggctgtctatgagagaggtgcttagagagctccacgctcgaggccatcaggccgtggtgctgacccctgaagtgaatatgcatatcaaggaggaaaacttcttcacacttaccacctacgcaatctcctggacccaggatgagtttgatcggcacgtgctcggtcacacacagttgtatttcgaaaccgagcacttcctaaaaaaattcttccggtccatggcaatgctcaacaacatgagcctggtgtatcacaggtcgtgcgtcgaactgctccataacgaggctctcattagacatctgaacgctacatcctttgacgtggtcctcaccgatccagttaatctgtgtgccgcagtgctggctaaatacctgtctatcccaacggtttttttcttacgcaatatcccttgcgatttggacttcaagggtactcagtgccctaatccttccagttatataccccgtttgctcacgaccaatagcgaccacatgacgttcatgcagagagttaaaaacatgctgtacccacttgctcttagctatatatgccacgcctttagcgccccctatgcatcactcgccagcgaacttttccagcgtgaagtaagtgttgtggatattctgtcccacgcgtcagtctggttgtttcgaggggattttgtgatggactacccacggccaattatgcccaacatggtgtttattggcggtattaattgcgccaacaggaagcctctgtcacaagagttcgaggcttacattaatgcaagcggcgagcatggcatcgtcgtgttctcactgggcagtatggtcagcgaaatcccagaaaagaaggcgatggccatagcggatgctttaggcaaaataccccagacagtgctttggagatacaccggaactaggccttccaacctggccaacaataccatcctcgttaagtggctcccccagaacgatcttctgggccatccaatgacccgcgcatttattacacacgccgggagccacggagtgtatgagagcatctgtaacggggttccaatggtgatgatgcccctcttcggggatcagatggacaatgccaaaaggatggagacaaagggagccggcgttaccctaaatgtgctggagatgacttcagaggatcttgagaacgcacttaaggccgtgatcaatgataaatcatataaggaaaacatcatgcgcctgtcgtccttgcacaaagacagacccgtggaacctctggacctcgctgtattctgggtagaattcgtgatgcgtcacaagggcgcccctcacttaaggcctgccgcccatgatcttacctggtaccagtaccactctctcgacgtaatcggattcctgctggcggtcgtgctaaccgtggccttcatcaccttcaagtgttgcgcatatgggtaccggaagtgcctcggaaaaaagggtcgcgtcaagaaggctcacaaatctaagactcattag

SEQ ID NO: 2881 - DNA, 1470 bp, Artificial Sequence
  Description of Artificial Sequence: Synthetic coding sequence
atggctgggcagagagtcctcctgctggtggggtttctcctccctggagtcctgctcagtgaggctgcaaaaattctgacaatctctaccgttgacttcaagaaagaagaaaagtcttaccaggtgattagctggttagctcctgaggatcaccagcgcgagtttaagaaaagtttcgacttcttcctggaggagacgctgggcggcaggggcaagtttgagaacctattaaatgtcctggaatacctggcactgcagtgtagtcacttcctgaataggaaggatataatggattcactgaaaaatgagaactttgacatggtgatagtcgagacttttgattactgcccgtttctgatcgcagaaaaactggggaagcccttcgtcgccattctgagcacaagcttcggatcgctcgaattcggactgcccatcccgctcagctatgttcccgtcttcaggtctttacttactgaccacatggatttttggggacgggtgaaaaactttctcatgttttttagcttctgcagacgacagcagcatatgcagtctaccttcgacaacactatcaaagagcattttacagaaggctcacgtcctgttttgagccatctgcttctgaaggcggagttatggttcatcaatagtgactttgctttcgattttgcacgccccctcttgcccaatactgtgtacgtgggaggcttgatggagaaaccaattaagccagtccctcaagacctcgagaattttatcgcaaagttcggagactccggctttgttctggtaaccctgggcagtatggtgaatacatgtcagaacccagagatcttcaaggagatgaacaatgcctttgctcatctgcctcagggggttatttggaagtgtcagtgtagccattggcctaaggacgtgcatctggccgccaatgtcaaaatcgtggattggcttcctcagtccgatctattggcccacccttctattcggctgttcgtgacccatggcggtcaaaactccatcatggaagctattcagcacggggtcccaatggtggggattcctctgtttggagatcagcctgaaaatatggtgcgtgtcgaggccaagaagttcggtgtgtctatccagttgaaaaaactgaaggcagagaccctcgcactcaaaatgaaacagattatggaggacaaaagatacaaatccgccgccgtcgcagcctcagtaattctgcggtcccacccactgtcccctacccagcgcctggtcgggtggatcgatcatgttctgcaaacgggtggcgccacgcatctgaagccatatgttttccagcagccttggcacgaacagtacctacttgatgtctttgttttccttctcggactgacgttagggaccctgtggttgtgtggcaaacttctgggcatggccgtgtggtggctgagaggcgccagaaaggttaaggaaacttag

SEQ ID NO: 2882 - DNA, 1572 bp, Artificial Sequence
  Description of Artificial Sequence: Synthetic coding sequence
atggctggtcaaagggtactcctgctcgtggggttcctactgcccggtgtgctcctatccgaggccgcaaagattctcacaattagtactgtcggtggctcacactatctgctcatggacagggtttcccagattttacaggaccatggccacaacgtcactatgttaaatcacaagagggggcccttcatgcccgactttaaaaaagaggagaagtcttatcaggtgatctcttggctcgcccccgaggaccaccagcgcgaattcaagaagagttttgacttcttcctggaggagacactcggagggagaggcaaatttgagaatttgttaaacgtgctggaatacctggcccttcagtgcagccacttcctgaaccgcaaggacattatggatagtttaaaaaacgagaacttcgacatggtaatcgtggaaacttttgattattgtcctttcctgattgctgagaagctggggaagccgtttgttgctattttatccacatcattcggcagcctggagttcggactcccaattcctcttagctatgtcccagtctttcgatcactcctgacagaccatatggacttctgggggcgcgtcaagaatttcctgatgttctttagtttctgtagacgacagcagcatatgcagtctaccttcgataacacaataaaagagcacttcacagaaggctccagacccgtactctcacacctgctgcttaaggcagagctgtggttcattaactctgacttcgcttttgactttgctcgacccctccttccaaatactgtatacgtgggcgggctgatggagaagcctattaaaccagtccctcaggatcttgaaaactttattgctaaattcggggactccggctttgtgctggtcacactgggctcaatggtgaacacctgccagaacccagagatcttcaaggagatgaataatgccttcgctcatttaccccaaggagtaatctggaagtgccaatgctcacactggcccaaggatgttcacctggccgctaatgtgaaaatcgttgattggctgccacaaagtgacttactggcgcacccctctatccgcctctttgtgacacacggcggccagaatagcatcatggaggctatccagcacggggtccctatggtaggtatccccctttttggcgatcaaccagagaatatggttcgcgtggaggcgaaaaagttcggagtgtccattcagctcaagaaactgaaagctgaaacccttgcactaaaaatgaaacagattatggaggataagaggtacaaatccgctgcagtcgccgcctcggtcatactgagaagccaccccctcagccccactcaaaggctagtgggttggatcgatcatgtgctccagacggggggagcaacacacctgaaaccctacgtattccagcagccatggcatgagcagtatctgttggacgtgttcgtcttcctgcttggcctcacgctaggcacgctctggctctgcggcaaactgctgggcatggctgtgtggtggctgcggggcgctagaaaagtaaaagaaacgtag

SEQ ID NO: 2883 - DNA, 417 bp, Artificial Sequence
  Description of Artificial Sequence: Synthetic coding sequence
atggccggccaaagagtactgttattggtgggctttctgttgcctggggttctgctctccgaggccgctaaaatccttaccatttccaccgtgggggggagtcattatctgttgatggaccgcgtctcccagatccttcaagaccatgggcataacgtcaccatgctgaaccataagcggggtcctttcatgccagatttcaagaaagaggagaagagctaccaggtgataagctggctggcccctgaggatcaccagagggaattcaagaaatctttcgacttctttctagaagagactctgggtggaagaggaaaattcgaaaatctgctgaacgtgttggaatacctcgctctccagtgttcacatttcttgaatcgcaaggacattatggatagcctgaagaatgaaaattag

SEQ ID NO: 2884 - DNA, 666 bp, Artificial Sequence
  Description of Artificial Sequence: Synthetic coding sequence
atggtcaacacctgccaaaatccggagatatttaaggagatgaacaatgccttcgctcacctcccacagggagttatctggaagtgccagtgctcccactggcccaaagacgtccacttggcagccaacgtaaaaatcgtcgactggctcccccagtctgacttgctcgcccaccctagcatccggttattcgtgactcatgggggccagaacagcatcatggaggcaattcaacatggcgtgcccatggtcggcatccctcttttcggggaccagcccgagaacatggtgagagtggaagcgaagaaattcggggtgtctattcagctgaagaagctgaaggccgagacactcgcccttaaaatgaagcagatcatggaagacaagcggtataagagtgcagcagtggcagcgagcgtcattctgcggagccacccattgtcccccacgcagcgactcgtgggctggatcgaccacgtactccaaaccggcggtgccacgcatctcaagccatatgtgttccagcaaccatggcacgagcagtacttgctggatgtattcgttttcctcctgggtcttaccctgggaactctctggctctgcggcaaactactggggatggctgtatggtggttgcgcggcgcgcggaaggtgaaagaaacatag

SEQ ID NO: 2885 - DNA, 1086 bp, Artificial Sequence
  Description of Artificial Sequence: Synthetic coding sequence
atggccatgaactacaacgcaaaagatgaagtggacggtggacccccttgtgctccaggcgggacagctaagactcggagacccgacaacactgcttttaaacagcagcggctgcccgcctggcagcctatactcaccgcgggcacagtgttaccaatcttctttattattggcctgatctttatacctatcggcatcggtatcttcgtaactagtaataacatacgagagatcgagatagattacacaggaaccgagcctagcagcccctgcaacaaatgtctgtccccagacgtgacaccctgtttctgcacgattaactttacactagagaagtctttcgaaggcaacgtatttatgtactacggattatctaatttttaccaaaaccatagacgttatgtgaagtcaagagatgatagccagctgaatggcgattcaagcgcactgctgaacccctcaaaggaatgcgaaccatatcggcgcaatgaagacaagcccatcgctccgtgcggggccattgctaattccatgttcaacgatacactagagctgtttctcattgggaacgactcttatccaataccaattgctcttaaaaaaaaaggaattgcctggtggacagataaaaacgtcaaatttaggaaccctccagggggtgataaccttgaagaaagattcaaagggactactaagcccgtcaactggttaaaacccgtctatatgctggactcggacccagataacaatggcttcatcaacgaagatttcattgtgtggatgcggacagcagctttacccacttttcgcaaactatatcgcctgattgagaggaaaagcgacctccatcctacactgcccgccggcagatactcactgaacgtcacatataattacccagtgcattattttgatggaagaaagcggatgatcctgtccaccatcagctggatgggcggcaagaacccattcctaggaatcgcctacattgcagttgggagtataagttttttactcggtgtggtgctacttgtcatcaatcataagtacaggaacagttccaataccgctgacatcacaatttag

SEQ ID NO: 2886 - DNA, 954 bp, Artificial Sequence
  Description of Artificial Sequence: Synthetic coding sequence
ctgaccgacaggcagactgacactgcaccatccccatcgtaccacttgctcccagggaggcggcggacagtcgatgccgccgctagcagaggccaaggacctgaacccgcccctgggggcggggttgaaggagtgggggcccggggagtggccctgaaactgttcgtccagctgctcgggtgcagcagattcggaggggccgtggtcagagccggggaggccgaaccctctggagccgcacggagtgccagctcagggcgcgaagaaccacagcctgaggagggagaggaggaagaggaaaaggaagaggaaaggggcccacagtggagactgggggcccgaaagcctgggtcttggaccggagaggctgctgtctgtgctgattccgcacctgcggctcgcgcacctcaggctctcgctcgagcaagcggtcggggaggcagagtagcacggcgcggtgccgaggagtctgggccgccccactccccctcccggaggggttccgcttcacgcgctggccctggccgcgcctctgagactatgaactttctcctgagctgggtgcattggagcctggccctactcctgtacctccaccacgcaaaatggtcccaggccgcccctatggctgagggaggggggcaaaatcaccacgaagttgtgaaatttatggacgtgtaccagagatcatattgccatccaatagagacactcgtcgatatctttcaggagtatccagacgaaatcgaatacatctttaagccctcatgtgtcccgcttatgcgctgtgggggttgctgtaacgatgaaggcctagagtgtgtccccacggaagaaagcaatatcaccatgcaaataatgagaattaagcctcaccaggggcagcacattggggaaatgagctttctgcagcataataagtgcgaatgtcgctgcgacaagcctcggcgctag

SEQ ID NO: 2887 - DNA, 1239 bp, Artificial Sequence
  Description of Artificial Sequence: Synthetic coding sequence
ctcaccgatagacaaaccgataccgccccaagcccctcataccacctacttcctggcaggcggcggaccgtggacgctgccgcctccagaggacagggaccggagcccgctcctggaggtggtgttgagggggtgggggctcgaggtgtcgccctgaagctatttgtccagctgctcggctgcagccgatttggcggggccgtggttagggccggagaggcggagccgtctggagctgccaggagtgcctcaagtggaagggaggaaccccagcccgaggaaggtgaggaggaggaggagaaggaggaggaacgcggcccccagtggcgtcttggagcacgcaagcctggctcttggacaggcgaggctgccgtgtgtgccgattcagcacctgctgcccgggctccgcaggctcttgcccgggcatctgggaggggtgggcgggtagcacgtagaggggcagaggaatccgggccaccccactcaccatctaggcgtggatccgcctctcgagccggccccgggcgcgctagtgaaacaatgaacttccttctaagctgggtgcactggagcttggccctcttgttatacctgcatcatgccaagtggagtcaggccgcgccaatggccgagggaggtggacagaatcaccatgaggtcgtcaagtttatggatgtctaccaaagatcctactgccacccaattgagacattagtcgacatcttccaggaataccctgatgagatcgagtacatcttcaagcccagttgtgtccctctgatgcgatgtggggggtgctgcaatgatgaaggactggagtgcgtgcccacagaggagtcaaatattaccatgcagatcatgcgcataaagccccaccaggggcagcatattggcgagatgtctttcctgcaacataacaagtgcgagtgtagaccgaaaaaagatcgggccagacaagaaaagaaaagcgtccgcggcaagggcaaaggacagaagcgtaagcggaagaagagcagatacaagtcctggtctgtctacgtgggcgcgaggtgctgtctgatgccctggagccttccaggccctcatccatgcggtccttgcagcgaaaggcgtaaacacctctttgtgcaggatcctcagacttgcaagtgctcttgcaagaatactgatagtcgctgcaaggcccgacagctcgagctgaatgaaaggacatgtcggtgtgacaaacccagacggtag

SEQ ID NO: 2888 - DNA, 984 bp, Artificial Sequence
  Description of Artificial Sequence: Synthetic coding sequence
ctcactgatcgccaaacagataccgctcctagtccgtcataccacttgcttccaggacggcggaggaccgtggacgctgctgcctcacgaggacagggccccgagcctgctcctgggggaggcgtggaaggagtgggtgccagaggagtcgcactgaagctttttgtgcagctcctcggatgcagcagatttgggggggcagtggtgagggccggtgaggctgagccttccggggccgcaaggagcgcctcgtctggccgagaggagcctcagcccgaagaaggggaggaagaggaggaaaaagaagaagagcggggccctcaatggcgcctcggcgcccgaaagcctggaagttggaccggggaggctgctgtgtgtgctgactctgcgcctgctgcaagagccccacaggctctggccagagctagtggcaggggcggtcgcgttgcccggaggggagcagaggaatcaggcccccctcattcacctagtagaaggggctccgcatcccgcgctggtccggggcgcgcctccgagactatgaatttcctgctttcctgggtgcactggagcctcgctctactgctgtaccttcaccatgccaagtggagccaggcagccccaatggcagaagggggtggccagaaccaccacgaggtagttaagttcatggacgtctatcagcggagctactgccacccaatcgaaaccttggtggatattttccaggagtatcctgacgagatagaatacatctttaaaccctcatgtgtcccgctcatgcgctgtggaggctgttgtaatgacgagggccttgagtgcgttcccactgaagaatctaatataaccatgcagatcatgagaattaaaccccaccaaggccagcacattggggagatgagcttcttacagcataacaaatgcgaatgtaggcccaaaaaggaccgtgctcggcaggagaaatgtgacaagccacggcggtag

SEQ ID NO: 2889 - DNA, 1116 bp, Artificial Sequence
  Description of Artificial Sequence: Synthetic coding sequence
cttaccgacaggcagacggacactgcacctagcccgtcgtaccacctactccccgggagacgacgaactgtggacgctgcagccagtcgggggcaagggccggaacccgcgccagggggcggtgtggagggggtcggggcccgcggtgttgccctgaaattattcgttcaattgcttggttgttctcgattcggcggagcggtggtcagagcgggcgaagccgaaccttcaggcgctgcaaggagcgcaagttccggaagagaggagcctcagccggaggagggagaagaggaagaagagaaggaagaggaacgaggcccacaatggcgcctgggagcaaggaagcccggctcatggaccggagaagcagctgtgtgcgctgacagcgctcccgccgccagggccccacaggccctggcacgtgcatctgggagaggtggccgtgtagcccggagaggagcagaggagtcgggccctccccatagtccttctaggcgcggaagtgcttctcgcgcaggccctggaagggccagcgagaccatgaactttttgttaagctgggtgcactggtccctggccctcttactgtacctacaccacgctaagtggagccaggccgcaccaatggccgaaggggggggacagaatcaccacgaggtggtcaagttcatggacgtgtatcagaggtcctattgtcatccgatcgaaacgctggtggatatatttcaggaataccccgatgaaattgaatacatatttaaaccctcttgtgtgcctctcatgcggtgcggcggatgctgtaacgacgaagggctagagtgtgtacccacagaagagagcaacatcacaatgcagattatgaggattaaaccacaccaaggacagcatattggtgaaatgtcctttctacagcacaataagtgtgaatgtcgcccaaagaaagatagggcaagacaggaaaatccctgcggtccttgctccgagagacgcaaacacctctttgttcaggatcctcaaacatgtaaatgttcatgcaagaacacagacagccgctgcaaagcacgccagctggagctcaacgaaagaacatgtcgctgtgacaagcctcgaaggtag

SEQ ID NO: 2890 - DNA, 444 bp, Artificial Sequence
  Description of Artificial Sequence: Synthetic coding sequence
atgaacttcctgctgtcatgggttcactggagtttggcacttctcctgtatctgcaccatgccaagtggagtcaggccgcccccatggctgagggaggtggacagaaccaccatgaggtcgtgaagttcatggacgtgtatcagcgttcttactgccaccctatagaaaccttggttgatatcttccaggaatacccggatgaaatagagtatatctttaaaccctcctgtgtgcccctgatgaggtgtgggggctgctgcaacgacgagggactggagtgcgttccaacagaggaatccaacataacaatgcagatcatgcgaattaaaccacaccagggccagcacatcggagagatgtccttcctgcagcataataagtgtgaatgcaggccgaagaaggatcgggctcggcaagagaagtgcgacaaaccacgtaggtag

SEQ ID NO: 2891 - DNA, 1170 bp, Artificial Sequence
  Description of Artificial Sequence: Synthetic coding sequence
ttgacagaccggcagaccgacaccgccccatctcctagttatcatctgctgcccggaagaagaaggaccgtcgacgcagccgcgagtagaggacaggggcccgagccggcccccggcggcggtgtggagggggtaggcgcccgaggtgttgcgcttaagcttttcgtgcagctcctgggctgttctcgatttggcggggccgttgtgagagccggcgaggctgaaccatcaggagcagctaggtcagccagcagcgggcgagaagagcctcagcctgaggaaggggaagaggaagaggaaaaagaggaagagcgggggccccagtggcgcctgggggcccgcaagccgggtagctggaccggtgaggctgccgtgtgtgccgattcagcacctgccgcccgggcgccgcaggctctcgcccgagcaagcggccgggggggccgcgtggcccggcgtggtgccgaggagtccgggcctccacatagtccttcaagacgcggttcggccagcagggccgggcctgggagggcgagcgagaccatgaactttctgctgagctgggtgcactggtccctggctctgttgttgtacctgcatcatgccaagtggagtcaggcagcccccatggctgaaggcggcggccagaatcatcatgaggtagtgaaatttatggacgtgtatcagcggtcatattgccatccaatagagacactggtggatatcttccaggaatacccggatgaaattgagtatatattcaaaccctcctgcgtgcctctgatgaggtgcgggggctgttgtaatgatgaagggttagaatgtgtacccactgaagaaagtaacatcacgatgcaaattatgcgcataaagcctcaccagggacagcatatcggtgagatgagttttctgcaacacaacaaatgcgagtgcagacctaagaaagatcgggctcgccaagaaaaaaaatcagtgcgtggtaagggcaaaggacagaagcgaaagagaaagaaatcaagaccatgcgggccatgctctgagcgacggaagcatttgttcgttcaagatcctcaaacgtgtaagtgtagttgtaaaaacactgattcccggtgtaaagcccggcagttggaactgaatgagcggacctgtcgctgtgataaaccccggagatag

SEQ ID NO: 2892 - DNA, 1065 bp, Artificial Sequence
  Description of Artificial Sequence: Synthetic coding sequence
ctaacagacagacagactgacacagcgccttcaccaagctatcacctcctgcctggacggcggaggactgtggacgctgctgccagtcgtggccaggggcccgagcccgcccccggcggaggcgtcgaaggcgtgggggccaggggagtggcgcttaagttattcgtccagctgctgggttgctccagattcggcggggccgtcgtccgagccggagaggctgagccaagcggtgctgcacgctcagcatcttccggccgagaagagccgcaacccgaagagggagaggaggaagaagaaaaggaggaggaacggggaccccagtggaggctcggcgctcggaaacctggctcctggactggagaggccgccgtctgcgcagacagtgcgcctgctgctcgggcgccccaggccctcgcacgggcttctggccgcggcggaagggtggctcgcaggggcgccgaggaatcaggtccaccccatagtccctcaaggaggggctcagcttcccgcgccggccctggcagggcaagtgagactatgaatttcctgcttagttgggtgcattggagcctggccttgcttttgtatcttcaccacgctaagtggtcccaggcggctcctatggccgagggcggggggcagaatcatcacgaggtagttaagttcatggatgtctatcaacgatcctactgccacccaatagagaccttggtggacattttccaggaatatcccgacgaaatcgagtacatctttaaacctagttgtgtccccctgatgcggtgcggcgggtgctgtaatgatgagggtctcgaatgcgtgccaaccgaagaatccaatataaccatgcagattatgaggatcaagccgcatcagggacagcacattggagagatgtccttcctccagcataacaagtgcgaatgtaggcctaagaaggaccgagcaaggcaagaaaatccatgtggaccttgctctgagaggcgcaaacacctgtttgtgcaggaccctcagacatgtaagtgtagttgtaagaacacagacagtcgttgcaagatgtag

SEQ ID NO: 2893 - DNA, 1188 bp, Artificial Sequence
  Description of Artificial Sequence: Synthetic coding sequence
ttgaccgataggcaaaccgacactgcccctagtccatcctaccacctcctcccaggccgacgtcggactgtggacgctgccgcatctcggggacagggacctgagccggcaccgggtgggggagttgagggagtcggagctagaggggttgcattgaaactgttcgtacaactcctgggatgctccaggttcgggggcgctgtggtgagagctggagaggctgagccatccggggccgccaggtccgcgtcctctgggcgggaagagccacagcccgaagaaggcgaggaagaggaggagaaagaagaagagcgaggcccacaatggcgtctgggcgcccgaaagcctggaagttggacgggcgaagccgcagtgtgtgcagatagcgctcctgcagccagggcccctcaagccctggctcgggctagcgggaggggggggcgcgtcgcccggcggggagctgaggaatccggaccgccacactccccatctcgccgaggcagtgcctctcgtgctggcccaggcagagcgtcggaaaccatgaatttcttgctcagttgggtgcactggagtttggcattgctgctgtatcttcatcacgctaagtggagccaggcagcacccatggccgaaggcggaggacagaaccaccatgaggttgtgaaatttatggatgtgtaccagaggtcatactgtcacccaatcgaaacccttgtggacatctttcaagaatacccggatgagatcgaatacatctttaaaccctcttgtgttcctttgatgcgctgtggagggtgctgcaacgacgagggacttgaatgcgtcccaaccgaggagtctaatatcactatgcagataatgcggatcaagccgcaccagggtcaacatattggggagatgtctttcctccagcacaacaaatgtgaatgccgtccaaagaaggaccgcgcccggcaggaaaagaagtccgtgcggggcaagggaaaaggacagaaacggaagaggaaaaaatcacgatacaaatcttggagcgtgccgtgcggcccatgtagcgaaagaagaaagcaccttttcgtacaggatccacagacttgcaagtgctcctgcaaaaatactgattcccggtgcaaggccaggcagctggaattgaatgaacgcacctgcagatgcgataagcctcggcgatag

SEQ ID NO: 2894 - DNA, 414 bp, Artificial Sequence
  Description of Artificial Sequence: Synthetic coding sequence
atgaacttcttactaagttgggttcattggtctctcgccctgttgctctacctgcaccatgccaaatggtcccaggccgccccaatggcagaggggggggggcaaaatcatcatgaggtggttaagtttatggacgtttaccaaaggtcttactgccaccctatcgaaactctagtggatattttccaagagtatccagatgagatagaatatatcttcaagccatcatgcgtgcccctgatgcggtgcggtggatgctgtaacgacgaaggcctggagtgtgtccccactgaggagtccaatataaccatgcagatcatgcgcataaagccgcaccaggggcagcatatcggcgaaatgagttttctacagcataataagtgcgagtgtaggtgtgacaagccaaggaggtag

SEQ ID NO: 2895 - DNA, 1116 bp, Artificial Sequence
  Description of Artificial Sequence: Synthetic coding sequence
ctcactgaccgccagacagatacagcaccatcacctagttatcatctgctccccggacggcggcgaaccgtggacgccgccgcaagtagaggtcagggacccgagcccgcacctggcggcggcgttgaaggagtgggagcaagaggcgtcgctctcaaactatttgttcagctactgggatgctcacggtttggcggagcggtggtaagggccggcgaggccgagccgtccggcgccgcgcggagtgcttcctccggacgggaagagccacagcccgaagagggcgaggaggaggaagagaaggaggaggagagaggcccccaatggcgactgggcgcacgcaaacccggatcctggaccggagaggccgctgtgtgcgccgattccgcaccagctgctcgcgctccacaagcacttgcacgtgcatccggccggggcggccgcgtggctcggaggggcgccgaggagtccggcccgccccactcaccaagcagacgggggtctgctagtagagccggccctggccgagctagtgagaccatgaatttcctgctttcgtgggtgcattggagtctcgcactcttgctctacctgcaccacgccaagtggtcccaggcagccccgatggccgaaggagggggtcagaatcatcacgaggtggtaaagtttatggatgtctaccaaaggagctattgtcaccccatcgagactctggtggatatattccaggaatacccggatgaaatcgaatacatatttaagccaagctgtgtgccattgatgcgctgcggcggatgttgtaacgacgaaggtttggagtgtgtgcccaccgaggaatctaatattacgatgcagataatgcgtattaaaccgcatcagggccaacatatcggtgaaatgtcctttctacagcataataaatgtgagtgccggcccaaaaaggatcgcgcccggcaggagaacccctgcggaccatgctcagaacggcgcaaacatttgttcgtccaggaccctcagacctgtaagtgtagctgcaagaacaccgacagccgctgcaaagctagacaattggagctgaatgagcgtacttgcaggagcttgactagaaaagactag

SEQ ID NO: 2896 - DNA, 630 bp, Artificial Sequence
  Description of Artificial Sequence: Synthetic coding sequence
atgaatttcctgttgagttgggtccactggtcactggctcttttgctttatctgcaccatgccaaatggagccaagccgcccctatggctgagggcggcggtcagaatcaccacgaggtagtcaaatttatggatgtctatcagcggtcctattgtcaccctattgagacgttagtggacatttttcaagagtatccagatgagattgagtacatcttcaagccatcgtgtgtgcctctgatgcgttgtggagggtgttgcaacgatgaaggtctggaatgcgtaccgactgaagaatcaaatattacgatgcagataatgagaattaagcctcatcagggccagcacatcggtgagatgtcgttcttgcagcacaataagtgcgagtgtaggcctaaaaaagatcgagccaggcaggagaaaaaatccgtgaggggcaaagggaagggtcagaaacgaaagcgcaagaagagcagaccttgcggcccgtgctccgagagaaggaagcacctttttgtacaagaccctcagacctgtaagtgtagctgcaaaaacacagattcacggtgcaaggcacgtcaacttgagctcaacgaaaggacatgtagatgcgataagcctagacgatag

SEQ ID NO: 2897 - DNA, 576 bp, Artificial Sequence
  Description of Artificial Sequence: Synthetic coding sequence
atgaactttcttctgagttgggtacattggtccctggccctgctgctttacttacatcatgccaaatggtctcaggcggcccctatggctgagggggggggccagaaccaccatgaggtggtcaaatttatggatgtgtaccagcggagctactgtcaccctattgagacactggtggacatttttcaagagtatcccgacgagatcgaatatatcttcaaacctagttgtgtcccacttatgcggtgtggaggatgctgcaatgacgagggcctagagtgtgttcccacagaggagtcaaacattacgatgcaaattatgcggataaagccccaccaggggcaacatatcggcgaaatgtcatttctgcagcacaataaatgtgagtgcagacctaaaaaggatagggcacggcaggagaatccatgtggtccttgttcagagaggaggaagcacctttttgttcaagacccccaaacatgtaaatgcagctgtaaaaacaccgattcacggtgtaaagctaggcagttagaattgaacgagcgcacatgccggagtttaacaaggaaagattag

SEQ ID NO: 2898 - DNA, 972 bp, Artificial Sequence
  Description of Artificial Sequence: Synthetic coding sequence
tgacggggccagggccctgagcccgcaccaggagggggtgtggaaggggttggagcaagaggcgtcgctttaaagctctttgtccagctactaggttgttcacgtttcgggggcgcggtggtccgagccggtgaggctgagccatctggtgccgccagatcagcatcttcaggacgggaagagccccagccagaagagggggaggaggaggaagagaaggaggaagagagggggccccagtggagactgggagcccgtaagcccggtagttggaccggggaagcagccgtatgtgcggactctgcccctgctgcacgcgcaccccaggccttagcaagagcttccggccggggcgggcgagtggcacgacgcggcgcagaagagtccggccctccgcattcccctagccggagagggagcgccagcagagccgggcccggccgggcatccgagaccatgaactttctcctatcatgggtccattggtcacttgccctccttctttacctgcatcacgctaagtggagccaggcggccccaatggccgagggcggtggccagaaccatcacgaggtggttaaattcatggatgtataccaacgatcctactgccaccccatcgagaccttggtcgatatctttcaggaatatcccgacgagatcgaatacatatttaaaccgtcttgcgttccgttgatgaggtgtggcggatgctgtaatgatgaagggctggagtgtgtaccaaccgaggagtctaatatcaccatgcagataatgagaatcaaaccgcatcagggacagcatatcggcgaaatgtccttcttgcagcacaacaaatgtgaatgtcgtccaaaaaaggatcgcgctagacaagagaagaagtcagtacgggggaagggaaagggccaaaaacgcaagcgtaagaagagccggtataaatcatggtcagtatgcgataagcctaggcgctag

SEQ ID NO: 2899 - DNA, 648 bp, Artificial Sequence
  Description of Artificial Sequence: Synthetic coding sequence
atgaactttctgcttagctgggtgcactggtcccttgctcttttgttataccttcaccacgcaaaatggtctcaagccgctcccatggccgaaggcggcggacaaaaccaccatgaggtagtaaaattcatggacgtgtatcagcggagttattgtcatccaatcgaaactctagttgacatatttcaagagtatcctgacgaaattgagtacatctttaaaccttcttgcgtgcccctgatgcggtgcggcggctgttgtaatgacgagggacttgagtgcgtgcccactgaagagtcgaacataacaatgcaaattatgaggatcaagccacaccaaggacaacacattggtgagatgtcgtttcttcagcacaataagtgcgaatgtcgcccaaaaaaggatagggcaaggcaggagaagaagtccgtgcgcggtaaagggaaaggccagaagagaaagagaaagaagagccgctataaatcttggagcgtgccatgtgggccctgttctgagagacgcaaacacttgtttgtacaggaccctcagacctgtaaatgtagctgcaagaacacagactctagatgtaaagcccgacagcttgaattaaatgagcgcacctgccgatgcgacaagcccaggaggtag

SEQ ID NO: 2900 - DNA, 525 bp, Artificial Sequence
  Description of Artificial Sequence: Synthetic coding sequence
atgaattttctcctcagctgggttcactggagcttggcgctcctgttgtacttgcaccatgctaagtggagccaggcagcgcccatggccgaaggtggcggacagaaccatcatgaggtcgtcaagtttatggatgtgtaccagcgtagctactgccatcccattgagacacttgtggacatttttcaagagtaccccgatgaaattgaatatatcttcaaaccgtcctgcgtgccattaatgaggtgtggtggctgctgcaacgatgagggcttagagtgcgtgcccaccgaggagtcaaacatcaccatgcagatcatgaggataaagcctcaccagggccagcacatcggcgagatgagcttcctgcagcacaataagtgtgaatgtcgcccaaagaaggaccgcgcccgccaggagaatccgtgcggcccttgcagtgaacgtcgcaagcacttattcgttcaagatcctcagacatgtaaatgtagttgtaaaaataccgattctaggtgcaaaatgtag

SEQ ID NO: 2901 - DNA, 699 bp, Artificial Sequence
  Description of Artificial Sequence: Synthetic coding sequence
atgaactttctgctaagctgggtccattggagtttagctctgctactgtacctgcaccacgccaaatggagtcaggctgcccccatggcagagggtggaggccagaatcatcacgaggtggttaagttcatggacgtataccaaagatcctattgccacccaatcgagacacttgtggacatttttcaggaataccctgatgagatcgaatatatctttaaaccttcctgcgttcccttgatgcgctgcggcggttgttgcaacgatgagggactggagtgcgtcccaaccgaggaatctaacatcacaatgcaaatcatgagaataaaacctcatcagggtcaacatattggcgagatgagctttctccagcacaacaaatgcgaatgtagacctaagaaggaccgggcccggcaggagaaaaaaagcgtgagaggcaaaggcaaggggcagaagcggaagcggaagaaaagccgatataaatcatggtctgtgtacgttggagctcgttgttgtttgatgccttggagccttcccgggccacacccttgtggtccatgtagtgaacggagaaaacacttgtttgtgcaagatcctcaaacctgcaagtgctcctgcaaaaacacggattcaaggtgcaaggctcgtcagttggaactaaacgaaaggacctgccgttgtgataagccacgccgatag

SEQ ID NO: 2902 - DNA, 576 bp, Artificial Sequence
  Description of Artificial Sequence: Synthetic coding sequence
atgaactttcttttatcttgggtccactggagtttagccctgctcctatatctccaccatgcaaagtggtcgcaggctgcaccgatggccgagggaggcggtcagaaccatcacgaggtggttaagttcatggatgtataccagagatcatattgccacccaatcgaaactctggttgacatctttcaggagtaccctgatgaaattgagtacatcttcaaaccttcctgcgtccctctgatgcgctgtgggggctgctgtaacgacgaaggattggaatgcgtcccgaccgaggagtcaaacatcaccatgcagatcatgcggataaaaccccaccaggggcagcacatcggggagatgagttttttacagcacaacaagtgtgagtgtcggcccaaaaaggatagggcaaggcaggagaacccctgtggcccttgctctgaacggcggaagcacctgtttgttcaggacccccagacctgcaagtgcagctgtaaaaatacggactccagatgtaaggcaagacagctcgaattaaatgaaaggacctgccggtgtgataagcctcggagatag

SEQ ID NO: 2903 - DNA, 1263 bp, Artificial Sequence
  Description of Artificial Sequence: Synthetic coding sequence
atgcatttgctggggtttttcagcgtcgcctgttctctgttggctgcagctctgttacccggcccccgggaagcccctgccgcagccgccgccttcgagtccgggctcgatctgtccgacgccgagcccgacgccggggaagccacagcatatgctagtaaggatcttgaggagcagcttcgtagtgtatcttcagttgatgagctgatgaccgttctttatcccgagtactggaaaatgtataagtgccaactgcgcaagggcggctggcagcacaatcgggaacaggctaatctcaatagtcgaacggaggagaccattaagttcgcggcagcccactataacactgaaattctgaaaagcatcgataacgagtggaggaagacacagtgtatgccacgggaggtttgtattgacgttgggaaggaatttggcgtcgctactaacactttcttcaagccaccctgtgtgagcgtctacagatgtggcggctgctgcaactccgaagggcttcagtgcatgaacacctctactagctatctgtcaaagacgctcttcgagatcactgtgcccctttcacagggaccaaagcccgtgaccataagctttgccaaccacaccagttgcagatgcatgtcaaagttggacgtctatagacaggtgcattccatcatccgcagatctcttcctgctacactgccccagtgccaagcagcaaacaagacgtgtcctaccaattacatgtggaataatcacatatgtcgctgcctcgcacaggaggactttatgttttccagtgatgcaggggacgactccaccgacggattccatgacatatgcggaccaaataaggagctggacgaggaaacttgtcagtgcgtgtgccgtgccgggctcaggcctgcttcttgcggaccccataaagagctggatcgaaattcttgtcaatgtgtatgtaagaataagctgttcccttcacagtgtggagccaaccgtgaattcgacgaaaacacatgccagtgcgtgtgcaagcgcacatgcccacgaaaccagccactaaatcctggtaagtgcgcatgtgagtgtactgagtctccccagaaatgtttgttgaaaggtaagaagttccaccaccagacctgttcttgctaccggagaccgtgcaccaaccgacaaaaagcatgcgagcccgggttttcctattccgaggaggtatgtcgatgcgtccctagctactggaaaaggcctcagatgatgagctag

SEQ ID NO: 2904 - DNA, 510 bp, Artificial Sequence
  Description of Artificial Sequence: Synthetic coding sequence
atggacacacggaacaaggcgcagctcctcgtgttgttgacacttctctctgtacttttctcccagacgtccgcctggcccctgtaccgcgctccaagcgcactccggctgggtgacaggattccttttgaaggcgccaacgaaccggatcaggtctctctgaaagaagacattgacatgctccagaacgcgttggctgaaaatgacacaccttactacgacgtttctcgcaacgcccgccacgcagacggcgtctttacatctgactttagcaagctgctcggccagctttctgcaaagaagtatctcgagagcctcatgggcaaacgcgtctccaacatatccgaggatccagtccctgtgaaaagacattcagacgcggttttcacggataattataccagactgcgcaagcagatggccgttaagaaatacctgaatagcatactcaacggaaagcggtcatccgaaggcgagtctcctgacttccccgaggagttggagaagtag

SEQ ID NO: 2905 - DNA, 513 bp, Artificial Sequence
  Description of Artificial Sequence: Synthetic coding sequence
atggatacccgtaacaaggctcagctgctggtcctcctgactctgctgagcgtattattctctcagacttcagcttggccattatacagggccccgtctgctctgcggctgggcgacaggattccattcgagggcgctaacgaaccagaccaggtgtccctgaaggaagacatcgacatgcttcagaatgcactcgctgagaatgacactccctattatgatgtttctaggaatgccagacatgccgatggtgtgtttacttctgatttttctaagttgctgggccagttgtcagctaagaagtatctggagtctttgatgggcaaacgcgtaagcagcaatatctctgaggatccagtccctgtgaaacgtcatagtgacgcagtattcaccgacaactacacaagactcaggaaacaaatggctgtgaaaaaatacctgaattccatcctcaatggtaaacgctcttctgagggagaatcaccggatttcccggaggagcttgagaagtag

SEQ ID NO: 2906 - DNA, 360 bp, Artificial Sequence
  Description of Artificial Sequence: Synthetic coding sequence
taagtgtccctgaaggaggacatagatatgctgcaaaacgctctcgctgagaacgatactccttattacgacgtgtctcgaaatgccaggcatgctgacggtgtcttcacgtcagatttttcaaagctcctgggccagctgtcagcaaagaaatacctcgaatccctgatgggcaagcgggtttcttcgaatatttctgaggatcctgtgccggtgaaacgtcactctgacgccgtgtttacggataactatacccgtctccggaaacagatggcagtcaagaaatacctgaactccatccttaatggtaagaggtccgaaggcgagagccctgattttcctgaagaactggaaaaatag

SEQ ID NO: 2907 - DNA, 774 bp, Artificial Sequence
  Description of Artificial Sequence: Synthetic coding sequence
atgcctctgaacgtttcttttaccaaccgaaactacgacctggactatgacagtgtgcaaccttatttctattgcgacgaagaagaaaatttctaccagcagcaacagcagagtgagttgcagccgccagctcctagcgaagacatctggaagaagttcgagctgctccccacgcctcccctttcgcccagcaggaggtctggcctctgcagtcccagctatgtggctgtcaccccattcagtctgaggggcgacaatgatggaggcggcggctcatttagtactgccgaccagttggagatggtcactgaactattagggggagacatggttaatcagtcctttatctgtgatcccgatgacgagactttcataaaaaacattataatccaggattgcatgtggtccggattttctgccgccgctaagctggtgagtgaaaaactagcatcatatcaagccgctcgcaaggacagtggctcgcctaatcccgcacgcgggcacagcgtatgctctacttcttcgctgtatctgcaggatttgagcgcggccgccagtgaatgtatcgacccctcagtggtgttcccttatcctctgaatgatagcagttcccccaagagctgcgcaagtcaagactctagcgcattttcaccctcatcggatagcctgctgtcctcgaccgagtctagcccccagggctcccccgaacccttggtgctccacgaggagactccccctaccacatcctctgattcaggagggacaaggcggtag

SEQ ID NO: 2908 - DNA, 1365 bp, Artificial Sequence
  Description of Artificial Sequence: Synthetic coding sequence
ttagattttttcagagtggtggagaaccagcagccccctgcaaccatgccacttaatgtatcgttcactaatcgcaactatgacttggactacgactctgtccagccttacttctattgcgatgaggaggaaaatttctatcagcagcagcagcaaagtgaactccagcccccggcccccagcgaagatatttggaaaaagttcgagctgctgccaactcccccattgtcgccttctcggcggagcggcctttgctcgcctagctatgtggcagttacacctttctcattgagaggagataatgatggcgggggcggctccttttcaacagctgatcagctggagatggtgactgaactgcttgggggcgacatggtgaaccagagttttatctgcgatcctgatgacgagacattcattaaaaacatcataatccaggattgcatgtggtctggtttctcagccgccgctaagttagtctccgaaaaactcgcctcctaccaggccgcccggaaagacagcggctccccaaatcctgcgagggggcattccgtctgctctacgtcctcactgtacctgcaggatctctcagctgccgcaagtgaatgcattgacccatccgtcgtttttccatatcccttgaacgactcatccagccccaagtcatgtgcctcacaggactcttctgcattctccccctcctccgatagtctgctgtcttccaccgagtccagtccgcagggctctccagagccattggtcctgcacgaggagaccccacccacaacgtccagcgattcagaggaggaacaggaagatgaggaagaaatcgatgtcgtgtcggtggagaaacgtcaggcccccggcaagaggtcggagtccggatcgccgtctgccggtgggcactccaaaccgccccattctcccctggtcctgaagcgttgccatgtgtctacccaccaacataattatgccgcacccccctcaacccggaaggactaccctgccgctaagcgggtgaaacttgacagcgtgcgagtgctgcgccagatctccaacaacagaaagtgcacttccccccgaagcagcgatacggaagagaacgtgaagcggcggacacataatgtgctggagcgccagagacgaaatgagcttaagaggtcttttttcgccctccgggaccagatcccggaacttgaaaacaacgagaaggctcctaaagtggtgatcctgaagaaagccactgcctacatcctgagcgtccaggccgaagagcagaagttaatatcagaggaggacctgctcagaaaacggagggagcagctgaaacacaaactcgaacagctgagaaattcttgtgcgtag

SEQ ID NO: 2909 - DNA, 1263 bp, Artificial Sequence
  Description of Artificial Sequence: Synthetic coding sequence
atgccactcaatgttagttttaccaatagaaattatgacttggactacgatagcgttcaaccctacttttattgcgacgaggaggacatttggaaaaagtttgaacttttacccacgccacctttaagcccgtctcggcggtctggattgtgttcgccttcatacgtcgcagtaacacccttcagtcttaggggtgacaacgatgggggcggtggcagtttctccacagcggaccagctggagatggtgacggaactactcggcggggacatggtcaaccaatcttttatctgcgatccagacgatgagacatttattaagaacattatcatccaagattgcatgtggagcggattcagcgcagccgccaagctggtgtcagagaaactggcatcttaccaagccgcccgcaaagatagcggcagccccaaccctgcgagaggccactctgtgtgctccacctctagtctatatcttcaggatctttcagccgccgcaagtgagtgcattgatcctagcgttgtatttccctaccccctgaacgactcatcatccccaaagtcgtgcgcctcacaggatagttctgctttcagtccatcatctgattctcttctctccagtaccgagagttctccacagggcagccctgagccactggtgctacacgaggaaaccccccctacgacgagctccgatagcgaggaggaacaggaagatgaagaggaaatagatgtggtgagcgtggaaaaacgacaggcccccggtaagaggagtgagtctgggagtccttcagccggtggccactccaaaccaccccatagtccactggtcctaaaaaggtgccatgtgtcgacccatcaacataattatgccgcaccacccagcacacgcaaggattacccagccgcgaaaagagttaaactggattctgtcagggtcttaagacagataagcaacaataggaaatgtactagcccacgcagttccgacacagaggaaaatgtcaagcggcgaacccataacgtactcgagagacagcgtcgcaatgagctcaaacggtctttcttcgcattgcgagatcagatccctgaattggagaacaacgagaaagcccccaaagtggttattctaaaaaaggcaacagcttacattctcagcgtacaagcagaggaacagaagttgattagcgaggaagacctgttgaggaaacgtcgtgagcagcttaagcacaaactcgagcagttgcggaattcatgcgcttag

SEQ ID NO: 2910 - DNA, 1362 bp, Artificial Sequence
  Description of Artificial Sequence: Synthetic coding sequence
cttgatttctttcgagtagtagagaaccagcccccagcaaccatgcccctgaatgttagctttacaaacagaaactacgatctggactatgacagcgtccagccatacttctactgcgatgaagaggaaaatttctaccaacagcagcagcagagtgagcttcagcccccagccccgtctgaggacatctggaagaagttcgagctcctgcccactcccccgctaagtccgagccgcaggagtggactgtgttctcccagctacgtagccgtgacacccttctccctgagaggagataatgatggaggaggtggcagcttcagcactgcagatcaattagagatggtgactgaattactgggtggggacatggttaatcagtcttttatttgcgatccagacgatgagacgttcataaaaaatattatcattcaggactgtatgtggagcggcttttctgcggccgcaaagctggtctctgaaaaactcgcatcataccaggcagcaaggaaagatagcggcagccccaaccccgcaagaggccattcagtgtgctcaacctctagcctgtacttacaggatctgagtgcagctgcatccgaatgcattgacccttcggtagtgttcccgtatccactcaatgatagctcctctcctaagtcatgcgcatcgcaggattcttctgccttttctccttcctcagattctcttctttcctcaaccgaaagttctccccagggctcacccgaacccctcgtactgcacgaagaaactcctccaacgacaagttccgactccgaggaggaacaggaggacgaggaggaaatcgacgtagtctccgtcgagaaacggcaggcccccggaaagcggtctgagtccgggagcccgtccgccgggggacacagcaaaccccctcatagccccttagtcctgaaaaggtgccatgtctccacacatcagcacaattacgccgctcccccgtccacccgaaaagactatccagccgccaaacgtgtgaagctcgattcggttcgcgtgctgcgccaaatttctaataaccgtaaatgcactagccccaggtcctccgatactgaagagaacgttaaaaggcggacacataatgtcctcgagaggcagagacgcaacgagctgaagcggtcattcttcgctctgagggaccaaattccggagctagagaacaatgagaaggcccccaaggtcgttatattgaagaaggcgactgcatatattttgagtgtgcaggccgaggaacagaagctgatcagcgaagaagaccttctccggaagcggcgggaacagctgaagcataagctagagcagctgagaaattcatgtgcctag

SEQ ID NO: 2911 - DNA, 8442 bp, Artificial Sequence
  Description of Artificial Sequence: Synthetic coding sequence
atgatcccagcacggtttgccggcgtgcttctggcattagctctgatcctgcctggcaccctttgtgctgagggcactagaggccgctcaagcaccgctagatgttctcttttcggatccgattttgtcaataccttcgacggtagcatgtattctttcgctggatattgctcatacctgctcgctggaggctgccagaagaggtcattctctataattggcgatttccaaaacggaaaacgggtgagtctttcagtgtacttgggcgaatttttcgacatccatctgtttgtaaacgggaccgtcacacagggggaccagagagtcagtatgccctatgcttcgaaagggctgtacctggagacagaggcaggctattacaaattaagcggcgaggcatacgggttcgtagccagaatcgatgggagcgggaactttcaggttttactgtcagatcgctattttaacaaaacttgcggtctgtgcggtaactttaacatattcgcagaggacgactttatgactcaggagggaaccttaacctctgatccttatgacttcgctaattcatgggcactcagcagcggtgagcaatggtgcgaacgggcgagcccgcccagctctagctgcaacatatccagcggtgagatgcagaaagggttgtgggagcagtgtcagctccttaaatccacgagcgtttttgcccggtgccatcctctggtggaccctgaacccttcgtggccctgtgtgaaaaaacactgtgcgagtgcgcaggcggccttgaatgcgcctgtcctgccctactggaatacgccaggacttgtgctcaggaagggatggtgctgtacggctggaccgaccacagcgcctgtagccccgtgtgccccgccggtatggagtaccgtcagtgcgtgtctccttgcgcaagaacttgtcaatctttacacattaacgagatgtgccaggagcggtgtgtcgacgggtgtagttgcccagaaggccaactgctggatgaaggactgtgcgttgagagcactgaatgtccatgcgtccattccggtaagagatatccccccgggacatccctgtccagagattgcaacacttgcatctgcaggaattcccagtggatttgcagtaatgaggaatgccccggcgaatgtctggtgacaggacagtcacattttaagagttttgacaatagatactttacattctcaggcatatgtcagtatctcttagccagagattgccaggatcattccttttccatcgtcatcgaaaccgtccagtgcgccgatgacagggacgcagtctgcaccaggtcagtgactgtacgcctgcccggtctgcacaacagccttgtgaaactaaaacacggagccggagtggctatggacggtcaagacgtgcagctccccctgctaaaaggcgacttacgcatccaacacaccgtcacagcaagcgtgagactgtcttatggtgaggatctccagatggactgggacggccggggcaggcttctcgtgaagctgtcccctgtgtacgccggaaagacctgtgggctctgcggcaattacaatggtaaccagggagatgacttcctcacccctagcggtctggcagaaccgagggtggaggactttgggaacgcatggaaactccacggagactgtcaagacctccagaaacagcactccgacccctgtgccctgaacccgaggatgacacgcttttccgaggaagcctgtgctgtgctgactagcccgacattcgaggcctgccacagggccgtgtcccctctgccatacctgagaaattgccgttacgatgtgtgttcgtgctccgacggccgggagtgcctgtgtggagctctggcttcatacgcggccgcgtgtgccggtcgcggcgtccgtgtggcttggcgcgagcccgggagatgtgagttgaactgccccaaagggcaggtatacttgcaatgcggcacgccatgtaatttgacctgcagatctctcagctacccagatgaagagtgcaatgaggcatgcttagaggggtgtttttgcccccccggcctctatatggatgaaagaggagattgtgttccgaaggcgcagtgcccctgttactacgacggggaaatcttccagcccgaagacatcttctcagaccatcacacaatgtgctattgcgaggatggattcatgcattgtacaatgtccggcgtacctgggagtctgctgcctgatgccgtcctgtcgtccccactgtcacacagatctaagcggtctcttagctgcagacccccaatggtcaagcttgtatgtcccgccgataacctgagagctgaaggactggaatgtactaagacgtgtcagaactacgacctggagtgcatgagcatgggctgtgtgtccgggtgcttatgccctcctgggatggtcagacacgagaatcggtgcgttgccttggaacggtgtccctgctttcaccagggtaaggagtatgcgcctggggagactgtgaaaataggatgtaatacatgtgtctgtcaagatcggaaatggaattgcacggaccacgtgtgcgacgccacttgcagtaccattggtatggctcattatctgacgttcgacggtctaaaatacttgttccccggtgagtgtcagtacgtgctcgtccaagattattgcggctcgaaccctggtaccttcagaattctggtcggaaataaagggtgttcccatccaagcgtgaagtgcaagaaacgcgtgaccatcctcgtggagggaggtgaaattgagctcttcgatggagaggttaatgtgaaaaggccaatgaaggacgaaacccacttcgaggtggttgaatccgggcgatacattatcctcctgctgggtaaagcactctcagtggtttgggaccgacatctcagtatcagtgtcgtgctcaagcaaacataccaagagaaggtgtgcgggctctgcggcaattttgacgggattcaaaataacgacctgacaagtagtaatctccaggtggaggaagatcctgtggatttcggaaactcatggaaggtgtcttcccagtgtgccgacactagaaaagtgcccctcgactcttcccctgctacctgtcacaataacattatgaagcagactatggttgattcaagctgtaggatactgacatccgacgtgtttcaggactgtaataaactggtggacccagagccgtacttggacgtctgcatctacgacacctgttcttgcgagtcgatcggtgattgtgcgtgtttttgtgatactatcgcagcttacgcgcatgtgtgtgctcagcatgggaaagtggtcacctggcgaaccgccacactgtgcccacagtcatgcgaggaacgcaatctgagggaaaatggatatgaatgcgagtggaggtacaatagctgcgccccagcctgccaggtcacttgtcagcaccctgaaccgctggcctgcccggtgcagtgcgtggaaggctgccacgcccactgcccgcctggcaaaatccttgacgaactactccagacttgtgtggaccccgaagattgccctgtttgtgaagtggccggccgaaggtttgcaagcggtaaaaaggtgactctcaacccatcagatcctgagcattgtcagatctgccattgcgacgtcgttaacttgacatgcgaggcttgccaggaacctggcgggctcgtagtcccgcctaccgacgctccagtctctcccactaccctatacgtcgaggacataagcgaacctcctctgcatgatttctactgctcacggctgctggatctggtttttttgttggacggctcctcccgtctgagtgaggcagagtttgaggttttaaaagcttttgtcgttgacatgatggagagattacgtatatcccagaaatgggtcagggttgctgtggtggagtatcatgacggtagtcatgcgtacattggcctgaaagatcgtaaacggccgtcggaattaaggcgaatagcaagtcaggtgaagtatgctggctcccaggtcgcgtccaccagcgaggtcttgaagtacaccctgttccagatctttagcaaaatcgatagacccgaagcgagccgcatcaccctgctcttaatggcctcacaggaaccccagcgaatgtctcggaacttcgtacggtatgtccaggggctcaagaaaaagaaagtgatcgtcatacccgtgggcataggacctcatgctaaccttaagcagatccgcttaatcgaaaagcaggccccggagaataaggcgtttgtcttaagtagtgttgatgagttagagcagcagagggacgagattgtgtcctatctttgcgacctcgcgcccgaggctccacctcctacacttcctccagacatggcccaggtgacggtcggtcccggactgctgggcgtgagtaccctgggacctaaacgcaacagcatggtccttgacgtcgcctttgtgctggaaggctctgacaaaataggcgaggctgacttcaatcggtctaaggaatttatggaagaagtgattcagcgaatggacgtgggccaggattccattcacgttacagttttacagtacagttacatggttaccgtggagtaccccttcagtgaagcacaaagcaagggcgatatcctgcagcgtgtgagagaaatccgttatcagggagggaatagaactaacaccggcctggcactccggtatctatccgaccatagtttcctagtgtcccaaggcgaccgggagcaagcaccaaacctcgtgtacatggtcaccggaaacccagccagcgacgaaatcaaaaggctcccgggggacatccaggtagtcccaatcggcgttggacccaacgccaatgttcaagagctggagaggatcggatggcccaatgcccccatactgatacaggacttcgaaactctgcccagagaggctccagatctggttcttcagagatgctgctccggcgagggcctgcagattcctaccctgtcccccgcccccgactgtagccagcctctggacgtaattctgctcctggacgggtcgtccagctttcccgcgtcctacttcgatgaaatgaaatcgttcgcaaaagcattcatcagcaaggctaatataggcccgcgtctgacacaagtcagtgtgcttcagtatggctcaattactaccattgatgtcccctggaatgtggttcccgaaaaagcccatctgctctcattggtggatgtcatgcagcgggaggggggtccttcccaaataggcgatgctctgggattcgccgtccgatatctgacaagcgagatgcatggggcacgccctggagcttccaaggccgttgtgattctagtaaccgacgtgtcagtggacagcgtcgatgcagctgctgatgccgcccggtctaacagagtgaccgtgttccctattggcattggggaccggtatgacgcggctcagcttcgcattcttgccggtccagcaggcgattccaatgtcgtgaaactgcaaagaatcgaagacctgccaacaatggtgaccctcggaaattcattcctgcacaaactgtgttcagggttcgtacgaatctgcatggacgaagatggtaacgagaagagacctggtgatgtgtggactctgcccgatcagtgtcacaccgtgacttgtcagcccgatggtcagaccttgttaaaaagtcatcgggtgaattgcgatcgtggcctgcggccatcatgcccgaactcccagtcaccggtgaaagttgaggaaacttgcggctgcagatggacatgcccatgtgtctgcacaggctctagcactcggcatatcgtgacatttgacggccagaacttcaagctgacaggtagttgctcctatgtcctgtttcagaataaggaacaagatctcgaagtgatcctgcacaatggcgcctgctctccaggtgcccggcagggctgcatgaagtcaatcgaagtgaagcattcggcccttagtgttgagctccacagcgacatggaagtgacagtcaatggcagattggtctccgtcccttacgtgggaggaaatatggaggttaacgtgtacggggcgatcatgcatgaggttcggtttaatcacttgggtcatatcttcacttttacccctcagaacaacgaattccagctccaactcagtccgaagaccttcgcctccaaaacatacggtctgtgcggaatatgcgacgagaacggagcaaacgactttatgctgagagatggaaccgtcacaaccgactggaagacgctggtacaggaatggaccgttcaaagacctggccagacctgtcaaccgatcttggaggagcagtgcctagtgcctgacagcagccattgccaggtcttgctgctgcctttgttcgctgaatgccacaaggttctagcaccagcaactttctacgctatttgtcaacaagatagttgccaccaggaacaggtctgtgaggttatcgcatcttatgcgcatttgtgtcgaacgaacggagtatgcgtggattggcgcacacccgacttctgcgcaatgagctgcccaccttctcttgtctataaccactgtgagcacggctgtcctcggcactgtgacgggaacgtcagcagttgcggcgatcatccgtccgagggctgtttctgcccacccgacaaggtgatgttggaaggttcatgcgttcctgaagaggcatgcacacagtgcattggcgaggatggcgtgcagcatcaattcctagaggcttgggtgccagatcatcagccatgccagatatgtacctgcttgagtggccgaaaggtcaactgcacaactcagccatgcccgaccgcgaaggccccgacatgcggtctgtgcgaggttgccaggttgagacagaatgccgaccaatgttgccccgagtatgagtgcgtctgcgacccagtgtcttgtgatctccccccggtcccccactgcgaaaggggactgcaacccaccttgacgaacccaggcgagtgcaggcccaacttcacctgtgcatgtcgcaaggaggagtgtaaacgagtgtcccctcccagctgccctccacaccggcttccgactcttcgtaagactcaatgctgtgatgaatacgagtgcgcctgcaactgtgttaactccacggtgtcatgtccactggggtatctggcctccactgcaacaaatgactgtggctgtacgactactacgtgcctgcctgacaaggtttgcgttcacagaagcaccatttaccccgtgggacagttttgggaagagggttgtgacgtgtgtacatgtaccgacatggaagatgcagtgatggggttacgcgtggcccagtgtagtcagaaaccatgtgaggatagctgtcgctcgggcttcacgtatgttctccacgaaggggaatgttgtgggagatgtctcccaagtgcatgtgaagtcgtgacggggtccccgcgcggagacagccagagctcatggaaatcggttggcagtcaatgggcaagccctgagaatccctgcttaatcaacgagtgtgtgcgcgtgaaggaggaagtgttcatccagcaacggaatgtgtcttgtccccagctggaggtgcccgtttgcccctctggtttccaactctcctgtaaaaccagcgcttgttgtccctcctgtcgctgtgagcggatggaggcatgcatgctcaatggcactgtaatcggacctgggaagaccgtgatgattgacgtttgcaccacatgccgctgcatggtgcaggtcggggttattagcgggttcaagctcgagtgtcgaaaaactacctgcaatccgtgcccccttggatacaaggaggagaacaacacgggtgagtgctgtggacggtgtctgcccaccgcctgcactattcagctgagaggtggccagatcatgaccttgaagcgggacgagactctgcaggatggctgcgatacacatttctgtaaggttaacgaacggggagagtatttttgggagaagagagtgaccgggtgtccacccttcgatgagcacaagtgtctggccgaagggggaaaaattatgaagatccctggtacttgttgtgatacctgcgaggaacctgaatgcaacgacattacggctcggctgcagtatgtgaaggtcggaagttgtaagagtgaggtggaagtggacatccattattgtcaaggaaagtgcgccagcaaggccatgtactcaattgacataaacgacgtacaagatcaatgcagctgctgcagccctactagaaccgagccaatgcaggtggctctgcattgtactaatggatctgtggtgtatcatgaagtcctgaacgccatggagtgtaagtgtagcccaagaaagtgcagcaaatag

SEQ ID NO: 2912 - DNA, 816 bp, Artificial Sequence
  Description of Artificial Sequence: Synthetic coding sequence
atgactgagccccaggtgggctgtgtcgcctgtccaagggtccataaggagcctgctcaagtgggtaccccatggcctgcaaagcctcgcagtcaccctagaaaacgcgaccctacggctctgctgcccagatctctatggcctgcatgccaggagtcggtaaccgcactgtgctttttacaagagacagtcgaacgtttggggcagtcacccgcccaggacacccccgtactgggcccatgctgggacccaatggcacttggcacacagggacgccttctgctggatcgcgattctaaagacacccagactcgcatctcgcaaaagggccgcagactccagccacctgggaccccaagtgctcctccacagcgacgacccagaaagcaactcaacccctgtaggggcacggagcgagtggacccaggattcgagggggtgaccctaaaattccagattaagcctgatagctctctgcaaatcatccccacctattccttgccgtgcagttccagaagtcaggagtcgcctgccgatgcagtgggcggaccagcagcccacccgggaggcaccgaggcacatagcgccgggtcggaggccctggagccaagacgatgtgccagctgcaggacccagcgtacgcctctgtggcgcgacgcggaagatggtacccccctgtgtaatgcctgtggaattagatataagaagtacggcactaggtgctcaagttgctggctcgtcccaagaaagaatgtgcagcctaagagactctgcgggagatgcggagtttcgcttgacccgatacaggaggggtag

SEQ ID NO: 2913 - DNA, 1182 bp, Artificial Sequence
  Description of Artificial Sequence: Synthetic coding sequence
atgaccacctacagcgacaagggggccaagccagagcggggccgcttcctgcacttccacagcgtgaccttctgggtgggcaatgccaagcaggccaccagcttctactgcagcaagatgggctttgagcccctggcctaccggggcctggagaccggcagccgggaggtggtgagccacgtgatcaagcagggcaagatcgtgtttgtgctgagcagcgccctgaacccctggaacaaggagatgggagaccacctggtgaagcatggagatggagtgaaggacatcgcctttgaggtggaggactgtgactacatcgtgcagaaggcccgggagcggggggccaagatcatgagggagccctgggtggagcaggacaagtttgggaaggtgaagtttgctgtgctgcagacctatggagacaccacccacaccctggtggagaagatgaactacatcggccagttcctgcccggctatgaggccccagccttcatggaccccctgctgcccaagctgcccaagtgcagcctggagatgattgaccacatcgtgggcaaccagcctgaccaggagatggtgtctgccagcgagtggtacctgaagaacctgcagttccaccgcttctggagcgtggatgacacccaggtgcacacagagtacagcagcctgcggagcatcgtggtggccaactatgaggagagcatcaagatgcccatcaatgaaccagcccctgggaagaagaagagccagatccaggagtatgtggactacaatggaggagctggggtgcagcacatcgccctgaagacagaggacatcatcacagccatccgccacctgcgggagcggggcctggagttcctgtctgtgcccagcacctactacaagcagctgcgggagaagctgaagacagccaagatcaaggtgaaggagaacattgatgccctggaggagctgaagatcctggtggactatgatgagaagggctacctgctgcagatcttcaccaagcctgtgcaggaccggcccaccctcttcctggaggtgatccagaggcacaaccaccagggctttggagctggcaacttcaacagcctcttcaaggcctttgaggaggagcagaacctgcggggcaacctgaccaacatggagaccaatggagtggtgcccggcatgtag

SEQ ID NO: 2914 - DNA, 1065 bp, Artificial Sequence
  Description of Artificial Sequence: Synthetic coding sequence
atgggctttgagcccctggcctaccggggcctggagaccggcagccgggaggtggtgagccacgtgatcaagcagggcaagatcgtgtttgtgctgagcagcgccctgaacccctggaacaaggagatgggagaccacctggtgaagcatggagatggagtgaaggacatcgcctttgaggtggaggactgtgactacatcgtgcagaaggcccgggagcggggggccaagatcatgagggagccctgggtggagcaggacaagtttgggaaggtgaagtttgctgtgctgcagacctacggggacaccacccacaccctggtggagaagatgaactacatcggccagttcctgcccggctatgaggccccagccttcatggaccccctgctgcccaagctgcccaagtgcagcctggagatgattgaccacatcgtgggcaaccagcctgaccaggagatggtgtctgccagcgagtggtacctgaagaacctgcagttccaccgcttctggagcgtggatgacacccaggtgcacacagagtacagcagcctgcggagcatcgtggtggccaactatgaggagagcatcaagatgcccatcaatgagcccgcccctgggaagaagaagagccagatccaggagtatgtggactacaacggcggggccggcgtgcagcacatcgccctgaagacagaggacatcatcacagccatccgccacctgcgggagcggggcctggagttcctgtctgtgcccagcacctactacaagcagctgcgggagaagctgaagacagccaagatcaaggtgaaggaaaatattgatgccctggaggagctgaagatcctggtggactatgatgagaagggctacctgctgcagatcttcaccaagcctgtgcaggaccggcccaccctcttcctggaggtgatccagaggcacaaccaccagggctttggagctggcaacttcaacagcctcttcaaggcctttgaggaggagcagaacctgcggggcaacctgaccaacatggagaccaacggggtggtgcccggcatgtag

SEQ ID NO: 2915 - DNA, 1173 bp, Artificial Sequence
  Description of Artificial Sequence: Synthetic coding sequence
tacagcgacaagggggccaagccagagcggggccgcttcctgcacttccacagcgtgaccttctgggtgggcaatgccaagcaggccaccagcttctactgcagcaagatgggctttgagcccctggcctaccggggcctggagaccggcagccgggaggtggtgagccacgtgatcaagcagggcaagatcgtgtttgtgctgagcagcgccctgaacccctggaacaaggagatgggagaccacctggtgaagcatggagatggagtgaaggacatcgcctttgaggtggaggactgtgactacatcgtgcagaaggcccgggagcggggggccaagatcatgagggagccctgggtggagcaggacaagtttgggaaggtgaagtttgctgtgctgcagacctacggggacaccacccacaccctggtggagaagatgaactacatcggccagttcctgcccggctatgaggccccagccttcatggaccccctgctgcccaagctgcccaagtgcagcctggagatgattgaccacatcgtgggcaaccagcctgaccaggagatggtgtctgccagcgagtggtacctgaagaacctgcagttccaccgcttctggagcgtggatgacacccaggtgcacacagagtacagcagcctgcggagcatcgtggtggccaactatgaggagagcatcaagatgcccatcaatgagcccgcccctgggaagaagaagagccagatccaggagtatgtggactacaacggcggggccggcgtgcagcacatcgccctgaagacagaggacatcatcacagccatccgccacctgcgggagcggggcctggagttcctgtctgtgcccagcacctactacaagcagctgcgggagaagctgaagacagccaagatcaaggtgaaggaaaatattgatgccctggaggagctgaagatcctggtggactatgatgagaagggctacctgctgcagatcttcaccaagcctgtgcaggaccggcccaccctcttcctggaggtgatccagaggcacaaccaccagggctttggagctggcaacttcaacagcctcttcaaggcctttgaggaggagcagaacctgcggggcaacctgaccaacatggagaccaacggggtggtgcccggcatgtag

SEQ ID NO: 2916 - DNA, 438 bp, Artificial Sequence
  Description of Artificial Sequence: Synthetic coding sequence
atgagcacagaaggaggcggccgccgctgccaggcccaggtgagccgccgcatctccttcagcgccagccaccggctgtacagcaagttcctgagtgatgaggagaacctgaagctgtttgggaagtgcaacaaccccaatggacatggccacaactacaaggtggtggtgacagtgcacggggagattgatcctgccaccggcatggtgatgaacctggccgacctgaagaagtacatggaggaggccatcatgcagcccctggaccacaagaacctggacatggatgtgccctactttgctgatgtggtgtccaccacagaaaatgtggccgtgtacatctgggacaacctgcagaaggtgctgcctgtgggcgtgctgtacaaggtgaaggtgtatgaaacagacaacaacatcgtggtgtacaagggggagtag

SEQ ID NO: 2917 - DNA, 4284 bp, Artificial Sequence
  Description of Artificial Sequence: Synthetic coding sequence
atgcaccagaggcacccccgggcccgctgcccccccctgtgtgtggccggcatcctggcctgtggcttcctgctgggctgctggggccccagccacttccagcagagctgcctgcaggccctggagccccaggccgtgagcagctacctgagccctggggcccccctgaagggccggccccccagccctggcttccagaggcagaggcagaggcagaggagagctgctgggggcatcctgcacctggagctgctggtggccgtgggcccagatgtgttccaggcccaccaggaggacacagaaagatatgtgctgaccaacctgaacatcggggctgagctgctgcgggaccccagcctgggcgcccagttccgggtgcacctggtgaagatggtgatcctgacagagcctgagggcgcccccaacatcacagccaacctgaccagcagcctgctgtctgtgtgtggctggagccagaccatcaacccagaagatgacacagatcctggccacgccgacctggtgctgtacatcaccaggtttgacctggagctgcctgatggcaaccggcaggtgcggggcgtgacccagctgggcggggcctgcagccccacctggagctgcctgatcacagaggacaccggctttgacctgggcgtgaccatcgcccacgagatcggccacagctttggcctggagcatgatggagcccctggcagcggctgcggccccagcggccacgtgatggccagtgatggagctgccccccgggccggcctggcctggagcccctgcagccggcggcagctgctgagcctgctgtctgctggccgggcccgctgtgtgtgggaccccccccggccccagcccggcagcgctggccaccccccagatgcccagcccggcctgtactacagcgccaatgagcagtgccgggtggccttcggccccaaggctgtggcctgcacctttgcccgggagcacctggacatgtgccaggccctgagctgccacacagaccccctggaccagagcagctgcagccggctgctggtgcccctgctggatggaacagaatgtggggtggagaagtggtgcagcaagggccgctgccgcagcctggtggagctgacccccatcgctgctgtgcacggccgctggagctcctggggccccaggagcccctgcagccgcagctgtggcggcggcgtggtgacccggcggcggcagtgcaacaaccccaggcctgccttcggcggccgggcctgtgtgggcgctgacctgcaggccgagatgtgcaacacccaggcctgtgagaagacccagctggagttcatgagccagcagtgtgccaggacagatggccagcccctgcggagcagccctgggggcgccagcttctaccactggggcgctgctgtgccccacagccagggagatgccctgtgccgccacatgtgccgggccatcggggagagcttcatcatgaagagaggagacagcttcctggatggcacccgctgcatgcccagcggccccagagaagatggcaccctgagcctgtgtgtgtctggcagctgcaggaccttcggctgtgatggccgcatggacagccagcaggtgtgggaccgctgccaggtgtgtggcggggacaacagcacctgcagccccaggaagggcagcttcaccgctggccgggcccgggagtatgtgaccttcctgactgtgacccccaacctgacctctgtgtacatcgccaaccaccggcccctcttcacccacctggccgtgagaattggaggccgctacgtggtggccggcaagatgagcatcagccccaacaccacctaccccagcctgctggaggatggccgggtggagtacagagtggccctgacagaggaccggctgccccggctggaggagatccgcatctggggccccctgcaggaggatgctgacatccaggtgtacagaagatatggagaggagtatggcaacctgaccaggccagacatcaccttcacctacttccagcccaagccccggcaggcctgggtgtgggccgctgtgcggggcccctgcagcgtgtcctgtggggccggcctgcgctgggtgaactacagctgcctggaccaggccaggaaggagctggtggagaccgtgcagtgccagggcagccagcagcccccagcctggccagaggcctgtgtgctggagccctgccccccctactgggccgtgggggactttggcccctgcagcgccagctgtggcggcggcctgcgggagaggcctgtgcgctgtgtggaggcccagggcagcctgctgaagaccctgcccccagcccgctgcagagctggggcccagcagcctgctgtggccctggagacctgcaacccccagccctgcccagcccgctgggaggtgtctgagcccagcagctgcaccagcgctggaggagctggcctggccctggagaatgagacctgtgtgcctggagcagatggcctggaggcccctgtgacagagggccctggctctgtggatgagaagctgcctgcccctgagccctgtgtgggcatgagctgccccccaggctggggccacctggatgccaccagcgctggggagaaggcccccagcccctggggcagcatcagaactggagcccaggccgcccacgtgtggaccccagctgctggcagctgcagcgtgtcctgtggccggggcctgatggagctgcgcttcctgtgcatggacagcgccctgcgggtgcctgtgcaggaggagctgtgtggcctggccagcaagccaggcagccggcgggaggtgtgccaggccgtgccctgcccagcccgctggcagtacaagctggccgcctgcagcgtgtcctgtggccggggcgtggtgcggcgcatcctgtactgtgcccgggcccatggagaagatgatggagaggagatcctgctggacacccagtgccagggcctgcccaggcctgagccccaggaggcctgcagcctggagccctgccccccacgctggaaggtgatgagcctgggcccctgcagcgccagctgtggcctgggcacagcccggcgctctgtggcctgtgtgcagctggaccagggccaggatgtggaggtggatgaagctgcctgtgccgccctggtgcggcctgaggcctctgtgccctgcctgattgctgactgcacctaccgctggcacgtgggcacctggatggagtgcagcgtgtcctgtggagatggcatccagaggagaagagacacctgcctgggcccccaggcccaggcccctgtgcctgctgacttctgccagcacctgcccaagcctgtgacagtgcggggctgctgggccggcccctgtgtgggccagggcacccccagcctggtgccccatgaggaggccgccgcccctggccgcaccacagccaccccagctggggccagcctggagtggagccaggcccggggcctgctcttctccccagccccccagccccggcggctgctgcccggcccccaggagaacagcgtgcagagcagcgcctgtggccggcagcacctggagcccaccggcaccatcgacatgaggggccctggccaggccgactgtgctgtggccatcggccggcccctgggggaggtggtgaccctgcgggtgctggagagcagcctgaactgcagcgctggggacatgctgctgctgtggggccgcctgacctggaggaagatgtgcaggaagctgctggacatgaccttcagcagcaagaccaacaccctggtggtgcggcagagatgtggccggcctgggggcggcgtgctgctgcgctatggcagccagctggcccctgagaccttctaccgggagtgtgacatgcagctgtttggcccctggggcgagatcgtgagccccagcctgagccctgccaccagcaatgctgggggctgccgcctcttcatcaacgtggccccccacgccagaattgccatccacgccctggccaccaacatgggcgccggcacagagggcgccaatgccagctacatcctgatccgggacacccacagcctgcggaccacagccttccacggccagcaggtgctgtactgggagagcgagagcagccaggccgagatggagttcagcgagggcttcctgaaggcccaggccagcctgcggggccagtactggaccctgcagagctgggtgcctgagatgcaggacccccagagctggaagggcaaggagggcacctag

SEQ ID NO: 2918 - DNA, 3309 bp, Artificial Sequence
  Description of Artificial Sequence: Synthetic coding sequence
atgttccagctgcctgtgaacaacctgggcagcctgaggaaggccaggaagacagtgaagaagatcctgagtgacatcggcctggagtactgcaaggagcacatcgaggacttcaagcagtttgagcccaatgacttctacctgaagaacaccacctgggaggatgtgggcctgtgggaccccagcctgaccaagaaccaggactaccgcaccaagcccttctgctgcagcgcctgccccttcagcagcaagttcttcagcgcctacaagagccacttcagaaatgtgcacagtgaagattttgagaaccgcatcctgctgaactgcccctactgcaccttcaatgctgacaagaagaccctggagacccacatcaagatcttccacgccccaaatgccagcgcccccagcagcagcctgagcaccttcaaggacaagaacaagaatgatggcctgaagcccaagcaggccgacagcgtggagcaggccgtgtactactgcaagaagtgcacctacagagaccccctgtatgaaattgtgaggaagcacatctaccgggagcacttccagcacgtggccgccccctacatcgccaaggccggggagaagagcctgaatggagctgtgcccctgggcagcaatgcccgggaggagagcagcatccactgcaagcgctgcctcttcatgcccaagagctatgaggccctggtgcagcacgtgattgaggaccacgagagaattggctaccaggtgacagccatgattggccacaccaacgtggtggtgcccaggagcaagcccctgatgctgattgcccccaagccccaggacaagaagtccatgggcctgcccccaagaattggcagcctggccagcggaaatgtgcgcagcctgcccagccagcagatggtgaaccggctgagcatccccaagcccaacctgaacagcactggagtgaacatgatgagctctgtgcacctgcagcagaacaactacggcgtgaagtctgtgggccagggctacagcgtgggccagagcatgaggctgggcctgggcggcaatgcccctgtgtccatcccccagcagagccagagcgtgaagcagctgctgcccagcggaaatggccgctcctatggcctgggcagcgagcagaggagccaggccccagcccgctacagcctgcagagcgccaatgccagcagcctgagcagcggccagctgaagagccccagcctgagccagagccaggccagccgggtgctgggccagagcagcagcaagccagctgctgctgccactggacctcctcctggcaacaccagcagcacccagaagtggaagatctgcaccatctgcaatgaactcttcccagaaaatgtgtacagcgtgcactttgagaaggagcacaaggccgagaaggtgcctgctgtggccaactacatcatgaagatccacaacttcaccagcaagtgcctgtactgcaaccgctacctgcccacagacaccctgctgaaccacatgctgatccacggcctgagctgcccctactgccgcagcaccttcaatgatgtggagaagatggccgcccacatgaggatggtgcacattgatgaggagatgggccccaagacagacagcaccctgagctttgacctgaccctgcagcagggcagccacaccaacatccacctgctggtgaccacctacaacctgagagatgccccagctgagagcgtggcctaccacgcccagaacaacccccctgtgccccccaagccccagcccaaggtgcaggagaaggctgacatccctgtgaagagcagcccccaggccgctgtgccctacaagaaggatgtgggcaagaccctgtgccccctgtgcttcagcatcctgaagggccccatcagtgatgccctggcccaccacctgcgggagcggcaccaggtgatccagacagtgcaccctgtggagaagaagctgacctacaagtgcatccactgcctgggcgtgtacaccagcaacatgacagccagcaccatcaccctgcacctggtgcactgccggggcgtgggcaagacccagaatggccaggacaagaccaatgcccccagccggctgaaccagagccccagcctggcccctgtgaagaggacctatgagcagatggagttccccctgctgaagaagaggaagctggatgatgacagcgacagccccagcttctttgaggagaagccagaggagcctgtggtgctggccctggaccccaagggccatgaagatgacagctatgaggccaggaagagcttcctgaccaagtacttcaacaagcagccctaccccacccggcgggagattgagaagctggccgccagcctgtggctgtggaagagtgacatcgccagccacttcagcaacaagaggaagaagtgtgtgcgggactgtgagaagtacaagccaggagtgctgctgggcttcaacatgaaggagctgaacaaggtgaagcatgagatggactttgatgctgagtggctgtttgaaaatcatgatgagaaggacagccgggtgaatgccagcaagacagctgacaagaagctgaacctgggcaaggaggatgacagcagcagtgacagctttgagaacctggaggaggagagcaatgaaagtggcagcccctttgatcctgtgtttgaggtggagcccaagatcagcaatgacaaccctgaggagcacgtgctgaaggtgatcccagaagatgccagcgagagcgaggagaagctggaccagaaggaggatggcagcaaatatgagaccatccacctgacagaggagcccaccaagctgatgcacaatgccagtgacagcgaggtggaccaggatgatgtggtggagtggaaggatggagccagccccagcgagagcggccctggcagccagcaggtgtctgactttgaggacaacacctgtgagatgaagccaggcacctggagcgatgagagcagccagagtgaagatgcccggagcagcaagccagctgccaagaagaaggccaccatgcagggcgaccgggagcagctgaagtggaagaacagcagctatggcaaggtggagggcttctggagcaaggaccagagccagtggaagaatgcctctgaaaatgatgagcggctgagcaacccccagatcgagtggcagaacagcaccattgattctgaagatggagagcagtttgacaacatgacagatggagtggccgagcccatgcacggcagcctggccggcgtgaagctgagcagccagcaggcctag

SEQ ID NO: 2919 - DNA, 3309 bp, Artificial Sequence; identical to SEQ ID NO: 2918
  Description of Artificial Sequence: Synthetic coding sequence

SEQ ID NO: 2920 - DNA, 3309 bp, Artificial Sequence; identical to SEQ ID NO: 2918
  Description of Artificial Sequence: Synthetic coding sequence

SEQ ID NO: 2921 - DNA, 3309 bp, Artificial Sequence; identical to SEQ ID NO: 2918
  Description of Artificial Sequence: Synthetic coding sequence

SEQ ID NO: 2922 - DNA, 522 bp, Artificial Sequence
  Description of Artificial Sequence: Synthetic coding sequence
atgttccagctgcctgtgaacaacctgggcagcctgaggaaggccaggaagacagtgaagaagatcctgagtgacatcggcctggagtactgcaaggagcacatcgaggacttcaagcagtttgagcccaatgacttctacctgaagaacaccacctgggaggatgtgggcctgtgggaccccagcctgaccaagaaccaggactaccgcaccaagcccttctgctgcagcgcctgccccttcagcagcaagttcttcagcgcctacaagagccacttcagaaatgtgcacagtgaagattttgagaaccgcatcctgctgaactgcccctactgcaccttcaatgctgacaagaagaccctggagacccacatcaagatcttccacgccccaaatgccagcgcccccagcagcagcctgagcaccttcaaggacaagaacaagaatgatggcctgaagcccaagcaggccgacagcgtggagcaggccgtgtactactgcaagaagtgcacctacagatag

SEQ ID NO: 2923 - DNA, 441 bp, Artificial Sequence
  Description of Artificial Sequence: Synthetic coding sequence
atggtgatcctgacagagcctgagggcgcccccaacatcacagccaacctgaccagcagcctgctgtctgtgtgtggctggagccagaccatcaacccagaagatgacacagatcctggccacgccgacctggtgctgtacatcaccaggtttgacctggagctgcctgatggcaaccggcaggtgcggggcgtgacccagctgggcggggcctgcagccccacctggagctgcctgatcacagaggacaccggctttgacctgggcgtgaccatcgcccacgagatcggccaccgcatctgtgcccggcccagccctgccacccagacccgctggaccaaggctgctgctgctgccagcagcttcctgtcctggatgggccagaatgtggcctggaggtctggggccccccgggtggccgccgccccctggtggagctag

SEQ ID NO: 2924 - DNA, 4116 bp, Artificial Sequence
  Description of Artificial Sequence: Synthetic coding sequence
atgcaccagaggcacccccgggcccgctgcccccccctgtgtgtggccggcatcctggcctgtggcttcctgctgggctgctggggccccagccacttccagcagagctgcctgcaggccctggagccccaggccgtgagcagctacctgagccctggggcccccctgaagggccggccccccagccctggcttccagaggcagaggcagaggcagaggagagctgctgggggcatcctgcacctggagctgctggtggccgtgggcccagatgtgttccaggcccaccaggaggacacagaaagatatgtgctgaccaacctgaacatcggggctgagctgctgcgggaccccagcctgggcgcccagttccgggtgcacctggtgaagatggtgatcctgacagagcctgagggcgcccccaacatcacagccaacctgaccagcagcctgctgtctgtgtgtggctggagccagaccatcaacccagaagatgacacagatcctggccacgccgacctggtgctgtacatcaccaggtttgacctggagctgcctgatggcaaccggcaggtgcggggcgtgacccagctgggcggggcctgcagccccacctggagctgcctgatcacagaggacaccggctttgacctgggcgtgaccatcgcccacgagatcggccacagctttggcctggagcatgatggagcccctggcagcggctgcggccccagcggccacgtgatggccagtgatggagctgccccccgggccggcctggcctggagcccctgcagccggcggcagctgctgagcctgctgtctgctggccgggcccgctgtgtgtgggaccccccccggccccagcccggcagcgctggccaccccccagatgcccagcccggcctgtactacagcgccaatgagcagtgccgggtggccttcggccccaaggctgtggcctgcacctttgcccgggagcacctggacatgtgccaggccctgagctgccacacagaccccctggaccagagcagctgcagccggctgctggtgcccctgctggatggaacagaatgtggggtggagaagtggtgcagcaagggccgctgccgcagcctggtggagctgacccccatcgctgctgtgcacggccgctggagctcctggggccccaggagcccctgcagccgcagctgtggcggcggcgtggtgacccggcggcggcagtgcaacaaccccaggcctgccttcggcggccgggcctgtgtgggcgctgacctgcaggccgagatgtgcaacacccaggcctgtgagaagacccagctggagttcatgagccagcagtgtgccaggacagatggccagcccctgcggagcagccctgggggcgccagcttctaccactggggcgctgctgtgccccacagccagggagatgccctgtgccgccacatgtgccgggccatcggggagagcttcatcatgaagagaggagacagcttcctggatggcacccgctgcatgcccagcggccccagagaagatggcaccctgagcctgtgtgtgtctggcagctgcaggaccttcggctgtgatggccgcatggacagccagcaggtgtgggaccgctgccaggtgtgtggcggggacaacagcacctgcagccccaggaagggcagcttcaccgctggccgggcccgggagtatgtgaccttcctgactgtgacccccaacctgacctctgtgtacatcgccaaccaccggcccctcttcacccacctggccgtgagaattggaggccgctacgtggtggccggcaagatgagcatcagccccaacaccacctaccccagcctgctggaggatggccgggtggagtacagagtggccctgacagaggaccggctgccccggctggaggagatccgcatctggggccccctgcaggaggatgctgacatccaggtgtacagaagatatggagaggagtatggcaacctgaccaggccagacatcaccttcacctacttccagcccaagccccggcaggcctgggtgtgggccgctgtgcggggcccctgcagcgtgtcctgtggggccggcctgcgctgggtgaactacagctgcctggaccaggccaggaaggagctggtggagaccgtgcagtgccagggcagccagcagcccccagcctggccagaggcctgtgtgctggagccctgccccccctactgggccgtgggggactttggcccctgcagcgccagctgtggcggcggcctgcgggagaggcctgtgcgctgtgtggaggcccagggcagcctgctgaagaccctgcccccagcccgctgcagagctggggcccagcagcctgctgtggccctggagacctgcaacccccagccctgcccagcccgctgggaggtgtctgagcccagcagctgcaccagcgctggaggagctggcctggccctggagaatgagacctgtgtgcctggagcagatggcctggaggcccctgtgacagagggccctggctctgtggatgagaagctgcctgcccctgagccctgtgtgggcatgagctgccccccaggctggggccacctggatgccaccagcgctggggagaaggcccccagcccctggggcagcatcagaactggagcccaggccgcccacgtgtggaccccagctgctggcagctgcagcgtgtcctgtggccggggcctgatggagctgcgcttcctgtgcatggacagcgccctgcgggtgcctgtgcaggaggagctgtgtggcctggccagcaagccaggcagccggcgggaggtgtgccaggccgtgccctgcccagcccgctggcagtacaagctggccgcctgcagcgtgtcctgtggccggggcgtggtgcggcgcatcctgtactgtgcccgggcccatggagaagatgatggagaggagatcctgctggacacccagtgccagggcctgcccaggcctgagccccaggaggcctgcagcctggagccctgccccccacgctggaaggtgatgagcctgggcccctgcagcgccagctgtggcctgggcacagcccggcgctctgtggcctgtgtgcagctggaccagggccaggatgtggaggtggatgaagctgcctgtgccgccctggtgcggcctgaggcctctgtgccctgcctgattgctgactgcacctaccgctggcacgtgggcacctggatggagtgcagcgtgtcctgtggagatggcatccagaggagaagagacacctgcctgggcccccaggcccaggcccctgtgcctgctgacttctgccagcacctgcccaagcctgtgacagtgcggggctgctgggccggcccctgtgtgggccagggcgcctgtggccggcagcacctggagcccaccggcaccatcgacatgaggggccctggccaggccgactgtgctgtggccatcggccggcccctgggggaggtggtgaccctgcgggtgctggagagcagcctgaactgcagcgctggggacatgctgctgctgtggggccgcctgacctggaggaagatgtgcaggaagctgctggacatgaccttcagcagcaagaccaacaccctggtggtgcggcagagatgtggccggcctgggggcggcgtgctgctgcgctatggcagccagctggcccctgagaccttctaccgggagtgtgacatgcagctgtttggcccctggggcgagatcgtgagccccagcctgagccctgccaccagcaatgctgggggctgccgcctcttcatcaacgtggccccccacgccagaattgccatccacgccctggccaccaacatgggcgccggcacagagggcgccaatgccagctacatcctgatccgggacacccacagcctgcggaccacagccttccacggccagcaggtgctgtactgggagagcgagagcagccaggccgagatggagttcagcgagggcttcctgaaggcccaggccagcctgcggggccagtactggaccctgcagagctgggtgcctgagatgcaggacccccagagctggaagggcaaggagggcacctag

SEQ ID NO: 2925 - DNA, 4023 bp, Artificial Sequence
  Description of Artificial Sequence: Synthetic coding sequence
atgcaccagaggcacccccgggcccgctgcccccccctgtgtgtggccggcatcctggcctgtggcttcctgctgggctgctggggccccagccacttccagcagagctgcctgcaggccctggagccccaggccgtgagcagctacctgagccctggggcccccctgaagggccggccccccagccctggcttccagaggcagaggcagaggcagaggagagctgctgggggcatcctgcacctggagctgctggtggccgtgggcccagatgtgttccaggcccaccaggaggacacagaaagatatgtgctgaccaacctgaacatcggggctgagctgctgcgggaccccagcctgggcgcccagttccgggtgcacctggtgaagatggtgatcctgacagagcctgagggcgcccccaacatcacagccaacctgaccagcagcctgctgtctgtgtgtggctggagccagaccatcaacccagaagatgacacagatcctggccacgccgacctggtgctgtacatcaccaggtttgacctggagctgcctgatggcaaccggcaggtgcggggcgtgacccagctgggcggggcctgcagccccacctggagctgcctgatcacagaggacaccggctttgacctgggcgtgaccatcgcccacgagatcggccacagctttggcctggagcatgatggagcccctggcagcggctgcggccccagcggccacgtgatggccagtgatggagctgccccccgggccggcctggcctggagcccctgcagccggcggcagctgctgagcctgctgagcgccaatgagcagtgccgggtggccttcggccccaaggctgtggcctgcacctttgcccgggagcacctggacatgtgccaggccctgagctgccacacagaccccctggaccagagcagctgcagccggctgctggtgcccctgctggatggaacagaatgtggggtggagaagtggtgcagcaagggccgctgccgcagcctggtggagctgacccccatcgctgctgtgcacggccgctggagctcctggggccccaggagcccctgcagccgcagctgtggcggcggcgtggtgacccggcggcggcagtgcaacaaccccaggcctgcctttggaggccgggcctgtgtgggcgctgacctgcaggccgagatgtgcaacacccaggcctgtgagaagacccagctggagttcatgagccagcagtgtgccaggacagatggccagcccctgcggagcagccctggaggagccagcttctaccactggggcgctgctgtgccccacagccagggagatgccctgtgccgccacatgtgccgggccatcggggagagcttcatcatgaagagaggagacagcttcctggatggcacccgctgcatgcccagcggcccccgggaggatggcaccctgagcctgtgtgtgtctggcagctgcaggaccttcggctgtgatggccgcatggacagccagcaggtgtgggaccgctgccaggtgtgtggcggggacaacagcacctgcagccccaggaagggcagcttcaccgctggccgggcccgggagtatgtgaccttcctgactgtgacccccaacctgacctctgtgtacatcgccaaccaccggcccctcttcacccacctggccgtgcgcatcggcggccgctacgtggtggccggcaagatgagcatcagccccaacaccacctaccccagcctgctggaggatggccgggtggagtacagagtggccctgacagaagatcggctgccccggctggaggagatccgcatctggggccccctgcaggaggatgctgacatccaggtgtaccgccgctacggggaggagtatggcaacctgaccaggccagacatcaccttcacctacttccagcccaagccccggcaggcctgggtgtgggccgctgtgcggggcccctgcagcgtgtcctgtggggccggcctgcgctgggtgaactacagctgcctggaccaggccaggaaggagctggtggagaccgtgcagtgccagggcagccagcagcccccagcctggccagaggcctgtgtgctggagccctgccccccctactgggccgtgggggactttggcccctgcagcgccagctgtggcggcggcctgcgggagaggcctgtgcgctgtgtggaggcccagggcagcctgctgaagaccctgcccccagcccgctgccgggccggggcccagcagcctgctgtggccctggagacctgcaacccccagccctgcccagcccgctgggaggtgtctgagcccagcagctgcaccagcgctgggggcgccggcctggccctggagaatgagacctgtgtgcctggagcagatggcctggaggcccctgtgacagagggccctggctctgtggatgagaagctgcctgcccctgagccctgtgtgggcatgagctgccccccaggctggggccacctggatgccaccagcgctggggagaaggcccccagcccctggggcagcatcagaactggagcccaggccgcccacgtgtggaccccagctgctggcagctgcagcgtgtcctgtggccggggcctgatggagctgcgcttcctgtgcatggattctgccctgcgggtgcctgtgcaggaggagctgtgtggcctggccagcaagccaggcagcagaagagaggtgtgccaggccgtgccctgcccagcccgctggcagtacaagctggccgcctgcagcgtgtcctgtggccggggcgtggtgcggcgcatcctgtactgtgcccgggcccacggggaggatgatggagaggagatcctgctggacacccagtgccagggcctgcccaggcctgagccccaggaggcctgcagcctggagccctgccccccacgctggaaggtgatgagcctgggcccctgcagcgccagctgtggcctgggcacagccaggagatctgtggcctgtgtgcagctggaccagggccaggatgtggaggtggatgaggccgcctgtgccgccctggtgcggcctgaggcctctgtgccctgcctgattgctgactgcacctaccgctggcacgtgggcacctggatggagtgcagcgtgtcctgtggagatggcatccagaggcggcgggacacctgcctgggcccccaggcccaggcccctgtgcctgctgacttctgccagcacctgcccaagcctgtgacagtgcggggctgctgggccggcccctgtgtgggccagggcgcctgtggccggcagcacctggagcccaccggcaccatcgacatgaggggccctggccaggccgactgtgctgtggccatcggccggcccctgggggaggtggtgaccctgcgggtgctggagagcagcctgaactgcagcgctggggacatgctgctgctgtggggccgcctgacctggaggaagatgtgcaggaagctgctggacatgaccttcagcagcaagaccaacaccctggtggtgcggcagagatgtggccggcctgggggcggcgtgctgctgcgctatggcagccagctggcccctgagaccttctacagagaatgtgacatgcagctgtttggcccctggggcgagatcgtgagccccagcctgagccctgccaccagcaatgccggcggctgccgcctcttcatcaacgtggcccctcatgcccgcatcgccatccacgccctggccaccaacatgggcgccggcacagaaggagccaatgccagctacatcctgatccgggacacccacagcctgcggaccacagccttccacggccagcaggtgctgtactgggagagcgagagcagccaggccgagatggagttcagcgagggcttcctgaaggcccaggccagcctgcggggccagtactggaccctgcagagctgggtgcctgagatgcaggacccccagagctggaagggcaaggagggcacctag

SEQ ID NO: 2926 - DNA, 672 bp, Artificial Sequence
  Description of Artificial Sequence: Synthetic coding sequence
atgaggggccctggccaggccgactgtgctgtggccatcggccggcccctgggggaggtggtgaccctgcgggtgctggagagcagcctgaactgcagcgctggggacatgctgctgctgtggggccgcctgacctggaggaagatgtgcaggaagctgctggacatgaccttcagcagcaagaccaacaccctggtggtgcggcagagatgtggccggcctgggggcggcgtgctgctgcgctatggcagccagctggcccctgagaccttctaccgggagtgtgacatgcagctgtttggcccctggggcgagatcgtgagccccagcctgagccctgccaccagcaatgctgggggctgccgcctcttcatcaacgtggccccccacgccagaattgccatccacgccctggccaccaacatgggcgccggcacagagggcgccaatgccagctacatcctgatccgggacacccacagcctgcggaccacagccttccacggccagcaggtgctgtactgggagagcgagagcagccaggccgagatggagttcagcgagggcttcctgaaggcccaggccagcctgcggggccagtactggaccctgcagagctgggtgcctgagatgcaggacccccagagctggaagggcaaggagggcacctag

SEQ ID NO: 2927 - DNA, 1035 bp, Artificial Sequence
  Description of Artificial Sequence: Synthetic coding sequence
atgcaccagaggcacccccgggcccgctgcccccccctgtgtgtggccggcatcctggcctgtggcttcctgctgggctgctggggccccagccacttccagcagagctgcctgcaggccctggagccccaggccgtgagcagctacctgagccctggggcccccctgaagggccggccccccagccctggcttccagaggcagaggcagaggcagaggagagctgctgggggcatcctgcacctggagctgctggtggccgtgggcccagatgtgttccaggcccaccaggaggacacagaaagatatgtgctgaccaacctgaacatcggggctgagctgctgcgggaccccagcctgggcgcccagttccgggtgcacctggtgaagatggtgatcctgacagagcctgagggcgcccccaacatcacagccaacctgaccagcagcctgctgtctgtgtgtggctggagccagaccatcaacccagaagatgacacagatcctggccacgccgacctggtgctgtacatcaccaggtttgacctggagctgcctgatggcaaccggcaggtgcggggcgtgacccagctgggcggggcctgcagccccacctggagctgcctgatcacagaggacaccggctttgacctgggcgtgaccatcgcccacgagatcggccacagctttggcctggagcatgatggagcccctggcagcggctgcggccccagcggccacgtgatggccagtgatggagctgccccccgggccggcctggcctggagcccctgcagccggcggcagctgctgagcctgctgcggcctgtgccccccagccccctgcccctgctggccacccacctgtgtgccggccgcagcctgagcctgggccccagccaggagcccgcccctgggggcggccggggccccaggacccctgtgcccacccacaagaggccccgcttccagaccctgcccagcagctgccccctgctgcggcctgccagcagccgctgcaccccccgggactag

SEQ ID NO: 2928 - DNA, 831 bp, Artificial Sequence
  Description of Artificial Sequence: Synthetic coding sequence
atgcaccagaggcacccccgggcccgctgcccccccctgtgtgtggccggcatcctggcctgtggcttcctgctgggctgctggggccccagccacttccagcagagctgcctgcaggccctggagccccaggccgtgagcagctacctgagccctggggcccccctgaagggccggccccccagccctggcttccagaggcagaggcagaggcagaggagagctgctgggggcatcctgcacctggagctgctggtggccgtgggcccagatgtgttccaggcccaccaggaggacacagaaagatatgtgctgaccaacctgaacatcggggctgagctgctgcgggaccccagcctgggcgcccagttccgggtgcacctggtgaagatggtgatcctgacagagcctgagggcgcccccaacatcacagccaacctgaccagcagcctgctgtctgtgtgtggctggagccagaccatcaacccagaagatgacacagatcctggccacgccgacctggtgctgtacatcaccaggtttgacctggagctgcctgatggcaaccggcaggtgcggggcgtgacccagctgggcggggcctgcagccccacctggagctgcctgatcacagaggacaccggctttgacctgggcgtgaccatcgcccacgagatcggccaccgcatctgtgcccggcccagccctgccacccagacccgctggaccaaggctgctgctgctgccagcagcttcctgtcctggatgggccagaatgtggcctggaggtctggggccccccgggtggccgccgccccctggtggagctag

SEQ ID NO: 2929 - DNA, 4284 bp, Artificial Sequence; identical to SEQ ID NO: 2917
  Description of Artificial Sequence: Synthetic coding sequence

SEQ ID NO: 2930 - DNA, 1095 bp, Artificial Sequence
  Description of Artificial Sequence: Synthetic coding sequence
atggacatgtgccaggccctgagctgccacacagaccccctggaccagagcagctgcagccggctgctggtgcccctgctggatggaacagaatgtggggtggagaagtggtgcagcaagggccgctgccgcagcctggtggagctgacccccatcgctgctgtgcacggccgctggagctcctggggccccaggagcccctgcagccgcagctgtggcggcggcgtggtgacccggcggcggcagtgcaacaaccccaggcctgccttcggcggccgggcctgtgtgggcgctgacctgcaggccgagatgtgcaacacccaggcctgtgagaagacccagctggagttcatgagccagcagtgtgccaggacagatggccagcccctgcggagcagccctgggggcgccagcttctaccactggggcgctgctgtgccccacagccagggagatgccctgtgccgccacatgtgccgggccatcggggagagcttcatcatgaagagaggagacagcttcctggatggcacccgctgcatgcccagcggccccagagaagatggcaccctgagcctgtgtgtgtctggcagctgcaggaccttcggctgtgatggccgcatggacagccagcaggtgtgggaccgctgccaggtgtgtggcggggacaacagcacctgcagccccaggaagggcagcttcaccgctggccgggcccgggagtatgtgaccttcctgactgtgacccccaacctgacctctgtgtacatcgccaaccaccggcccctcttcacccacctggccgtgagaattggaggccgctacgtggtggccggcaagatgagcatcagccccaacaccacctaccccagcctgctggaggatggccgggtggagtacagagtggccctgacagaggaccggctgccccggctggaggagatccgcatctggggccccctgcaggaggatgctgacatccaggtgggcggcgtgcgggcccagctgatgcacatctcctggtggagcaggcctggcctgggggagcgggacctgtgtgcccggggccgctggccaggcggcagcagtgactag

SEQ ID NO: 2931 - DNA, 1095 bp, Artificial Sequence
  Description of Artificial Sequence: Synthetic coding sequence
atgccctaccagtacccagccctgaccccagagcagaagaaggagctgagtgacatcgcccacagaattgtggcccctgggaagggcatcctggccgcagatgagagcacaggcagcatcgccaagaggctgcagagcattggaacagagaacacagaggagaacagacgcttctaccggcagctgctgctgacagcagatgacagagtgaacccctgcatcggcggcgtcatcctcttccacgagaccctgtaccagaaggcagatgatggccggcccttcccccaggtgatcaagagcaaaggaggagtggtgggcatcaaggtggacaagggcgtggtgcccctggccggcaccaacggggagaccaccacccagggcctggatggcctgtctgagcgctgtgcccagtacaagaaggatggagctgactttgccaagtggaggtgtgtgctgaagatcggggagcacacccccagcgccctggccatcatggagaatgccaacgtgctggcccgctatgccagcatctgccagcagaatggaattgtgcccatcgtggagcctgagatcctgcctgatggagaccatgacctgaagcgctgccagtatgtgacagagaaggtgctggccgctgtgtacaaggccctgagtgaccaccacatctacctggagggcaccctgctgaagcccaacatggtgaccccaggccacgcctgcacccagaagttcagccatgaggagatcgccatggccaccgtgacagccctgcggaggacagtgcccccagctgtgacaggcatcaccttcctgagcggcggccagagcgaggaggaggccagcatcaacctgaatgccatcaacaagtgccccctgctgaagccctgggccctgaccttctcctatggccgggccctgcaggccagcgccctgaaggcctggggcggcaagaaggagaacctgaaggccgcccaggaggagtatgtgaagagggccctggccaacagcctggcctgccagggcaagtacacccccagcggccaggccggggccgccgccagcgagagcctgtttgtgagcaaccacgcctactag

SEQ ID NO: 2932 - DNA, 1095 bp, Artificial Sequence; identical to SEQ ID NO: 2931
  Description of Artificial Sequence: Synthetic coding sequence

SEQ ID NO: 2933 - DNA, 1257 bp, Artificial Sequence
  Description of Artificial Sequence: Synthetic coding sequence
atggcccggaggaagccagagggcagcagcttcaacatgacccacctgtccatggccatggccttctccttcccccctgtggccagcggccagctgcacccccagctgggcaacacccagcaccagacagagctgggcaaggagctggccaccaccagcaccatgccctaccagtacccagccctgaccccagagcagaagaaggagctgagtgacatcgcccacagaattgtggcccctgggaagggcatcctggccgcagatgagagcacaggcagcatcgccaagaggctgcagagcattggaacagagaacacagaggagaacagacgcttctaccggcagctgctgctgacagcagatgacagagtgaacccctgcatcggcggcgtcatcctcttccacgagaccctgtaccagaaggcagatgatggccggcccttcccccaggtgatcaagagcaaaggaggagtggtgggcatcaaggtggacaagggcgtggtgcccctggccggcaccaacggggagaccaccacccagggcctggatggcctgtctgagcgctgtgcccagtacaagaaggatggagctgactttgccaagtggaggtgtgtgctgaagatcggggagcacacccccagcgccctggccatcatggagaatgccaacgtgctggcccgctatgccagcatctgccagcagaatggaattgtgcccatcgtggagcctgagatcctgcctgatggagaccatgacctgaagcgctgccagtatgtgacagagaaggtgctggccgctgtgtacaaggccctgagtgaccaccacatctacctggagggcaccctgctgaagcccaacatggtgaccccaggccacgcctgcacccagaagttcagccatgaggagatcgccatggccaccgtgacagccctgcggaggacagtgcccccagctgtgacaggcatcaccttcctgagcggcggccagagcgaggaggaggccagcatcaacctgaatgccatcaacaagtgccccctgctgaagccctgggccctgaccttctcctatggccgggccctgcaggccagcgccctgaaggcctggggcggcaagaaggagaacctgaaggccgcccaggaggagtatgtgaagagggccctggccaacagcctggcctgccagggcaagtacacccccagcggccaggccggggccgccgccagcgagagcctgtttgtgagcaaccacgcctactag

SEQ ID NO: 2934 - DNA, 1095 bp, Artificial Sequence; identical to SEQ ID NO: 2931
  Description of Artificial Sequence: Synthetic coding sequence

SEQ ID NO: 2935 - DNA, 1095 bp, Artificial Sequence; identical to SEQ ID NO: 2931
  Description of Artificial Sequence: Synthetic coding sequence

SEQ ID NO: 2936 - DNA, 1257 bp, Artificial Sequence; identical to SEQ ID NO: 2933
  Description of Artificial Sequence: Synthetic coding sequence

SEQ ID NO: 2937 - DNA, 1095 bp, Artificial Sequence; identical to SEQ ID NO: 2931
  Description of Artificial Sequence: Synthetic coding sequence

SEQ ID NO: 2938 - DNA, 1344 bp, Artificial Sequence
  Description of Artificial Sequence: Synthetic coding sequence
atgtctgccagcaagatccccctcttcaagatgaaggacctgatcctgatcctgtgcctgctggagatgagctttgctgtgcccttcttcccccagcagagcggcaccccaggcatggccagcctgagcctggagaccatgaggcagctgggcagcctgcagaggctgaacaccctgagccagtacagccgctatggctttgggaagagcttcaacagcctgtggatgcacggcctgctgcccccccacagcagcctgccctggatgaggccccgggagcacgagacccagcagtatgagtacagcctgcctgtgcaccccccacccctgcccagccagcccagcctgaagccccagcagcccggcctgaagcccttcctgcagagcgctgctgccaccaccaaccaggccacagccctgaaggaggccctgcagccccccatccacctgggccacctgcccctgcaggagggggagctgcccctggtgcagcagcaggtggcccccagcgacaagccacccaagccagagctgcccggggtggactttgctgacccccagggccccagcctgcccggcatggacttcccagacccccagggccccagcctgcccggcctggactttgctgacccccagggcagcaccatcttccagatcgcccggctcatcagccacggccccatgccccagaacaagcagagccccctgtacccaggcatgctgtatgtgccctttggagccaaccagctgaatgccccagcccggctgggcatcatgagcagcgaggaggtggccggcggccgggaggaccccatggcctatggagccatgtttcctggctttggaggcatgaggcctggctttgagggcatgccccacaacccagccatgggcggggacttcaccctggagtttgacagccctgtggccgccaccaagggcccagaaaatgaggagggcggggcccagggcagccccatgcctgaggccaacccagacaacctggagaacccagccttcctgacagagctggagcccgcccctcatgctggcctgctggccctgcccaaggatgacatccctggcctgcccaggagccccagcggcaagatgaagggcctgcccagcgtgaccccagctgctgctgaccccctgatgaccccagagctggctgatgtgtaccgcacctatgatgctgacatgaccacctctgtggacttccaggaggaggccaccatggacaccaccatggcccccaacagcctgcagacctccatgcctggcaacaaggcccaggagcctgagatgatgcatgatgcctggcacttccaggagccctag

SEQ ID NO: 2939 - DNA, 1299 bp, Artificial Sequence
  Description of Artificial Sequence: Synthetic coding sequence
atgtctgccagcaagatccccctcttcaagatgaaggacctgatcctgatcctgtgcctgctggagatgagctttgctgtgcccttcttcccccagcagagcggcaccccaggcatggccagcctgagcctggagaccatgaggcagctgggcagcctgcagaggctgaacaccctgagccagtacagccgctatggctttgggaagagcttcaacagcctgtggatgcacggcctgctgcccccccacagcagcctgccctggatgaggccccgggagcacgagacccagcagcccagcctgaagccccagcagcccggcctgaagcccttcctgcagagcgctgctgccaccaccaaccaggccacagccctgaaggaggccctgcagccccccatccacctgggccacctgcccctgcaggagggggagctgcccctggtgcagcagcaggtggcccccagcgacaagccacccaagccagagctgcccggggtggactttgctgacccccagggccccagcctgcccggcatggacttcccagacccccagggccccagcctgcccggcctggactttgctgacccccagggcagcaccatcttccagatcgcccggctcatcagccacggccccatgccccagaacaagcagagccccctgtacccaggcatgctgtatgtgccctttggagccaaccagctgaatgccccagcccggctgggcatcatgagcagcgaggaggtggccggcggccgggaggaccccatggcctacggggccatgtttcctggctttggaggcatgaggcctggctttgagggcatgccccacaacccagccatgggcggggacttcaccctggagtttgacagccctgtggccgccaccaagggcccagaaaatgaggagggcggggcccagggcagccccatgcctgaggccaacccagacaacctggagaacccagccttcctgacagagctggagcccgcccctcatgctggcctgctggccctgcccaaggatgacatccctggcctgcccaggagccccagcggcaagatgaagggcctgcccagcgtgaccccagctgctgctgaccccctgatgaccccagagctggctgatgtgtaccgcacctatgatgctgacatgaccacctctgtggacttccaggaggaggccaccatggacaccaccatggcccccaacagcctgcagacctccatgcctggcaacaaggcccaggagcctgagatgatgcatgatgcctggcacttccaggagccctag

SEQ ID NO: 2940 - DNA, 1341 bp, Artificial Sequence
  Description of Artificial Sequence: Synthetic coding sequence
atgtctgccagcaagatccccctcttcaagatgaaggacctgatcctgatcctgtgcctgctggagatgagctttgctgtgcccttcttcccccagcagagcggcaccccaggcatggccagcctgagcctggagaccatgaggcagctgggcagcctgcagaggctgaacaccctgagccagtacagccgctatggctttgggaagagcttcaacagcctgtggatgcacggcctgctgcccccccacagcagcctgccctggatgaggccccgggagcacgagacccagcagtatgagtacagcctgcctgtgcaccccccacccctgcccagccagcccagcctgaagccccagcagcccggcctgaagcccttcctgcagagcgctgctgccaccaccaaccaggccacagccctgaaggaggccctgcagccccccatccacctgggccacctgcccctgcaggagggggagctgcccctggtgcagcagcaggtggcccccagcgacaagccacccaagccagagctgcgggtggactttgctgacccccagggccccagcctgcccggcatggacttcccagacccccagggccccagcctgcccggcctggactttgctgacccccagggcagcaccatcttccagatcgcccggctcatcagccacggccccatgccccagaacaagcagagccccctgtacccaggcatgctgtatgtgccctttggagccaaccagctgaatgccccagcccggctgggcatcatgagcagcgaggaggtggccggcggccgggaggaccccatggcctacggggccatgtttcctggctttggaggcatgaggcctggctttgagggcatgccccacaacccagccatgggcggggacttcaccctggagtttgacagccctgtggccgccaccaagggcccagaaaatgaggagggcggggcccagggcagccccatgcctgaggccaacccagacaacctggagaacccagccttcctgacagagctggagcccgcccctcatgctggcctgctggccctgcccaaggatgacatccctggcctgcccaggagccccagcggcaagatgaagggcctgcccagcgtgaccccagctgctgctgaccccctgatgaccccagagctggctgatgtgtaccgcacctatgatgctgacatgaccacctctgtggacttccaggaggaggccaccatggacaccaccatggcccccaacagcctgcagacctccatgcctggcaacaaggcccaggagcctgagatgatgcatgatgcctggcacttccaggagccctag

SEQ ID NO: 2941 - DNA, 528 bp, Artificial Sequence
  Description of Artificial Sequence: Synthetic coding sequence
atgggcacctggatcctgtttgcctgcctgctgggcgccgcctttgccatgcctgtgctgacccccctgaagtggtaccagagcatccggcccccctaccccagctatggctatgagcccatgggcggctggctgcaccaccagatcatccctgtgctgagccagcagcacccccccacccacaccctgcagccccaccaccacatccctgtggtgcctgcccagcagcctgtgatcccccagcagcccatgatgcctgtgcccggccagcacagcatgacccccatccagcaccaccagcccaacctgcccccaccagcccagcagccctaccagccccagcctgtgcagccccagccccaccagcccatgcagccccagccccctgtgcaccccatgcagcccctgcccccccagccccccctgccccccatgttccccatgcagcccctgccccccatgctgcctgacctgaccctggaggcctggcccagcacagacaagaccaagcgggaggaggtggactag

SEQ ID NO: 2942 - DNA, 618 bp, Artificial Sequence
  Description of Artificial Sequence: Synthetic coding sequence
atgggcacctggatcctgtttgcctgcctgctgggcgccgcctttgccatgcccctgcccccccaccctggccaccctggctacatcaacttctcctatgagaacagccacagccaggccatcaacgtggacagaacagccctggtgctgacccccctgaagtggtaccagagcatccggcccccctaccccagctatggctatgagcccatgggcggctggctgcaccaccagatcatccctgtgctgagccagcagcacccccccacccacaccctgcagccccaccaccacatccctgtggtgcctgcccagcagcctgtgatcccccagcagcccatgatgcctgtgcccggccagcacagcatgacccccatccagcaccaccagcccaacctgcccccaccagcccagcagccctaccagccccagcctgtgcagccccagccccaccagcccatgcagccccagccccctgtgcaccccatgcagcccctgcccccccagccccccctgccccccatgttccccatgcagcccctgccccccatgctgcctgacctgaccctggaggcctggcccagcacagacaagaccaagcgggaggaggtggactag

SEQ ID NO: 2943 - DNA, 576 bp, Artificial Sequence
  Description of Artificial Sequence: Synthetic coding sequence
atgggcacctggatcctgtttgcctgcctgctgggcgccgcctttgccatgcccctgcccccccaccctggccaccctggctacatcaacttctcctatgaggtgctgacccccctgaagtggtaccagagcatccggcccccctaccccagctatggctatgagcccatgggcggctggctgcaccaccagatcatccctgtgctgagccagcagcacccccccacccacaccctgcagccccaccaccacatccctgtggtgcctgcccagcagcctgtgatcccccagcagcccatgatgcctgtgcccggccagcacagcatgacccccatccagcaccaccagcccaacctgcccccaccagcccagcagccctaccagccccagcctgtgcagccccagccccaccagcccatgcagccccagccccctgtgcaccccatgcagcccctgcccccccagccccccctgccccccatgttccccatgcagcccctgccccccatgctgcctgacctgaccctggaggcctggcccagcacagacaagaccaagcgggaggaggtggactag

SEQ ID NO: 2944 - DNA, 4023 bp, Artificial Sequence
  Description of Artificial Sequence: Synthetic coding sequence
atgttccgggtgggcttcctgatcatcagcagcagcagcagcctgagccccctgctgctggtgtctgtggtgcgggtgaacaccaccaactgccacaagtgcctgctgagcggcacctacatctttgctgtgctgctggtgtgtgtggtgttccacagcggggcccaggagaagaactacaccatccgggaggagatcccagaaaatgtgctgattggcaacctgctgaaggacctgaacctgagcctcatccccaacaagagcctgaccaccaccatgcagttcaagctggtgtacaagacaggagatgtgcccctcatcagaattgaagaagatactggagagatcttcaccactggagccagaattgaccgggagaagctgtgtgccggcatccccagagatgagcactgcttctatgaggtggaggtggccatcctgcctgatgagatcttccggctggtgaagatccgcttcctgattgaggacatcaatgacaatgcccccctcttccctgccaccgtcatcaacatcagcatccctgagaacagcgccatcaacagcaagtacaccctgcctgctgctgtggaccctgatgtgggcatcaatggagtgcagaactatgagctgatcaagagccagaacatcttcggcctggatgtgattgagaccccagagggggacaagatgccccagctgattgtgcagaaggagctggaccgggaggagaaggacacctacgtgatgaaggtgaaggtggaggatggcggcttcccccagaggagcagcacagccatcctgcaggtgtctgtgacagacaccaatgacaaccaccctgtgttcaaggagacagaaattgaggtgtccatcccagaaaatgcccctgtgggcacctctgtgacccagctgcacgccacagatgctgacatcggggagaatgccaagatccacttctccttcagcaacctggtgagcaacatcgcccggcggctcttccacctgaatgccaccaccggcctcatcaccatcaaggagcccctggaccgggaggagacccccaaccacaagctgctggtgctggccagtgatggcggcctgatgcctgcccgggccatggtgctggtgaatgtgacagatgtgaatgacaacgtgcccagcattgacatccgctacatcgtgaaccctgtgaatgacacagtggtgctgtctgagaacatccccctgaacaccaagatcgccctgatcaccgtgacagacaaggatgctgaccacaacggccgggtgacctgcttcacagaccacgagatccccttccggctgcggcctgtgttcagcaaccagttcctgctggagaatgctgcctacctggactatgagagcaccaaggagtatgccatcaagctgctggccgcagatgctgggaagccacccctgaaccagagcgccatgctgttcatcaaggtgaaggatgaaaatgacaatgcccctgtgttcacccagagctttgtgacagtgtccatccctgagaacaacagccctggcatccagctgatgaaggtgtctgccacagatgctgacagcggccccaatgctgagatcaactacctgctgggcccagatgcccctcctgagttcagcctggacagaagaacaggcatgctgactgtggtgaagaagctggaccgggagaaggaggacaagtacctgttcaccatcctggccaaggacaatggagtgccccccctgaccagcaatgtgacagtgtttgtgtccatcatcgaccagaatgacaacagccctgtgttcacccacaatgagtacaagttctacgtgcctgagaacctgcccaggcatggcaccgtgggcctcatcaccgtgacagatcctgactatggagacaacagcgctgtgaccctgagcatcctggatgaaaatgatgacttcaccatcgacagccagacaggagtcatccggcccaacatcagctttgaccgggagaagcaggagagctacaccttctacgtgaaggccgaggatggcggccgggtgagccgcagcagcagcgccaaggtgaccatcaacgtggtggatgtgaatgacaacaagcctgtgttcatcgtgcccccctacaactacagctatgagctggtgctgcccagcaccaaccctggcaccgtggtgttccaggtgattgctgtggacaatgacaccggcatgaatgctgaggtgcgctacagcatcgtgggcggcaacacccgggacctgtttgccatcgaccaggagaccggcaacatcaccctgatggagaagtgtgatgtgacagacctgggcctgcaccgggtgctggtgaaggccaatgacctgggccagcctgacagcctcttctctgtggtgattgtgaacctgtttgtgaatgaatctgtgaccaatgccaccctcatcaatgagctggtgaggaagagcattgaggcccctgtgacccccaacacagaaattgctgatgtgagcagccccaccagtgactatgtgaagatcctggtggccgctgtggccggcaccatcaccgtggtggtggtgatcttcatcacagctgtggtgcgctgccggcaggccccccacctgaaggccgcccagaagaacatgcagaacagcgagtgggccacccccaaccctgagaaccggcagatgatcatgatgaagaagaagaagaagaagaagaagcacagccccaagaacctgctgctgaatgtggtgaccatcgaggagaccaaggcagatgatgtggacagtgatggcaacagagtgaccctggacctgcccatcgacctggaggagcagaccatgggcaagtacaactgggtgaccacccccaccaccttcaagccagacagcccagacctggcccggcactacaagagcgccagcccccagcctgccttccagatccagcctgagacccccctgaacctgaagcaccacatcatccaggagctgcccctggacaacacctttgtggcctgtgacagcatcagcaactgcagcagcagcagcagtgacccctacagcgtgtctgactgtggctaccctgtgaccacctttgaggtgcctgtgtctgtgcacacccggcccagccagaggagagtgaccttccacctgcctgagggcagccaggagagcagcagtgatggcggcctgggggaccatgatgctggcagcctgaccagcaccagccacggcctgcccctgggctacccccaggaggagtactttgaccgggccacccccagcaacagaacagaaggagatggcaacagcgaccctgagagcaacttcatcagcggcatgagggagaagatcaccgtgcagcccaccgtggaggaggccagtgacaactgcacccaggagtgcctgatctacggccacagtgatgcctgctggatgcctgccagcctggaccacagcagcagcagccaggcccaggccagcgccctgtgccacagcccccccctgagccaggccagcacccagcaccacagcccccctgtgacccagaccatcgtgctgtgccacagcccccctgtgacccagaccatcgccctgtgccacagccccccacccatccaggtgtctgccctgcaccacagcccccccctggtgcagggcacagccctgcaccacagcccccccagcgcccaggccagcgccctgtgctacagcccccccctggcccaggccgccgccatcagccacagcagcagcctgccccaggtgattgccctgcacaggagccaggcccagagctctgtgtccctgcagcagggctgggtgcagggcgccaacggcctgtgcagcgtggaccagggcgtgcagggcagcgccaccagccagttctacaccatgtctgagcggctgcaccccagtgatgacagcatcaaggtgatccccctgaccacctttgccccccggcagcaggcccggcccagcagaggagacagccccatcatggagacccaccccctgtag

SEQ ID NO: 2945 - DNA, 621 bp, Artificial Sequence
  Description of Artificial Sequence: Synthetic coding sequence
atgggcacctggatcctgtttgcctgcctggtgggcgccgcctttgccatgcccctgcccccccaccctggccaccctggctacatcaacttctcctatgagaacagccacagccaggccatcaacgtggaccgcatcgccctggtgctgacccccctgaagtggtaccagagcatgatccggcccccctacagcagctatggctatgagcccatgggcggctggctgcaccaccagatcatccctgtggtgtcccagcagcaccccctgacccacaccctgcagagccaccaccacatccctgtggtgcctgcccagcagccccgggtgcggcagcaggccctgatgcctgtgcccggccagcagagcatgacccccacccagcaccaccagcccaacctgcccctgcctgcccagcagcccttccagccccagcctgtgcagccccagccccaccagcccatgcagccccagccccctgtgcagcccatgcagcccctgctgccccagccccccctgccccccatgttccccctgcggcccctgccccccatcctgcctgacctgcacctggaggcctggccagccacagacaagaccaagcaggaggaggtggactag

SEQ ID NO: 2946 - DNA, 618 bp, Artificial Sequence
  Description of Artificial Sequence: Synthetic coding sequence
atgggcacctggatcctgtttgcctgcctggtgggcgccgcctttgccatgcccctgcccccccaccctggccaccctggctacatcaacttctcctatgagaacagccacagccaggccatcaacgtggaccgcatcgccctggtgctgacccccctgaagtggtaccagagcatgatccggcccccctacagcagctatggctatgagcccatgggcggctggctgcaccaccagatcatccctgtggtgtcccagcagcaccccctgacccacaccctgcagagccaccaccacatccctgtggtgcctgcccagcagccccgggtgcggcagcaggccctgatgcctgtgcccggccagcagagcatgacccccacccagcaccaccagcccaacctgcccctgcctgcccagcagcccttccagccccagcctgtgcagccccagccccaccagcccatgcagccccagccccctgtgcagcccatgcagcccctgctgccccagccccccctgccccccatgttccccctgcggcccctgccccccatcctgcctgacctgcacctggaggcctggccagccacagacaagaccaagcaggaggaggtgtag

SEQ ID NO: 2947 - DNA, 4599 bp, Artificial Sequence
  Description of Artificial Sequence: Synthetic coding sequence
atgggccacagcaagcagatccgcatcctgctgctgaatgagatggagaagctggagaagaccctcttccggctggagcagggctatgagctgcagttccggctgggccccaccctgcagggcaaggctgtgacagtgtacaccaactaccccttccctggagagaccttcaaccgggagaagttccgcagcctggactgggagaaccccacagagcgggaggatgacagcgacaagtactgcaagctgaacctgcagcagagcggcagcttccagtactacttcctgcagggcaatgagaagagcggcggcggctacatcgtggtggaccccatcctgcgggtgggcgctgacaaccacgtgctgcccctggactgtgtgaccctgcagaccttcctggccaagtgcctgggcccctttgatgagtgggagagccggctgcgggtggccaaggagagcggctacaacatgatccacttcacccccctgcagaccctgggcctgagccgcagctgctacagcctggccaaccagctggagctgaacccagacttcagccggcccaacaggaagtacacctggaatgatgtgggccagctggtggagaagctgaagaaggagtggaatgtcatctgcatcacagatgtggtgtacaaccacacagctgccaacagcaagtggatccaggagcacccagaatgtgcctacaacctggtgaacagcccccacctgaagccagcctgggtgctggaccgggccctgtggaggttcagctgtgatgtggccgagggcaagtacaaggagaagggcatcccagccctgattgaaaatgaccaccacatgaacagcatcaggaagatcatctgggaggacatcttccccaagctgaagctgtgggagttcttccaggtggatgtgaacaaggctgtggagcagttccggcggctgctgacccaggagaacagaagagtgaccaagagtgaccccaaccagcacctgaccatcatccaggaccctgagtaccgccgcttcggctgcaccgtggacatgaacatcgccctgaccaccttcatcccccatgacaagggccctgctgccatcgaggagtgctgcaactggttccacaagaggatggaggagctgaacagcgagaagcacaggctcatcaactaccaccaggagcaggccgtgaactgcctgctgggcaatgtgttctatgaaaggctggccggccacggccccaagctgggccctgtgaccaggaagcaccccctggtgacccgctacttcaccttcccctttgaggagattgacttctccatggaggagagcatgatccacctgcccaacaaggcctgcttcctgatggcccacaacggctgggtgatgggagatgaccccctgaggaactttgctgagcccggcagcgaggtgtacctgcggcgggagctgatctgctggggagacagcgtgaagctgcgctatggcaacaagccagaggactgcccctacctgtgggcccacatgaagaagtacacagagatcacagccacctacttccagggcgtgcggctggacaactgccacagcacccccctgcacgtggccgagtacatgctggatgctgccaggaacctgcagcccaacctgtatgtggtggccgagctgttcaccggcagcgaggacctggacaacgtgtttgtgacccggctgggcatcagcagcctcatccgggaggccatgtctgcctacaacagccatgaggagggccgcctggtgtaccgctatggaggagagcctgtgggcagctttgtgcagccctgcctgcggcccctgatgcctgccatcgcccacgccctcttcatggacatcacccatgacaatgaatgtcccatcgtgcacaggtctgcctatgatgccctgcccagcaccaccatcgtgtccatggcctgctgtgccagcggcagcacccggggctatgatgagctggtgccccaccagatctctgtggtgtctgaggagcgcttctacaccaagtggaaccctgaggccctgcccagcaacacaggagaggtgaacttccagagcggcatcatcgccgcccgctgtgccatcagcaagctgcaccaggagctgggcgccaagggcttcatccaggtgtatgtggaccaggtggatgaagatattgtggccgtgaccaggcacagccccagcatccaccagagcgtggtggccgtgtccaggacagccttcaggaaccccaagaccagcttctacagcaaggaggtgccccagatgtgcatccctgggaagattgaggaggtggtgctggaggcccggaccatcgagaggaacaccaagccctacaggaaggatgaaaattccatcaatggcaccccagacatcaccgtggagatccgggagcacatccagctgaatgaaagcaagatcgtgaagcaggccggcgtggccaccaagggccccaatgagtacatccaggagattgaatttgagaacctgagccctggcagcgtcatcatcttccgggtgtccctggacccccacgcccaggtggccgtgggcatcctgaggaaccacctgacccagttcagcccccacttcaagagcggcagcctggccgtggacaatgctgaccccatcctgaagatcccctttgccagcctggccagccggctgaccctggccgagctgaaccagatcctgtaccgctgtgagagcgaggagaaggaggatggcggcggctgctatgacatccccaactggagcgccctgaagtatgccggcctgcagggcctgatgtctgtgctggccgagatccggcccaagaatgacctgggccaccccttctgcaacaacctgcggagcggggactggatgattgattatgtgagcaacagactcatcagccgcagcggcaccatcgccgaggtgggcaagtggctgcaggccatgttcttctacctgaagcagatcccccgctacctgatcccctgctactttgatgccatcctgattggagcctacaccaccctgctggacacagcctggaagcagatgagcagctttgtgcagaatggcagcacctttgtgaagcacctgagcctgggctctgtgcagctgtgtggggtgggcaagttccccagcctgcccatcctgagccctgccctgatggatgtgccctaccgcctgaatgagatcaccaaggagaaggagcagtgctgcgtgtccctggccgccggcctgccccacttcagcagcggcatcttccgctgctggggccgggacaccttcatcgccctgcggggcatcctgctgatcaccggccgctacgtggaggccaggaacatcatcctggcctttgctggcaccctgcggcacggcctcatccccaacctgctgggggagggcatctatgcccgctacaactgcagagatgctgtgtggtggtggctgcagtgcatccaggactactgcaagatggtgcccaacggcctggacatcctgaagtgccctgtgtccaggatgtaccccacagatgacagcgcccccctgcctgctggcaccctggaccagcccctgtttgaagtcatccaggaggccatgcagaagcacatgcagggcatccagttccgggagagaaatgccggcccccagattgacaggaacatgaaggatgagggcttcaacatcacagctggggtggatgaggagactggatttgtgtatggaggcaaccgcttcaactgtggcacctggatggacaagatgggagagagtgaccgggccaggaacagaggcatcccagccaccccaagagatggcagcgctgtggagatcgtgggcctgagcaagtctgctgtgcgctggctgctggagctgagcaagaagaacatcttcccctaccacgaggtgacagtgaagagacatggcaaggccatcaaggtgtcctatgatgagtggaacaggaagatccaggacaactttgagaagctgttccacgtgtctgaggaccccagcgacctgaatgagaagcaccccaacctggtgcacaagaggggcatctacaaggacagctatggagccagcagcccctggtgtgactaccagctgcggcccaacttcaccatcgccatggtggtggcccctgagctgttcaccacagagaaggcctggaaggccctggagattgctgagaagaagctgctgggccccctgggcatgaagaccctggaccctgatgacatggtgtactgcggcatctatgacaatgccctggacaatgacaactacaacctggccaagggcttcaactaccaccagggccctgagtggctgtggcccatcggctacttcctgcgggccaagctgtacttcagccggctgatgggccctgagaccacagccaagaccatcgtgctggtgaagaatgtgctgagccgccactacgtgcacctggagaggagcccctggaagggcctgcctgagctgaccaatgaaaatgcccagtactgccccttcagctgtgagacccaggcctggagcatcgccaccatcctggagaccctgtatgacctgtag

SEQ ID NO: 2948 - DNA, 4551 bp, Artificial Sequence
  Description of Artificial Sequence: Synthetic coding sequence
atggcccccatcctgagcatcaacctcttcatcggctatgagctgcagttccggctgggccccaccctgcagggcaaggctgtgacagtgtacaccaactaccccttccctggagagaccttcaaccgggagaagttccgcagcctggactgggagaaccccacagagcgggaggatgacagcgacaagtactgcaagctgaacctgcagcagagcggcagcttccagtactacttcctgcagggcaatgagaagagcggcggcggctacatcgtggtggaccccatcctgcgggtgggcgctgacaaccacgtgctgcccctggactgtgtgaccctgcagaccttcctggccaagtgcctgggcccctttgatgagtgggagagccggctgcgggtggccaaggagagcggctacaacatgatccacttcacccccctgcagaccctgggcctgagccgcagctgctacagcctggccaaccagctggagctgaacccagacttcagccggcccaacaggaagtacacctggaatgatgtgggccagctggtggagaagctgaagaaggagtggaatgtcatctgcatcacagatgtggtgtacaaccacacagctgccaacagcaagtggatccaggagcacccagaatgtgcctacaacctggtgaacagcccccacctgaagccagcctgggtgctggaccgggccctgtggaggttcagctgtgatgtggccgagggcaagtacaaggagaagggcatcccagccctgattgaaaatgaccaccacatgaacagcatcaggaagatcatctgggaggacatcttccccaagctgaagctgtgggagttcttccaggtggatgtgaacaaggctgtggagcagttccggcggctgctgacccaggagaacagaagagtgaccaagagtgaccccaaccagcacctgaccatcatccaggaccctgagtaccgccgcttcggctgcaccgtggacatgaacatcgccctgaccaccttcatcccccatgacaagggccctgctgccatcgaggagtgctgcaactggttccacaagaggatggaggagctgaacagcgagaagcacaggctcatcaactaccaccaggagcaggccgtgaactgcctgctgggcaatgtgttctatgaaaggctggccggccacggccccaagctgggccctgtgaccaggaagcaccccctggtgacccgctacttcaccttcccctttgaggagattgacttctccatggaggagagcatgatccacctgcccaacaaggcctgcttcctgatggcccacaacggctgggtgatgggagatgaccccctgaggaactttgctgagcccggcagcgaggtgtacctgcggcgggagctgatctgctggggagacagcgtgaagctgcgctatggcaacaagccagaggactgcccctacctgtgggcccacatgaagaagtacacagagatcacagccacctacttccagggcgtgcggctggacaactgccacagcacccccctgcacgtggccgagtacatgctggatgctgccaggaacctgcagcccaacctgtatgtggtggccgagctgttcaccggcagcgaggacctggacaacgtgtttgtgacccggctgggcatcagcagcctcatccgggaggccatgtctgcctacaacagccatgaggagggccgcctggtgtaccgctatggaggagagcctgtgggcagctttgtgcagccctgcctgcggcccctgatgcctgccatcgcccacgccctcttcatggacatcacccatgacaatgaatgtcccatcgtgcacaggtctgcctatgatgccctgcccagcaccaccatcgtgtccatggcctgctgtgccagcggcagcacccggggctatgatgagctggtgccccaccagatctctgtggtgtctgaggagcgcttctacaccaagtggaaccctgaggccctgcccagcaacacaggagaggtgaacttccagagcggcatcatcgccgcccgctgtgccatcagcaagctgcaccaggagctgggcgccaagggcttcatccaggtgtatgtggaccaggtggatgaagatattgtggccgtgaccaggcacagccccagcatccaccagagcgtggtggccgtgtccaggacagccttcaggaaccccaagaccagcttctacagcaaggaggtgccccagatgtgcatccctgggaagattgaggaggtggtgctggaggcccggaccatcgagaggaacaccaagccctacaggaaggatgaaaattccatcaatggcaccccagacatcaccgtggagatccgggagcacatccagctgaatgaaagcaagatcgtgaagcaggccggcgtggccaccaagggccccaatgagtacatccaggagattgaatttgagaacctgagccctggcagcgtcatcatcttccgggtgtccctggacccccacgcccaggtggccgtgggcatcctgaggaaccacctgacccagttcagcccccacttcaagagcggcagcctggccgtggacaatgctgaccccatcctgaagatcccctttgccagcctggccagccggctgaccctggccgagctgaaccagatcctgtaccgctgtgagagcgaggagaaggaggatggcggcggctgctatgacatccccaactggagcgccctgaagtatgccggcctgcagggcctgatgtctgtgctggccgagatccggcccaagaatgacctgggccaccccttctgcaacaacctgcggagcggggactggatgattgattatgtgagcaacagactcatcagccgcagcggcaccatcgccgaggtgggcaagtggctgcaggccatgttcttctacctgaagcagatcccccgctacctgatcccctgctactttgatgccatcctgattggagcctacaccaccctgctggacacagcctggaagcagatgagcagctttgtgcagaatggcagcacctttgtgaagcacctgagcctgggctctgtgcagctgtgtggggtgggcaagttccccagcctgcccatcctgagccctgccctgatggatgtgccctaccgcctgaatgagatcaccaaggagaaggagcagtgctgcgtgtccctggccgccggcctgccccacttcagcagcggcatcttccgctgctggggccgggacaccttcatcgccctgcggggcatcctgctgatcaccggccgctacgtggaggccaggaacatcatcctggcctttgctggcaccctgcggcacggcctcatccccaacctgctgggggagggcatctatgcccgctacaactgcagagatgctgtgtggtggtggctgcagtgcatccaggactactgcaagatggtgcccaacggcctggacatcctgaagtgccctgtgtccaggatgtaccccacagatgacagcgcccccctgcctgctggcaccctggaccagcccctgtttgaagtcatccaggaggccatgcagaagcacatgcagggcatccagttccgggagagaaatgccggcccccagattgacaggaacatgaaggatgagggcttcaacatcacagctggggtggatgaggagactggatttgtgtatggaggcaaccgcttcaactgtggcacctggatggacaagatgggagagagtgaccgggccaggaacagaggcatcccagccaccccaagagatggcagcgctgtggagatcgtgggcctgagcaagtctgctgtgcgctggctgctggagctgagcaagaagaacatcttcccctaccacgaggtgacagtgaagagacatggcaaggccatcaaggtgtcctatgatgagtggaacaggaagatccaggacaactttgagaagctgttccacgtgtctgaggaccccagcgacctgaatgagaagcaccccaacctggtgcacaagaggggcatctacaaggacagctatggagccagcagcccctggtgtgactaccagctgcggcccaacttcaccatcgccatggtggtggcccctgagctgttcaccacagagaaggcctggaaggccctggagattgctgagaagaagctgctgggccccctgggcatgaagaccctggaccctgatgacatggtgtactgcggcatctatgacaatgccctggacaatgacaactacaacctggccaagggcttcaactaccaccagggccctgagtggctgtggcccatcggctacttcctgcgggccaagctgtacttcagccggctgatgggccctgagaccacagccaagaccatcgtgctggtgaagaatgtgctgagccgccactacgtgcacctggagaggagcccctggaagggcctgcctgagctgaccaatgaaaatgcccagtactgccccttcagctgtgagacccaggcctggagcatcgccaccatcctggagaccctgtatgacctgtag

SEQ ID NO: 2949 - DNA, 4548 bp, Artificial Sequence
  Description of Artificial Sequence: Synthetic coding sequence
atgagcctgctgacctgtgccttctacctgggctatgagctgcagttccggctgggccccaccctgcagggcaaggctgtgacagtgtacaccaactaccccttccctggagagaccttcaaccgggagaagttccgcagcctggactgggagaaccccacagaaagagaagatgacagcgacaagtactgcaagctgaacctgcagcagagcggcagcttccagtactacttcctgcagggcaatgagaagagcggcggcggctacatcgtggtggaccccatcctgcgggtgggcgctgacaaccacgtgctgcccctggactgtgtgaccctgcagaccttcctggccaagtgcctgggcccctttgatgagtgggagagccggctgcgggtggccaaggagagcggctacaacatgatccacttcacccccctgcagaccctgggcctgagccgcagctgctacagcctggccaaccagctggagctgaacccagacttcagccggcccaacaggaagtacacctggaatgatgtgggccagctggtggagaagctgaagaaggagtggaatgtcatctgcatcacagatgtggtgtacaaccacacagctgccaacagcaagtggatccaggagcacccagaatgtgcctacaacctggtgaacagcccccacctgaagccagcctgggtgctggaccgggccctgtggaggttcagctgtgatgtggccgagggcaagtacaaggagaagggcatcccagccctgattgaaaatgaccaccacatgaacagcatcaggaagatcatctgggaggacatcttccccaagctgaagctgtgggagttcttccaggtggatgtgaacaaggctgtggagcagttccggcggctgctgacccaggagaacagaagagtgaccaagagtgaccccaaccagcacctgaccatcatccaggaccctgagtacagaagatttggctgcaccgtggacatgaacatcgccctgaccaccttcatcccccatgacaagggccctgctgccatcgaggagtgctgcaactggttccacaagaggatggaggagctgaacagcgagaagcacaggctcatcaactaccaccaggagcaggccgtgaactgcctgctgggcaatgtgttctatgagcggctggccggccacggccccaagctgggccctgtgaccaggaagcaccccctggtgacccgctacttcaccttcccctttgaggagattgacttctccatggaggagagcatgatccacctgcccaacaaggcctgcttcctgatggcccacaacggctgggtgatgggagatgaccccctgaggaactttgctgagcccggcagcgaggtgtacctgcggcgggagctgatctgctggggagacagcgtgaagctgcgctatggcaacaagccagaggactgcccctacctgtgggcccacatgaagaagtacacagagatcacagccacctacttccagggcgtgcggctggacaactgccacagcacccccctgcacgtggccgagtacatgctggatgctgccaggaacctgcagcccaacctgtatgtggtggccgagctgttcaccggcagcgaggacctggacaacgtgtttgtgacccggctgggcatcagcagcctcatccgggaggccatgtctgcctacaacagccatgaggagggccgcctggtgtaccgctatggaggagagcctgtgggcagctttgtgcagccctgcctgcggcccctgatgcctgccatcgcccacgccctcttcatggacatcacccatgacaatgaatgtcccatcgtgcacaggtctgcctatgatgccctgcccagcaccaccatcgtgtccatggcctgctgtgccagcggcagcacccggggctatgatgagctggtgccccaccagatctctgtggtgtctgaggagcgcttctacaccaagtggaaccctgaggccctgcccagcaacacaggagaggtgaacttccagagcggcatcatcgccgcccgctgtgccatcagcaagctgcaccaggagctgggcgccaagggcttcatccaggtgtatgtggaccaggtggatgaggacatcgtggccgtgaccaggcacagccccagcatccaccagagcgtggtggccgtgtccaggacagccttcaggaaccccaagaccagcttctacagcaaggaggtgccccagatgtgcatccctgggaagattgaggaggtggtgctggaggcccggaccattgaaagaaacaccaagccctacaggaaggatgagaacagcatcaatggcaccccagacatcaccgtggagatccgggagcacatccagctgaatgaaagcaagatcgtgaagcaggccggcgtggccaccaagggccccaatgagtacatccaggagattgaatttgagaacctgagccctggcagcgtcatcatcttccgggtgtccctggacccccacgcccaggtggccgtgggcatcctgaggaaccacctgacccagttcagcccccacttcaagagcggcagcctggccgtggacaatgctgaccccatcctgaagatcccctttgccagcctggccagccggctgaccctggccgagctgaaccagatcctgtaccgctgtgagagcgaggagaaggaggatggcggcggctgctatgacatccccaactggagcgccctgaagtatgccggcctgcagggcctgatgtctgtgctggccgagatccggcccaagaatgacctgggccaccccttctgcaacaacctgcggagcggggactggatgattgattatgtgagcaacagactcatcagccgcagcggcaccatcgccgaggtgggcaagtggctgcaggccatgttcttctacctgaagcagatcccccgctacctgatcccctgctactttgatgccatcctgattggagcctacaccaccctgctggacacagcctggaagcagatgagcagctttgtgcagaatggcagcacctttgtgaagcacctgagcctgggctctgtgcagctgtgtggggtgggcaagttccccagcctgcccatcctgagccctgccctgatggatgtgccctaccgcctgaatgagatcaccaaggagaaggagcagtgctgcgtgtccctggccgccggcctgccccacttcagcagcggcatcttccgctgctggggccgggacaccttcatcgccctgcggggcatcctgctgatcaccggccgctacgtggaggccaggaacatcatcctggcctttgctggcaccctgcggcacggcctcatccccaacctgctgggggagggcatctatgcccgctacaactgcagagatgctgtgtggtggtggctgcagtgcatccaggactactgcaagatggtgcccaacggcctggacatcctgaagtgccctgtgtccaggatgtaccccacagatgattctgcccccctgcctgctggcaccctggaccagcccctgtttgaggtgatccaggaggccatgcagaagcacatgcagggcatccagttccgggagagaaatgccggcccccagattgacaggaacatgaaggatgagggcttcaacatcacagctggggtggatgaggagaccggctttgtgtatggaggcaaccgcttcaactgtggcacctggatggacaagatgggagagagtgaccgggccaggaacagaggcatcccagccaccccaagagatggcagcgctgtggagatcgtgggcctgagcaagtctgctgtgcgctggctgctggagctgagcaagaagaacatcttcccctaccacgaggtgacagtgaagagacatggcaaggccatcaaggtgtcctatgatgagtggaacaggaagatccaggacaactttgagaagctgttccacgtgtctgaggaccccagcgacctgaatgagaagcaccccaacctggtgcacaagaggggcatctacaaggacagctatggagccagcagcccctggtgtgactaccagctgcggcccaacttcaccatcgccatggtggtggcccctgagctgttcaccacagagaaggcctggaaggccctggagattgctgagaagaagctgctgggccccctgggcatgaagaccctggaccctgatgacatggtgtactgcggcatctatgacaatgccctggacaatgacaactacaacctggccaagggcttcaactaccaccagggccctgagtggctgtggcccatcggctacttcctgcgggccaagctgtacttcagccggctgatgggccctgagaccacagccaagaccatcgtgctggtgaagaatgtgctgagccgccactacgtgcacctggagaggagcccctggaagggcctgcctgagctgaccaatgaaaatgcccagtactgccccttcagctgtgagacccaggcctggagcatcgccaccatcctggagaccctgtatgacctgtag

SEQ ID NO: 2950 - DNA, 4599 bp, Artificial Sequence; identical to SEQ ID NO: 2947
  Description of Artificial Sequence: Synthetic coding sequence

SEQ ID NO: 2951 - DNA, 4551 bp, Artificial Sequence; identical to SEQ ID NO: 2948
  Description of Artificial Sequence: Synthetic coding sequence

SEQ ID NO: 2952 - DNA, 4599 bp, Artificial Sequence; identical to SEQ ID NO: 2947
  Description of Artificial Sequence: Synthetic coding sequence

SEQ ID NO: 2953 - DNA, 4599 bp, Artificial Sequence; identical to SEQ ID NO: 2947
  Description of Artificial Sequence: Synthetic coding sequence

SEQ ID NO: 2954 - DNA, 672 bp, Artificial Sequence
  Description of Artificial Sequence: Synthetic coding sequence
atgaacaagcccctgctgtggatctctgtgctgaccagcctgctggaggcctttgcccacacagacctgagcggcaaggtgtttgtgttcccccgggagagcgtgacagaccacgtgaacctgatcacccccctggagaagcccctgcagaacttcaccctgtgcttccgggcctacagcgacctgagccgggcctacagcctcttctcctacaacacccagggccgggacaatgagctgctggtgtacaaggagcgggtgggggagtacagcctgtacatcggccgccacaaggtgaccagcaaggtgattgagaagtttcctgcccctgtgcacatctgtgtgtcctgggagagcagcagcggcattgctgagttctggatcaatggcacccccctggtgaagaagggcctgcggcagggctactttgtggaggcccagcccaagatcgtgctgggccaggagcaggacagctatggaggcaagtttgacaggagccagagctttgtgggggagattggagacctgtacatgtgggacagcgtgctgcccccagagaacatcctgagcgcctaccagggcacccccctgcctgccaacatcctggactggcaggccctgaactatgagatccggggctacgtgatcatcaagcccctggtgtgggtgtag

SEQ ID NO: 2955 - DNA, 2418 bp, Artificial Sequence
  Description of Artificial Sequence: Synthetic coding sequence
atgagcagcagctcctggctgctgctgagcctggtggccgtgacagctgcccagagcaccatcgaggagcaggccaagaccttcctggacaagttcaaccacgaggctgaagatctcttctaccagagcagcctggcctcctggaactacaacaccaacatcacagaagaaaatgtgcagaacatgaacaatgctggggacaagtggagcgccttcctgaaggagcagagcaccctggcccagatgtaccccctgcaggagatccagaacctgactgtgaagctgcagctgcaggccctgcagcagaatggcagctctgtgctgtctgaggacaagagcaagaggctgaacaccatcctgaacaccatgagcaccatctacagcacaggcaaggtgtgcaacccagacaacccccaggagtgcctgctgctggagcccggcctgaatgagatcatggccaacagcctggactacaatgaaaggctgtgggcctgggagagctggaggtctgaggtgggcaagcagctgcggcccctgtatgaggagtatgtggtgctgaagaatgagatggcccgggccaaccactatgaagattatggagactactggaggggggactatgaggtgaatggagtggatggctatgactacagccggggccagctgattgaagatgtggagcacacctttgaggagatcaagcccctgtatgagcacctgcacgcctacgtgcgggccaagctgatgaatgcctaccccagctacatcagccccatcggctgcctgcctgcccacctgctgggggacatgtggggccgcttctggaccaacctgtacagcctgactgtgcccttcggccagaagcccaacattgatgtgacagatgccatggtggaccaggcctgggatgcccagaggatcttcaaggaggccgagaagttctttgtgtctgtgggcctgcccaacatgacccagggcttctgggagaacagcatgctgacagatcctggaaatgtgcagaaggctgtgtgccaccccacagcctgggacctgggcaaaggagacttccgcatcctgatgtgcaccaaggtgaccatggatgacttcctgacagcccaccacgagatgggccacatccagtatgacatggcctatgctgcccagcccttcctgctgagaaatggagccaatgaaggcttccatgaagctgtgggggagatcatgagcctgtctgctgccacccccaagcacctgaagagcatcggcctgctgagcccagacttccaggaggacaatgaaacagagatcaacttcctgctgaagcaggccctgaccatcgtgggcaccctgcccttcacctacatgctggagaagtggcgctggatggtgttcaagggggagatccccaaggaccagtggatgaagaagtggtgggagatgaagcgggagatcgtgggcgtggtggagcctgtgccccatgatgagacctactgtgaccctgccagcctcttccacgtgtccaatgactacagcttcatccgctactacaccaggaccctgtaccagttccagttccaggaggccctgtgccaggccgccaagcatgagggccccctgcacaagtgtgacatcagcaacagcacagaggccggccagaagctgttcaacatgctgcggctgggcaagtctgagccctggaccctggccctggagaatgtggtgggcgccaagaacatgaatgtgcggcccctgctgaactactttgagcccctcttcacctggctgaaggaccagaacaagaacagctttgtgggctggagcacagactggagcccctatgctgaccagagcatcaaggtgcgcatcagcctgaagagcgccctgggggacaaggcctatgagtggaatgacaatgagatgtacctgttccgcagctctgtggcctatgccatgaggcagtacttcctgaaggtgaagaaccagatgatcctgtttggagaggaggatgtgcgggtggccaacctgaagccccgcatctccttcaacttctttgtgacagcccccaagaatgtgtctgacatcatccccaggacagaggtggagaaggccatccgcatgagccgcagccgcatcaatgatgccttccggctgaatgacaacagcctggagttcctgggcatccagcccaccctgggcccccccaaccagccccctgtgtccatctggctgattgtgtttggagtggtgatgggcgtgattgtggtgggcatcgtcatcctgatcttcaccggcatccgggacaggaagaagaagaacaaggcccggagcggggagaacccctatgccagcattgacatcagcaagggggagaacaaccctggcttccagaacacagatgatgtgcagaccagcttctag

SEQ ID NO: 2956 - DNA, 2418 bp, Artificial Sequence; identical to SEQ ID NO: 2955
  Description of Artificial Sequence: Synthetic coding sequence

SEQ ID NO: 2957 - DNA, 804 bp, Artificial Sequence
  Description of Artificial Sequence: Synthetic coding sequence
atgaaggctgctgtgctgaccctggccgtgctcttcctgaccggcagccaggcccggcacttctggcagcaggatgagcccccccagagcccctgggacagagtgaaggacctggccaccgtgtatgtggatgtgctgaaggacagcggccgggactatgtgtcccagtttgagggcagcgccctgggcaagcagctgaacctgaagctgctggacaactgggacagcgtgaccagcaccttcagcaagctgcgggagcagctgggccctgtgacccaggagttctgggacaacctggagaaggagacagagggcctgcggcaggagatgagcaaggacctggaggaggtgaaggccaaggtgcagccctacctggatgacttccagaagaagtggcaggaggagatggagctgtaccggcagaaggtggagcccctgcgggcagagctgcaggagggcgcccggcagaagctgcacgagctgcaggagaagctgagccccctgggggaggagatgagggaccgggcccgggcccacgtggatgccctgcggacccacctggccccctacagtgatgagctgcggcagtgcctggccgcccggctggaggccctgaaggaaaatggaggagcccggctggccgagtaccacgccaaggccacagagcacctgagcaccctgtctgagaaggccaagccagccctggaggacctgcggcagggcctgctgcctgtgctggagagcttcaaggtgtccttcctgagcgccctggaggagtacaccaagaagctgaacacccagtag

SEQ ID NO: 2958 - DNA, 804 bp, Artificial Sequence
  Description of Artificial Sequence: Synthetic coding sequence
atgaaggctgctgtgctgaccctggccgtgctcttcctgaccggcagccaggcccggcacttctggcagcaggatgagcccccccagagcccctgggacagagtgaaggacctggccaccgtgtatgtggatgtgctgaaggacagcggccgggactatgtgtcccagtttgagggcagcgccctgggcaagcagctgaacctgaagctgctggacaactgggacagcgtgaccagcaccttcagcaagctgcgggagcagctgggccctgtgacccaggagttctgggacaacctggagaaggagacagagggcctgcggcaggagatgagcaaggacctggaggaggtgaaggccaaggtgcagccctacctggatgacttccagaagaagtggcaggaggagatggagctgtaccggcagaaggtggagcccctgcgggcagagctgcaggagggcgcccggcagaagctgcacgagctgcaggagaagctgagccccctgggggaggagatgagggactgtgcccgggcccacgtggatgccctgcggacccacctggccccctacagtgatgagctgcggcagaggctggccgcccggctggaggccctgaaggaaaatggaggagcccggctggccgagtaccacgccaaggccacagagcacctgagcaccctgtctgagaaggccaagccagccctggaggacctgcggcagggcctgctgcctgtgctggagagcttcaaggtgtccttcctgagcgccctggaggagtacaccaagaagctgaacacccagtag

SEQ ID NO: 2959 - DNA, 804 bp, Artificial Sequence
  Description of Artificial Sequence: Synthetic coding sequence
atgaaggctgctgtgctgaccctggccgtgctcttcctgaccggcagccaggcccggcacttctggcagcaggatgagcccccccagagcccctgggacagagtgaaggacctggccaccgtgtatgtggatgtgctgaaggacagcggccgggactatgtgtcccagtttgagggcagcgccctgggcaagcagctgaacctgaagctgctggacaactgggacagcgtgaccagcaccttcagcaagctgcgggagcagctgggccctgtgacccaggagttctgggacaacctggagaaggagacagagggcctgcggcaggagatgagcaaggacctggaggaggtgaaggccaaggtgcagccctacctggatgacttccagaagaagtggcaggaggagatggagctgtaccggcagaaggtggagcccctgcgggcagagctgcaggagggcgcccggcagaagctgcacgagctgcaggagaagctgagccccctgggggaggagatgagggaccgggcccgggcccacgtggatgccctgcggacccacctggccccctacagtgatgagctgcggcagaggctggccgcccggctggaggccctgaaggaaaatggaggagcccggctggccgagtaccacgccaaggccacagagcacctgagcaccctgtctgagaaggccaagccagccctggaggacctgcggcagggcctgctgcctgtgctggagagcttcaaggtgtccttcctgagcgccctggaggagtacaccaagaagctgaacacccagtag

SEQ ID NO: 2960 - DNA, 804 bp, Artificial Sequence; identical to SEQ ID NO: 2959
  Description of Artificial Sequence: Synthetic coding sequence

SEQ ID NO: 2961 - DNA, 804 bp, Artificial Sequence; identical to SEQ ID NO: 2959
  Description of Artificial Sequence: Synthetic coding sequence

SEQ ID NO: 2962 - DNA, 804 bp, Artificial Sequence; identical to SEQ ID NO: 2959
  Description of Artificial Sequence: Synthetic coding sequence

SEQ ID NO: 2963 - DNA, 1653 bp, Artificial Sequence
  Description of Artificial Sequence: Synthetic coding sequence
atgaccggggacaagggcccccagaggctgagcggcagcagctatggcagcatcagcagccccaccagccccaccagccctggcccccagcaggccccaccccgggagacctacctgtctgagaagatccccatcccagacaccaagccaggcaccttcagcctgaggaagctgtgggccttcaccggccctggcttcctgatgagcatcgccttcctggaccccggcaacatcgagagtgacctgcaggccggggctgtggccggcttcaagctgctgtgggtgctgctgtgggccaccgtgctgggcctgctgtgccagaggctggccgcccggctgggcgtggtgacaggcaaggacctgggggaggtgtgccacctgtactaccccaaggtgcccaggacagtgctgtggctgaccatcgagctggccatcgtgggcagtgacatgcaggaggtgattggaacagccatcgccttcaacctgctgtctgctggccgcatccccctgtggggcggcgtgctgatcaccatcgtggacaccttcttcttcctgttcctggacaactacggcctgaggaagctggaggccttcttcggcctgctgatcaccatcatggccctgaccttcggctatgaatatgtggtggcccggcctgagcagggcgccctgctgcggggcctcttcctgcccagctgccccggctgcggccaccctgagctgctgcaggccgtgggcatcgtgggcgccatcatcatgccccacaacatctacctgcacagcgccctggtgaagagccgggagattgaccgggccaggagagctgacatccgggaggccaacatgtacttcctgattgaggccaccatcgccctgtctgtgtccttcatcatcaacctgtttgtgatggctgtgtttggccaggccttctaccagaagaccaaccaggccgccttcaacatctgtgccaacagcagcctgcatgactatgccaagatcttccccatgaacaatgccaccgtggccgtggacatctaccagggcggcgtcatcctgggctgcctgtttggacctgctgccctgtacatctgggccatcggcctgctggccgccggccagagcagcaccatgacaggcacctacgccggccagtttgtgatggagggcttcctgcggctgcgctggagcagatttgcccgggtgctgctgaccaggagctgtgccatcctgcccaccgtgctggtggccgtgttccgggacctgcgggacctgagcggcctgaatgacctgctgaatgtgctgcagagcctgctgctgccctttgctgtgctgcccatcctgaccttcacctccatgcccaccctgatgcaggagtttgccaacggcctgctgaacaaggtggtgaccagcagcatcatggtgctggtgtgtgccatcaacctgtactttgtggtgtcctacctgcccagcctgccccacccagcctacttcggcctggccgccctgctggccgccgcctacctgggcctgagcacctacctggtgtggacctgctgcctggcccacggggccaccttcctggcccacagcagccaccaccacttcctgtatggcctgctggaggaggaccagaagggggagaccagcggctag

SEQ ID NO: 2964 - DNA, 13035 bp, Artificial Sequence
  Description of Artificial Sequence: Synthetic coding sequence
atggacccccccaggcctgccctgctggccctgctggccctgcctgccctgctgctgctgctgctggccggggcccgggcagaggaggagatgctggagaatgtgtccctggtgtgccccaaggatgccacccgcttcaagcacctgaggaagtacacctacaactatgaggccgagagcagcagcggcgtgcctggaacagctgacagccgcagcgccacccgcatcaactgcaaggtggagctggaggtgccccagctgtgcagcttcatcctgaagaccagccagtgcaccctgaaggaggtgtatggcttcaaccctgagggcaaggccctgctgaagaagaccaagaacagcgaggagtttgctgctgccatgagccgctatgagctgaagctggccatccctgagggcaagcaggtgttcctgtacccagagaaggatgagcccacctacatcctgaacatcaagaggggcatcatcagcgccctgctggtgcccccagagacagaggaggccaagcaggtgctcttcctggacacagtgtatggcaactgcagcacccacttcaccgtgaagaccaggaaaggaaatgtggccacagagatcagcacagagcgggacctgggccagtgtgaccgcttcaagcccatcagaacaggcatcagccccctggccctgatcaagggcatgacccggcccctgagcaccctcatcagcagcagccagagctgccagtacaccctggatgccaagaggaagcacgtggccgaggccatctgcaaggagcagcacctgttcctgcccttctcctacaagaacaagtatggcatggtggcccaggtgacccagaccctgaagctggaggacacccccaagatcaacagccgcttctttggagagggcaccaagaagatgggcctggcctttgagagcaccaagagcaccagcccccccaagcaggccgaggccgtgctgaagaccctgcaggagctgaagaagctgaccatcagcgagcagaacatccagagggccaacctcttcaacaagctggtgacagagctgcggggcctgagtgatgaggccgtgaccagcctgctgccccagctgattgaggtgagcagccccatcaccctgcaggccctggtgcagtgtggccagccccagtgcagcacccacatcctgcagtggctgaagagggtgcacgccaaccccctgctgattgatgtggtgacctacctggtggccctgatccctgagcccagcgcccagcagctgcgggagatcttcaacatggcccgggaccagaggagccgggccaccctgtatgccctgagccatgctgtgaacaactaccacaagaccaaccccaccggcacccaggagctgctggacatcgccaactacctgatggagcagatccaggatgactgcacaggagatgaggactacacctacctgatcctgcgggtcatcggcaacatgggccagaccatggagcagctgaccccagagctgaagagcagcatcctgaagtgtgtgcagagcaccaagcccagcctgatgatccagaaggccgccatccaggccctgaggaagatggagcccaaggacaaggaccaggaggtgctgctgcagaccttcctggatgatgccagccctggggacaagaggctggccgcctacctgatgctgatgaggagccccagccaggccgacatcaacaagatcgtgcagatcctgccctgggagcagaatgagcaggtgaagaactttgtggccagccacatcgccaacatcctgaacagcgaggagctggacatccaggacctgaagaagctggtgaaggaggccctgaaggagagccagctgcccaccgtgatggacttcaggaagttcagcaggaactaccagctgtacaagtctgtgtccctgcccagcctggaccctgccagcgccaagattgagggcaacctgatctttgaccccaacaactacctgcccaaggagagcatgctgaagaccaccctgacagccttcggctttgccagcgctgacctgattgagatcggcctggagggcaaaggatttgagcccaccctggaggccctgtttgggaagcagggcttcttcccagacagcgtgaacaaggccctgtactgggtgaatggccaggtgcctgatggagtgtccaaggtgctggtggaccacttcggctacaccaaggatgacaagcatgagcaggacatggtgaatggcatcatgctgtctgtggagaagctgatcaaggacctgaagagcaaggaggtgcctgaggcccgggcctacctgcgcatcctgggggaggagctgggctttgccagcctgcatgacctgcagctgctgggcaagctgctgctgatgggcgcccggaccctgcagggcatcccccagatgattggagaggtgatcaggaagggcagcaagaatgacttcttcctgcactacatcttcatggagaatgcctttgagctgcccaccggggccggcctgcagctgcagatcagcagcagtggagtcatcgcccctggggccaaggccggcgtgaagctggaggtggccaacatgcaggccgagctggtggccaagcccagcgtgtctgtggagtttgtgaccaacatgggcatcatcatcccagactttgcccggtctggagtgcagatgaacaccaacttcttccatgaaagtggcctggaggcccacgtggccctgaaggccggcaagctgaagttcatcatccccagccccaagaggcctgtgaagctgctgagcggcggcaacaccctgcacctggtgtccaccaccaagacagaggtgatcccccccctgattgagaaccggcagagctggagcgtgtgcaagcaggtgtttcctggcctgaactactgcaccagcggggcctacagcaatgccagcagcacagattctgccagctactaccccctgaccggggacacccggctggagctggagctgcggcccaccggggagattgagcagtacagcgtgtctgccacctatgagctgcagagagaagatcgggccctggtggacaccctgaagtttgtgacccaggccgagggcgccaagcagacagaggccaccatgaccttcaagtacaaccggcagagcatgaccctgagcagcgaggtgcagatcccagactttgatgtggacctgggcaccatcctgcgggtgaatgatgagagcacagagggcaagaccagctaccgcctgaccctggacatccagaacaagaagatcacagaggtggccctgatgggccacctgagctgtgacaccaaggaggagaggaagatcaagggcgtcatcagcatcccccggctgcaggccgaggcccggtctgagatcctggcccactggagccctgccaagctgctgctgcagatggacagcagcgccacagcctacggcagcacagtgtccaagagggtggcctggcactatgatgaggagaagattgaatttgagtggaacacaggcaccaacgtggacaccaagaagatgaccagcaacttccctgtggacctgagtgactaccccaagagcctgcacatgtatgccaaccggctgctggaccaccgggtgccccagacagacatgaccttcagacatgtgggcagcaagctgattgtggccatgagctcctggctgcagaaggccagcggcagcctgccctacacccagaccctgcaggaccacctgaacagcctgaaggagttcaacctgcagaacatgggcctgcctgacttccacatcccagaaaatctcttcctgaagagtgatggccgggtgaagtacaccctgaacaagaacagcctgaagattgagatccccctgccctttggaggcaagagcagccgggacctgaagatgctggagaccgtgaggaccccagccctgcacttcaagtctgtgggcttccacctgcccagccgggagttccaggtgcccaccttcaccatccccaagctgtaccagctgcaggtgcccctgctgggcgtgctggacctgagcaccaacgtgtacagcaacctgtacaactggagcgccagctacagcggcggcaacaccagcacagaccacttcagcctgcgggcccgctaccacatgaaggctgacagcgtggtggacctgctgagctacaacgtgcagggcagcggggagaccacctatgaccacaagaacaccttcaccctgtcctatgatggcagcctgcggcacaagttcctggacagcaacatcaagttcagccacgtggagaagctgggcaacaaccctgtgtccaagggcctgctgatctttgatgccagcagctcctggggcccccagatgtctgcctctgtgcacctggacagcaagaagaagcagcacctgtttgtgaaggaggtgaagattgatggccagttccgggtgagcagcttctacgccaagggcacctacggcctgagctgccagagggaccccaacacaggccgcctgaatggagagagcaacctgcgcttcaacagcagctacctgcagggcaccaaccagatcaccggccgctatgaagatggcaccctgagcctgaccagcaccagtgacctgcagagcggcatcatcaagaacacagccagcctgaagtatgagaactatgagctgaccctgaagagtgacaccaacgggaagtacaagaactttgccaccagcaacaagatggacatgaccttcagcaagcagaatgccctgctgcggtctgagtaccaggccgactatgagagcctgcgcttcttcagcctgctgagcggcagcctgaacagccacggcctggagctgaatgctgacatcctgggcacagacaagatcaacagcggggcccacaaggccaccctgagaattggccaggacggcatcagcaccagcgccaccaccaacctgaagtgcagcctgctggtgctggagaatgagctgaatgctgagctgggcctgagcggggcctccatgaagctgaccaccaacggccgcttccgggagcacaatgccaagttcagcctggatggcaaggccgccctgacagagctgagcctgggcagcgcctaccaggccatgatcctgggcgtggacagcaagaacatcttcaacttcaaggtgtcccaggagggcctgaagctgagcaatgacatgatgggcagctatgcagagatgaagtttgaccacaccaacagcctgaacattgctggcctgagcctggacttcagcagcaagctggacaacatctacagcagtgacaagttctacaagcagacagtgaacctgcagctgcagccctacagcctggtgaccaccctgaacagcgacctgaagtacaatgccctggacctgaccaacaacgggaagctgcggctggagcccctgaagctgcacgtggccggcaacctgaagggggcctaccagaacaatgagatcaagcacatctatgccatcagcagcgctgccctgagcgccagctacaaggctgacacagtggccaaggtgcagggcgtggagttcagccaccggctgaacacagacattgctggcctggccagcgccatcgacatgagcaccaactacaacagcgacagcctgcacttcagcaatgtgttccgctctgtgatggcccccttcaccatgaccattgatgcccacaccaatggaaatggcaagctggccctgtggggcgagcacacaggccagctgtacagcaagttcctgctgaaggccgagcccctggccttcaccttcagccatgactacaagggcagcaccagccaccacctggtgtccaggaagagcatctctgctgccctggagcacaaggtgtctgccctgctgaccccagctgagcagacaggcacctggaagctgaagacccagttcaacaacaatgagtacagccaggacctggatgcctacaacaccaaggacaagattggagtggagctgaccggccgcaccctggccgacctgaccctgctggacagccccatcaaggtgcccctgctgctgtctgagcccatcaacatcattgatgccctggagatgagagatgctgtggagaagccccaggagttcaccatcgtggcctttgtgaagtatgacaagaaccaggatgtgcacagcatcaacctgcccttctttgagaccctgcaggagtactttgaaagaaaccggcagaccatcatcgtggtgctggagaatgtgcagaggaacctgaagcacatcaacatcgaccagtttgtgaggaagtacagagctgccctgggcaagctgccccagcaggccaatgactacctgaacagcttcaactgggagcggcaggtgtcccatgccaaggagaagctgacagccctgaccaagaagtaccgcatcacagaaaatgacatccagatcgccctggatgatgccaagatcaacttcaatgagaagctgagccagctgcagacctacatgatccagtttgaccagtacatcaaggacagctatgacctgcatgacctgaagatcgccatcgccaacatcattgatgagatcatcgagaagctgaagagcctggatgagcactaccacatccgggtgaacctggtgaagaccatccatgacctgcacctgttcatcgagaacatcgacttcaacaagagcggcagcagcacagcctcctggatccagaatgtggacaccaagtaccagatccgcatccagatccaggagaagctgcagcagctgaagaggcacatccagaacatcgacatccagcacctggccggcaagctgaagcagcacatcgaggccattgatgtgcgggtgctgctggaccagctgggcaccaccatcagctttgagcgcatcaatgacatcctggagcacgtgaagcacttcgtcatcaacctgattggagactttgaggtggccgagaagatcaatgccttccgggccaaggtgcatgagctgattgaaagatatgaggtggaccagcagatccaggtgctgatggacaagctggtggagctggcccaccagtacaagctgaaggagaccatccagaagctgagcaatgtgctgcagcaggtgaagatcaaggactactttgagaagctggtgggcttcattgatgatgctgtgaagaagctgaatgagctgtccttcaagaccttcattgaagatgtgaacaagttcctggacatgctgatcaagaagctgaagagctttgactaccaccagtttgtggatgagaccaatgacaagatccgggaggtgacccagaggctgaatggagagatccaggccctggagctgccccagaaggccgaggccctgaagctgttcctggaggagaccaaggccaccgtggccgtgtacctggagagcctgcaggacaccaagatcaccctcatcatcaactggctgcaggaggccctgagcagcgccagcctggcccacatgaaggccaagttccgggagaccctggaggacacccgggacaggatgtaccagatggacatccagcaggagctgcagcgctacctgagcctggtgggccaggtgtacagcaccctggtgacctacatcagtgactggtggaccctggccgccaagaacctgacagactttgctgagcagtacagcatccaggactgggccaagaggatgaaggccctggtggagcagggcttcaccgtgcctgagatcaagaccatcctgggcaccatgcctgcctttgaggtgtccctgcaggccctgcagaaggccaccttccagaccccagacttcatcgtgcccctgacagacctgcgcatccccagcgtgcagatcaacttcaaggacctgaagaacatcaagatccccagccgcttcagcaccccagagttcaccatcctgaacaccttccacatccccagcttcaccatcgactttgtggagatgaaggtgaagatcatccgcaccatcgaccagatgctgaacagcgagctgcagtggcctgtgcctgacatctacctgcgggacctgaaggtggaggacatccccctggcccgcatcaccctgcctgacttccggctgcctgagatcgccatccctgagttcatcatccccaccctgaacctgaatgacttccaggtgcctgacctgcacatccctgagttccagctgccccacatcagccacaccatcgaggtgcccaccttcggcaagctgtacagcatcctgaagatccagagccccctcttcaccctggatgccaatgctgacattggaaatggcaccaccagcgccaatgaagctggcattgctgccagcatcacagccaagggggagagcaagctggaggtgctgaactttgacttccaggccaatgcccagctgagcaaccccaagatcaaccccctggccctgaaggagagcgtgaagttcagcagcaagtacctgaggacagaacatggcagcgagatgctgttctttggaaatgccatcgagggcaagagcaacacagtggccagcctgcacacagagaagaacaccctggagctgagcaatggagtcatcgtgaagatcaacaaccagctgaccctggacagcaacaccaagtacttccacaagctgaacatccccaagctggacttcagcagccaggccgacctgagaaatgagatcaagaccctgctgaaggccggccacatcgcctggaccagcagcggcaagggctcctggaagtgggcctgcccccgcttcagtgatgagggcacccatgagagccagatctccttcaccatcgagggccccctgaccagctttggcctgagcaacaagatcaacagcaagcacctgcgggtgaaccagaacctggtgtatgagagcggcagcctgaacttcagcaagctggagatccagagccaggtggacagccagcacgtgggccacagcgtgctgacagccaagggcatggccctgtttggagagggcaaggccgagttcaccggcagacatgatgcccacctgaatggcaaggtgattggcaccctgaagaacagcctcttcttcagcgcccagccctttgagatcacagccagcaccaacaatgaaggcaacctgaaggtgcgcttccccctgcggctgaccgggaagattgacttcctgaacaactatgccctcttcctgagccccagcgcccagcaggcctcctggcaggtgtctgcccgcttcaaccagtacaagtacaaccagaacttctctgctggcaacaatgaaaacatcatggaggcccacgtgggcatcaacggggaggccaacctggacttcctgaacatccccctgaccatccctgagatgaggctgccctacaccatcatcaccaccccacccctgaaggacttcagcctgtgggagaagacaggcctgaaggagttcctgaagaccaccaagcagagctttgacctgtctgtgaaggcccagtacaagaagaacaagcaccgccacagcatcaccaaccccctggccgtgctgtgtgagttcatcagccagagcatcaagagctttgacagacactttgagaagaacagaaataatgccctggactttgtgaccaagagctacaatgagaccaagatcaagtttgacaagtacaaggccgagaagagccatgatgagctgcccaggaccttccagatccctggctacacagtgcctgtggtgaatgtggaggtgagccccttcaccatcgagatgtctgccttcggctacgtgttccccaaggctgtgtccatgcccagcttcagcatcctgggcagtgatgtgcgggtgcccagctacaccctcatcctgcccagcctggagctgcctgtgctgcacgtgcccaggaacctgaagctgagcctgcctgacttcaaggagctgtgcaccatcagccacatcttcatcccagccatgggcaacatcacctatgacttctccttcaagagcagcgtcatcaccctgaacaccaatgctgagctgttcaaccagagcgacatcgtggcccacctgctgagcagcagcagctctgtgattgatgccctgcagtacaagctggagggcaccacccggctgaccaggaagaggggcctgaagctggccacagccctgagcctgagcaacaagtttgtggagggcagccacaacagcacagtgtccctgaccaccaagaacatggaggtgtctgtggccaccaccaccaaggcccagatccccatcctgaggatgaacttcaagcaggagctgaatggaaacaccaagagcaagcccaccgtgagcagctccatggagttcaagtatgacttcaacagctccatgctgtacagcacagccaagggagctgtggaccacaagctgagcctggagagcctgaccagctacttcagcattgagagcagcaccaagggagatgtgaagggctctgtgctgagccgggagtacagcggcaccatcgccagcgaggccaacacctacctgaacagcaagagcaccaggagctctgtgaagctgcagggcaccagcaagattgatgacatctggaacctggaggtgaaggagaactttgctggggaggccaccctgcagaggatctacagcctgtgggagcacagcaccaagaaccacctgcagctggagggcctcttcttcaccaacggggagcacaccagcaaggccaccctggagctgagcccctggcagatgtctgccctggtgcaggtgcacgccagccagcccagcagcttccatgacttcccagacctgggccaggaggtggccctgaatgccaacaccaagaaccagaagatccgctggaagaatgaggtgcgcatccacagcggcagcttccagagccaggtggagctgagcaatgaccaggagaaggcccacctggacattgctggcagcctggagggccacctgcgcttcctgaagaacatcatcctgcctgtgtatgacaagagcctgtgggacttcctgaagctggatgtgaccaccagcatcggccggcggcagcacctgcgggtgtccacagcctttgtgtacaccaagaaccccaacggctacagcttcagcatccctgtgaaggtgctggccgacaagttcatcatccctggcctgaagctgaatgacctgaacagcgtgctggtgatgcccaccttccacgtgcccttcacagacctgcaggtgcccagctgcaagctggacttccgggagatccagatctacaagaagctgcggaccagcagctttgccctgaacctgcccaccctgcctgaggtgaagtttcctgaggtggatgtgctgaccaagtacagccagcctgaggacagcctcatccccttctttgagatcaccgtgcctgagagccagctgactgtgtcccagttcaccctgcccaagtctgtgtctgatggcattgctgccctggacctgaatgctgtggccaacaagattgctgactttgagctgcccaccatcatcgtgcctgagcagaccatcgagatccccagcatcaagttctctgtgcctgctggcatcgtcatccccagcttccaggccctgacagccaggtttgaggtggacagccctgtgtacaatgccacctggagcgccagcctgaagaacaaggctgactatgtggagaccgtgctggacagcacctgcagcagcacagtgcagttcctggagtatgagctgaatgtgctgggcacccacaagattgaagatggcaccctggccagcaagaccaagggcacctttgcccaccgggacttcagcgcagaatatgaggaggatggcaagtatgagggcctgcaggagtgggagggcaaggcccacctgaacatcaagagccctgccttcacagacctgcacctgcgctaccagaaggacaagaagggcatcagcaccagcgctgccagccctgctgtgggcaccgtgggcatggacatggatgaagatgatgacttcagcaagtggaacttctactacagcccccagagcagcccagacaagaagctgaccatcttcaagacagagctgcgggtgcgggagagtgatgaggagacccagatcaaggtgaactgggaggaggaggccgccagcggcctgctgaccagcctgaaggacaacgtgcccaaggccaccggggtgctgtatgactatgtgaacaagtaccactgggagcacacaggcctgaccctgcgggaggtgagcagcaagctgcggaggaacctgcagaacaatgctgagtgggtgtaccagggcgccatccggcagattgatgacattgatgtgcgcttccagaaggccgccagcggcaccaccggcacctaccaggagtggaaggacaaggcccagaacctgtaccaggagctgctgacccaggagggccaggccagcttccagggcctgaaggacaacgtgtttgatggcctggtgcgggtgacccaggagttccacatgaaggtgaagcacctgattgacagcctgattgacttcctgaacttcccccgcttccagtttcctgggaagccaggcatctacacccgggaggagctgtgcaccatgttcatccgggaggtgggcaccgtgctgagccaggtgtacagcaaggtgcacaatggaagtgagatcctcttctcctacttccaggacctggtgatcaccctgccctttgagctgaggaagcacaagctgattgatgtgatctccatgtaccgggagctgctgaaggacctgagcaaggaggcccaggaggtgttcaaggccatccagagcctgaagaccacagaggtgctgaggaacctgcaggacctgctgcagttcatcttccagctgattgaggacaacatcaagcagctgaaggagatgaagttcacctacctgatcaactacatccaggatgagatcaacaccatcttcagtgactacatcccctgcttctag

SEQ ID NO: 2965 - DNA, 798 bp, Artificial Sequence
  Description of Artificial Sequence: Synthetic coding sequence
atgaagaaggaggtgtgcagcgtggccttcctgaaggctgtgtttgctgagttcctggccaccctcatctttgtgttcttcggcctgggcagcgccctgaagtggcccagcgccctgcccaccatcctgcagatcgccctggccttcggcctggccatcggcaccctggcccaggccctgggccctgtgtctgggggccacatcaacccagccatcaccctggccctgctggtgggcaaccagatcagcctgctgcgggccttcttctacgtggccgcccagctggtgggcgccatcgccggggccggcatcctgtatggagtggcccccctgaatgcccggggcaacctggccgtgaatgccctgaacaacaacaccacccagggccaggccatggtggtggagctgatcctgaccttccagctggccctgtgcatctttgccagcacagacagcaggaggaccagccctgtgggcagccctgccctgagcatcggcctgtctgtgaccctgggccacctggtgggcatctacttcaccggctgcagcatgaacccagcccggagctttggacctgctgtggtgatgaaccgcttctccccagcccactgggtgttctgggtgggccccatcgtgggcgctgtgctggccgccatcctgtacttctacctgctcttccccaacagcctgagcctgtctgagcgggtggccatcatcaagggcacctatgagccagatgaggactgggaggagcagcgggaggagaggaagaagaccatggagctgaccaccaggtag

SEQ ID NO: 2966 - DNA, 993 bp, Artificial Sequence
  Description of Artificial Sequence: Synthetic coding sequence
atgtctgccaagagcaggaccatcggcatcattggagcccccttcagcaagggccagccccggggcggcgtggaggagggccccaccgtgctgaggaaggccggcctgctggagaagctgaaggagcaggtgacccagaacttcctgatcctggagtgtgatgtgaaggactatggagacctgccctttgctgacatccccaatgacagccccttccagatcgtgaagaaccccaggtctgtgggcaaggccagcgagcagctggccggcaaggtggccgaggtgaagaagaatggccgcatcagcctggtgctgggcggggaccacagcctggccatcggcagcatcagcggccacgcccgggtgcacccagacctgggcgtcatctgggtggatgcccacacagacatcaacacccccctgaccaccaccagcggcaacctgcacggccagcctgtgtccttcctgctgaaggagctgaagggcaagatcccagatgtgcccggcttctcctgggtgaccccctgcatcagcgccaaggacatcgtgtacatcggcctgagagatgtggaccccggggagcactacatcctgaagaccctgggcatcaagtacttctccatgacagaggtggaccggctgggcatcggcaaggtgatggaggagaccctgagctacctgctgggcaggaagaagaggcccatccacctgagctttgatgtggatggcctggaccccagcttcaccccagccaccggcacccctgtggtgggcggcctgacctaccgggagggcctgtacatcacagaggagatctacaagacaggcctgctgagcggcctggacatcatggaggtgaaccccagcctgggcaagaccccagaggaggtgaccaggacagtgaacacagctgtggccatcaccctggcctgcttcggcctggcccgggagggcaaccacaagcccatcgactacctgaacccccccaagtag

SEQ ID NO: 2967 - DNA, 969 bp, Artificial Sequence
  Description of Artificial Sequence: Synthetic coding sequence
atgtctgccaagagcaggaccatcggcatcattggagcccccttcagcaagggccagccccggggcggcgtggaggagggccccaccgtgctgaggaaggccggcctgctggagaagctgaaggagcaggagtgtgatgtgaaggactatggagacctgccctttgctgacatccccaatgacagccccttccagatcgtgaagaaccccaggtctgtgggcaaggccagcgagcagctggccggcaaggtggccgaggtgaagaagaatggccgcatcagcctggtgctgggcggggaccacagcctggccatcggcagcatcagcggccacgcccgggtgcacccagacctgggcgtcatctgggtggatgcccacacagacatcaacacccccctgaccaccaccagcggcaacctgcacggccagcctgtgtccttcctgctgaaggagctgaagggcaagatcccagatgtgcccggcttctcctgggtgaccccctgcatcagcgccaaggacatcgtgtacatcggcctgagagatgtggaccccggggagcactacatcctgaagaccctgggcatcaagtacttctccatgacagaggtggaccggctgggcatcggcaaggtgatggaggagaccctgagctacctgctgggcaggaagaagaggcccatccacctgagctttgatgtggatggcctggaccccagcttcaccccagccaccggcacccctgtggtgggcggcctgacctaccgggagggcctgtacatcacagaggagatctacaagacaggcctgctgagcggcctggacatcatggaggtgaaccccagcctgggcaagaccccagaggaggtgaccaggacagtgaacacagctgtggccatcaccctggcctgcttcggcctggcccgggagggcaaccacaagcccatcgactacctgaacccccccaagtag

SEQ ID NO: 2968 - DNA, 711 bp, Artificial Sequence
  Description of Artificial Sequence: Synthetic coding sequence
atgtctgccaagagcaggaccatcggcatcattggagcccccttcagcaagggccagccccggggcggcgtggaggagggccccaccgtgctgaggaaggccggcctgctggagaagctgaaggagcaggagtgtgatgtgaaggactatggagacctgccctttgctgacatccccaatgacagccccttccagatcgtgaagaaccccaggtctgtgggcaaggccagcgagcagctggccggcaaggtggccgaggtgaagaagaatggccgcatcagcctggtgctgggcggggaccacagcctggccatcggcagcatcagcggccacgcccgggtgcacccagacctgggcgtcatctgggtggatgcccacacagacatcaacacccccctgaccaccaccagcggcaacctgcacggccagcctgtgtccttcctgctgaaggagctgaagggcaagatcccagatgtgcccggcttctcctgggtgaccccctgcatcagcgccaaggacatcgtgtacatcggcctgagagatgtggaccccggggagcactacatcctgaagaccctgggcatcaagtacttctccatgacagaggtgaccaggacagtgaacacagctgtggccatcaccctggcctgcttcggcctggcccgggagggcaaccacaagcccatcgactacctgaacccccccaagtag

SEQ ID NO: 2969 - DNA, 1395 bp, Artificial Sequence
  Description of Artificial Sequence: Synthetic coding sequence
atggccagcgagagcggcaagctgtggggcggccgctttgtgggcgctgtggaccccatcatggagaagttcaatgccagcatcgcctatgacagacacctgtgggaggtggatgtgcagggcagcaaggcctacagccggggcctggagaaggccggcctgctgaccaaggccgagatggaccagatcctgcacggcctggacaaggtggccgaggagtgggcccagggcaccttcaagctgaacagcaatgatgaggacatccacacagccaatgaaagaaggctgaaggagctgattggagccacagctgggaagctgcacacaggccgcagcagaaatgaccaggtggtgacagacctgcggctgtggatgaggcagacctgcagcaccctgagcggcctgctgtgggagctgatccgcaccatggtggacagagctgaggccgagagagatgtgctcttccctggctacacccacctgcagagggcccagcccatccgctggagccactggatcctgagccatgctgtggccctgacccgggacagcgagcggctgctggaggtgaggaagaggatcaacgtgctgcccctgggcagcggggccatcgccggcaaccccctgggcgtggaccgggagctgctgcgggcagagctgaactttggagccatcaccctgaacagcatggatgccaccagcgagcgggactttgtggccgagttcctgttctgggccagcctgtgcatgacccacctgagcaggatggccgaggacctgatcctgtactgcaccaaggagttctcctttgtgcagctgagtgatgcctacagcacaggcagcagcctgatgccccagaagaagaacccagacagcctggagctgatccgcagcaaggccggccgggtgtttggccgctgtgccggcctgctgatgaccctgaagggcctgcccagcacctacaacaaggacctgcaggaggacaaggaggccgtgtttgaggtgtctgacaccatgtctgctgtgctgcaggtggccactggagtcatcagcaccctgcagatccaccaggagaacatgggccaggccctgagcccagacatgctggccacagacctggcctactacctggtgaggaagggcatgcccttccggcaggcccacgaggccagcggcaaggctgtgttcatggccgagaccaagggcgtggccctgaaccagctgagcctgcaggagctgcagaccatcagccccctcttctctggagatgtgatctgtgtgtgggactatggccacagcgtggagcagtatggagccctgggcggcacagcccggagctctgtggactggcagatccggcaggtgcgggccctgctgcaggcccagcaggcctag

SEQ ID NO: 2970 - DNA, 1317 bp, Artificial Sequence
  Description of Artificial Sequence: Synthetic coding sequence
atggccagcgagagcggcaagctgtggggcggccgctttgtgggcgctgtggaccccatcatggagaagttcaatgccagcatcgcctatgacagacacctgtgggaggtggatgtgcagggcagcaaggcctacagccggggcctggagaaggccggcctgctgaccaaggccgagatggaccagatcctgcacggcctggacaaggtggccgaggagtgggcccagggcaccttcaagctgaacagcaatgatgaggacatccacacagccaatgaaagaaggctgaaggagctgattggagccacagctgggaagctgcacacaggccgcagcagaaatgaccaggtggtgacagacctgcggctgtggatgaggcagacctgcagcaccctgagcggcctgctgtgggagctgatccgcaccatggtggacagagctgaggccgagagagatgtgctcttccctggctacacccacctgcagagggcccagcccatccgctggagccactggatcctgagcggggccatcgccggcaaccccctgggcgtggaccgggagctgctgcgggcagagctgaactttggagccatcaccctgaacagcatggatgccaccagcgagcgggactttgtggccgagttcctgttctgggccagcctgtgcatgacccacctgagcaggatggccgaggacctgatcctgtactgcaccaaggagttctcctttgtgcagctgagtgatgcctacagcacaggcagcagcctgatgccccagaagaagaacccagacagcctggagctgatccgcagcaaggccggccgggtgtttggccgctgtgccggcctgctgatgaccctgaagggcctgcccagcacctacaacaaggacctgcaggaggacaaggaggccgtgtttgaggtgtctgacaccatgtctgctgtgctgcaggtggccactggagtcatcagcaccctgcagatccaccaggagaacatgggccaggccctgagcccagacatgctggccacagacctggcctactacctggtgaggaagggcatgcccttccggcaggcccacgaggccagcggcaaggctgtgttcatggccgagaccaagggcgtggccctgaaccagctgagcctgcaggagctgcagaccatcagccccctcttctctggagatgtgatctgtgtgtgggactatggccacagcgtggagcagtatggagccctgggcggcacagcccggagctctgtggactggcagatccggcaggtgcgggccctgctgcaggcccagcaggcctag

SEQ ID NO: 2971 - DNA, 1335 bp, Artificial Sequence
  Description of Artificial Sequence: Synthetic coding sequence
atggccagcgagagcggcaagctgtggggcggccgctttgtgggcgctgtggaccccatcatggagaagttcaatgccagcatcgcctatgacagacacctgtgggaggtggatgtgcagggcagcaaggcctacagccggggcctggagaaggccggcctgctgaccaaggccgagatggaccagatcctgcacggcctggacaaggtggccgaggagtgggcccagggcaccttcaagctgaacagcaatgatgaggacatccacacagccaatgaaagaaggctgaaggagctgattggagccacagctgggaagctgcacacaggccgcagcagaaatgaccaggtggtgacagacctgcggctgtggatgaggcagacctgcagcaccctgagcggcctgctgtgggagctgatccgcaccatggtggacagagctgaggccgagagagatgtgctcttccctggctacacccacctgcagagggcccagcccatccgctggagccactggatcctgagccatgctgtggccctgacccgggacagcgagcggctgctggaggtgaggaagaggatcaacgtgctgcccctgggcagcggggccatcgccggcaaccccctgggcgtggaccgggagctgctgcgggcagagctgaactttggagccatcaccctgaacagcatggatgccaccagcgagcgggactttgtggccgagttcctgttctgggccagcctgtgcatgacccacctgagcaggatggccgaggacctgatcctgtactgcaccaaggagttctcctttgtgcagctgagtgatgcctacagcacaggcagcagcctgatgccccagaagaagaacccagacagcctggagctgatccgcagcaaggccggccgggtgtttggaagagaggacaaggaggccgtgtttgaggtgtctgacaccatgtctgctgtgctgcaggtggccactggagtcatcagcaccctgcagatccaccaggagaacatgggccaggccctgagcccagacatgctggccacagacctggcctactacctggtgaggaagggcatgcccttccggcaggcccacgaggccagcggcaaggctgtgttcatggccgagaccaagggcgtggccctgaaccagctgagcctgcaggagctgcagaccatcagccccctcttctctggagatgtgatctgtgtgtgggactatggccacagcgtggagcagtatggagccctgggcggcacagcccggagctctgtggactggcagatccggcaggtgcgggccctgctgcaggcccagcaggcctag

SEQ ID NO: 2972 - DNA, 1395 bp, Artificial Sequence; identical to SEQ ID NO: 2969
  Description of Artificial Sequence: Synthetic coding sequence

SEQ ID NO: 2973 - DNA, 297 bp, Artificial Sequence
  Description of Artificial Sequence: Synthetic coding sequence
atggagaagttcaatgccagcatcgcctatgacagacacctgtgggaggtggatgtgcagggcagcaaggcctacagccggggcctggagaaggccggcctgctgaccaaggccgagatggaccagatcctgcacggcctggacaaggtggccgaggagtgggcccagggcaccttcaagctgaacagcaatgatgaggacatccacacagccaatgaaagaaggctgaaggagctgattggagccacagctgggaagctgcacacaggccgcagcagaaatgaccaggtgctgtag

SEQ ID NO: 2974 - DNA, 1239 bp, Artificial Sequence
  Description of Artificial Sequence: Synthetic coding sequence
atgagcagcaagggctctgtggtgctggcctacagcggcggcctggacaccagctgcatcctggtgtggctgaaggagcagggctatgatgtgattgcctacctggccaacatcggccagaaggaggactttgaggaggccaggaagaaggccctgaagctgggcgccaagaaggtgttcattgaagatgtgtcccgggagtttgtggaggagttcatctggccagccatccagagcagcgccctgtatgaggaccgctacctgctgggcaccagcctggcccggccctgcatcgccaggaagcaggtggagatcgcccagcgggagggcgccaagtatgtgagccacggggccactggaaaaggaaatgaccaggtgcgctttgagctgagctgctacagcctggccccccagatcaaggtgattgccccctggaggatgcctgagttctacaaccgcttcaagggcagaaatgacctgatggagtatgccaagcagcacggcatccccatccctgtgacccccaagaacccctggagcatggatgagaacctgatgcacatctcctatgaggccggcatcctggagaaccccaagaaccaggcccctcctggcctgtacaccaagacccaggaccctgccaaggcccccaacaccccagacatcctggagattgagttcaagaagggcgtgcctgtgaaggtgaccaacgtgaaggatggcaccacccaccagaccagcctggagctgttcatgtacctgaatgaggtggccggcaagcatggagtgggcagaattgacatcgtggagaaccgcttcatcggcatgaagagccggggcatctatgagaccccagctggcaccatcctgtaccacgcccacctggacatcgaggccttcaccatggaccgggaggtgaggaagatcaagcagggcctgggcctgaagtttgctgagctggtgtacacaggcttctggcacagcccagaatgtgaatttgtgcgccactgcatcgccaagagccaggagcgggtggagggcaaggtgcaggtgtctgtgctgaagggccaggtgtacatcctgggccgggagagccccctgagcctgtacaatgaggagctggtgtccatgaatgtgcagggcgactatgagcccacagatgccaccggcttcatcaacatcaacagcctgcggctgaaggagtaccaccggctgcagagcaaggtgacagccaagtag

SEQ ID NO: 2975 - DNA, 1239 bp, Artificial Sequence; identical to SEQ ID NO: 2974
  Description of Artificial Sequence: Synthetic coding sequence

SEQ ID NO: 2976 - DNA, 510 bp, Artificial Sequence
  Description of Artificial Sequence: Synthetic coding sequence
gagcccggccccctgcagctgatggtggtggccgaggcccagggcggcaagcacggcgtgggcagaattgatattgtggagaaccgcttcatcggcatgaagagccggggcatctatgagaccccagctggcaccatcctgtaccacgcccacctggacatcgaggccttcaccatggaccgggaggtgaggaagatcaagcagggcctgggcctgaagtttgctgagctggtgtacacaggcttctggcacagcccagaatgtgaatttgtgcgccactgcatcgccaagagccaggagcgggtggagggcaaggtgcaggtgtctgtgctgaagggccaggtgtacatcctgggccgggagagccccctgagcctgtacaatgaggagctggtgtccatgaatgtgcagggcgactatgagcccacagatgccaccggcttcatcaacatcaacagcctgcggctgaaggagtaccaccggctgcagagcaaggtgacagccaagtag

SEQ ID NO: 2977 - DNA, 1239 bp, Artificial Sequence; identical to SEQ ID NO: 2974
  Description of Artificial Sequence: Synthetic coding sequence

SEQ ID NO: 2978 - DNA, 1239 bp, Artificial Sequence; identical to SEQ ID NO: 2974
  Description of Artificial Sequence: Synthetic coding sequence

SEQ ID NO: 2979 - DNA, 597 bp, Artificial Sequence
  Description of Artificial Sequence: Synthetic coding sequence
atgagcagcaagggctctgtggtgctggcctacagcggcggcctggacaccagctgcatcctggtgtggctgaaggagcagggctatgatgtgattgcctacctggccaacatcggccagaaggaggactttgaggaggccaggaagaaggccctgaagctgggcgccaagaaggtgttcattgaagatgtgtcccgggagtttgtggaggagttcatctggccagccatccagagcagcgccctgtatgaggaccgctacctgctgggcaccagcctggcccggccctgcatcgccaggaagcaggtggagatcgcccagcgggagggcgccaagtatgtgagccacggggccactggaaaaggaaatgaccaggtgcgctttgagctgagctgctacagcctggccccccagatcaaggtgattgccccctggaggatgcctgagttctacaaccgcttcaagggcagaaatgacctgatggagtatgccaagcagcacggcatccccatccctgtgacccccaagaacccctggagcatggatgagaacctgatgcacatctcctatgaggccggcatcctggagaacccctag

SEQ ID NO: 2980 - DNA, 540 bp, Artificial Sequence
  Description of Artificial Sequence: Synthetic coding sequence
atgagcagcaagggctctgtggtgctggcctacagcggcggcctggacaccagctgcatcctggtgtggctgaaggagcagggctatgatgtgattgcctacctggccaacatcggccagaaggaggactttgaggaggccaggaagaaggccctgaagctgggcgccaagaaggtgttcattgaagatgtgtcccgggagtttgtggaggagttcatctggccagccatccagagcagcgccctgtatgaggaccgctacctgctgggcaccagcctggcccggccctgcatcgccaggaagcaggtggagatcgcccagcgggagggcgccaagtatgtgagccacggggccaccgggaaggtgattgccccctggaggatgcctgagttctacaaccgcttcaagggcagaaatgacctgatggagtatgccaagcagcacggcatccccatccctgtgacccccaagaacccctggagcatggatgagaacctgatgcacatctcctatgaagctggcatcctggagaacccctag

SEQ ID NO: 2981 - DNA, 663 bp, Artificial Sequence
  Description of Artificial Sequence: Synthetic coding sequence
atggagctgggcctgggcggcctgagcaccctgagccactgcccctggccccggcagcagcctgccctgtggcccaccctggccgccctggccctgctgagctctgtggccgaggccagcctgggcagcgcccccaggagccctgccccccgggagggccccccacctgtgctggccagccctgctggccacctgcccggcggccgcacagcccgctggtgcagcggccgggcccggcggcccccaccccagcccagcaggcctgcccctcctcctccagcccctccttctgccctgccccggggcggccgggccgcccgggccggcggccctggcagccgggcccgggccgccggggcccggggctgccgcctgcggagccagctggtgcctgtgcgggccctgggcctgggccacagaagtgatgagctggtgcgcttccgcttctgcagcggcagctgcagaagagcccggagcccccatgacctgagcctggccagcctgctgggcgctggggccctgcggcccccacctggcagcaggcctgtgtcccagccctgctgccggcccaccaggtatgaagctgtgtccttcatggatgtgaacagcacctggaggacagtggaccggctgagcgccacagcctgtggctgcctgggctag

SEQ ID NO: 2982 - DNA, 663 bp, Artificial Sequence; identical to SEQ ID NO: 2981
  Description of Artificial Sequence: Synthetic coding sequence

SEQ ID NO: 2983 - DNA, 687 bp, Artificial Sequence
  Description of Artificial Sequence: Synthetic coding sequence
atggagctgggcctgggcggcctgagcaccctgagccactgcccctggccccggcagcaggcccccctgggcctgagcgcccagcctgccctgtggcccaccctggccgccctggccctgctgagctctgtggccgaggccagcctgggcagcgcccccaggagccctgccccccgggagggccccccacctgtgctggccagccctgctggccacctgcccggcggccgcacagcccgctggtgcagcggccgggcccggcggcccccaccccagcccagcaggcctgcccctcctcctccagcccctccttctgccctgccccggggcggccgggccgcccgggccggcggccctggcagccgggcccgggccgccggggcccggggctgccgcctgcggagccagctggtgcctgtgcgggccctgggcctgggccacagaagtgatgagctggtgcgcttccgcttctgcagcggcagctgcagaagagcccggagcccccatgacctgagcctggccagcctgctgggcgctggggccctgcggcccccacctggcagcaggcctgtgtcccagccctgctgccggcccaccaggtatgaagctgtgtccttcatggatgtgaacagcacctggaggacagtggaccggctgagcgccacagcctgtggctgcctgggctag

SEQ ID NO: 2984 - DNA, 201 bp, Artificial Sequence
  Description of Artificial Sequence: Synthetic coding sequence
atggagctgggcctgggcggcctgagcaccctgagccactgcccctggccccggcagcagcctgccctgtggcccaccctggccgccctggccctgctgagctctgtggccgaggccagcctgggcagcgcccccaggagccctgccccccgggagggccccccacctgtgctggccagccctgctggccacctgccctag

SEQ ID NO: 2985 - DNA, 270 bp, Artificial Sequence
  Description of Artificial Sequence: Synthetic coding sequence
atggagctgggcctgggcggcctgagcaccctgagccactgcccctggccccggcagcaggcccccctgggcctgagcgcccagcctgccctgtggcccaccctggccgccctggccctgctgagctctgtggccgaggccagcctgggcagcgcccccaggagccctgccccccgggagggccccccacctgtgctggccagccctgctggccacctgcccggcggccgcacagcccgctggtgcagcggccgggcccggcggccctag

SEQ ID NO: 2986 - DNA, 201 bp, Artificial Sequence; identical to SEQ ID NO: 2984
  Description of Artificial Sequence: Synthetic coding sequence

SEQ ID NO: 2987 - DNA, 270 bp, Artificial Sequence; identical to SEQ ID NO: 2985
  Description of Artificial Sequence: Synthetic coding sequence

SEQ ID NO: 2988 - DNA, 687 bp, Artificial Sequence; identical to SEQ ID NO: 2983
  Description of Artificial Sequence: Synthetic coding sequence

SEQ ID NO: 2989 - DNA, 1602 bp, Artificial Sequence
  Description of Artificial Sequence: Synthetic coding sequence
atgggccccaggggggccgccagcctgccccggggccctggcccccggcggctgctgctgcctgtggtgctgcccctgctgctgctgctgctgctggcccctcctggcagcggggccggggccagccggcccccccacctggtgttcctgctggctgatgacctgggctggaatgatgtgggcttccacggcagccgcatccgcaccccccacctggatgccctggccgccggcggcgtgctgctggacaactactacacccagcccctgtgcacccccagccgcagccagctgctgaccggccgctaccagatcagaacaggcctgcagcaccagatcatctggccctgccagcccagctgtgtgcccctggatgagaagctgctgccccagctgctgaaggaggccggctacaccacccacatggtgggcaagtggcacctgggcatgtacaggaaggagtgcctgcccacccggcggggctttgacacctacttcggctacctgctgggcagcgaggactactacagccatgagcgctgcaccctgattgatgccctgaatgtgacccgctgtgccctggacttcagagatggagaggaggtggccaccggctacaagaacatgtacagcaccaacatcttcaccaagagggccatcgccctgatcaccaaccaccccccagagaagcccctcttcctgtacctggccctgcagagcgtgcatgagcccctgcaggtgcctgaggagtacctgaagccctatgacttcatccaggacaagaacagacaccactacgccggcatggtgtccctgatggatgaggccgtgggcaatgtgacagctgccctgaagagcagcggcctgtggaacaacacagtgttcatcttcagcacagacaatggaggccagaccctggccggcggcaacaactggcccctgcggggcaggaagtggagcctgtgggagggcggcgtgcggggcgtgggctttgtggccagccccctgctgaagcagaagggcgtgaagaaccgggagctgatccacatcagtgactggctgcccaccctggtgaagctggcccggggccacaccaacggcaccaagcccctggatggctttgatgtgtggaagaccatcagcgagggcagccccagccccagaattgagctgctgcacaacatcgaccccaactttgtggacagcagcccctgccccagaaattccatggccccagccaaggatgacagcagcctgcctgagtacagcgccttcaacacctctgtgcatgctgccatcagacatggcaactggaagctgctgaccggctacccaggctgcggctactggttccccccacccagccagtacaacgtgtctgagatccccagcagtgacccccccaccaagaccctgtggctgtttgatattgaccgggaccctgaggagagacatgacctgagccgggagtacccccacatcgtgaccaagctgctgagccggctgcagttctaccacaagcacagcgtgcctgtgtacttccctgcccaggacccccgctgtgaccccaaggccaccggggtgtggggcccctggatgtag

SEQ ID NO: 2990 - DNA, 1602 bp, Artificial Sequence; identical to SEQ ID NO: 2989
  Description of Artificial Sequence: Synthetic coding sequence

SEQ ID NO: 2991 - DNA, 1242 bp, Artificial Sequence
  Description of Artificial Sequence: Synthetic coding sequence
atgggccccaggggggccgccagcctgccccggggccctggcccccggcggctgctgctgcctgtggtgctgcccctgctgctgctgctgctgctggcccctcctggcagcggggccggggccagccggcccccccacctggtgttcctgctggctgatgacctgggctggaatgatgtgggcttccacggcagccgcatccgcaccccccacctggatgccctggccgccggcggcgtgctgctggacaactactacacccagcccctgtgcacccccagccgcagccagctgctgaccggccgctaccagatcagaacaggcctgcagcaccagatcatctggccctgccagcccagctgtgtgcccctggatgagaagctgctgccccagctgctgaaggaggccggctacaccacccacatggtgggcaagtggcacctgggcatgtacaggaaggagtgcctgcccacccggcggggctttgacacctacttcggctacctgctgggcagcgaggactactacagccatgagcgctgcaccctgattgatgccctgaatgtgacccgctgtgccctggacttcagagatggagaggaggtggccaccggctacaagaacatgtacagcaccaacatcttcaccaagagggccatcgccctgatcaccaaccaccccccagagaagcccctcttcctgtacctggccctgcagagcgtgcatgagcccctgcaggtgcctgaggagtacctgaagccctatgacttcatccaggacaagaacagacaccactacgccggcatggtgtccctgatggatgaggccgtgggcaatgtgacagctgccctgaagagcagcggcctgtggaacaacacagtgttcatcttcagcacagacaatggaggccagaccctggccggcggcaacaactggcccctgcggggcaggaagtggagcctgtgggagggcggcgtgcggggcgtgggctttgtggccagccccctgctgaagcagaagggcgtgaagaaccgggagctgatccacatcagtgactggctgcccaccctggtgaagctggcccggggccacaccaacggcaccaagcccctggatggctttgatgtgtggaagaccatcagcgagggcagccccagccccagaattgagctgctgcacaacatcgaccccaactttgtggacagcagcccctactggccagagtgcagcctgctgctgtag

SEQ ID NO: 2992 - DNA, 138 bp, Artificial Sequence
  Description of Artificial Sequence: Synthetic coding sequence
atgggccccaggggggccgccagcctgccccggggccctggcccccggcggctgctgctgcctgtggtgctgcccctgctgctgctgctgctgctggcccctcctggcagcggggccggggccagccggcccccatag

SEQ ID NO: 2993 - DNA, 1788 bp, Artificial Sequence
  Description of Artificial Sequence: Synthetic coding sequence
atggccggccccagcccccccctgcgggccggcgtgggccggcggctgctgggcgtggcccacccagacctgcggccctgcctgtgtggggagctgcaggtggagggcggccctggccctgtgcccggcatgctgcggacctgctacgtgcgcagcccctggaggcggggccccagcagcgcccggggggagcagagcggcagcggccacctggagcaggaggaggtgcagagcggcagcctgctcttccggctgctgctcttcctgagccgcagccctgccagcaggaaccagaggatcctgtacacagtgctggagtgccagcccctgtttgacagcagtgacatgaccatcgccgagtgggtgtgcctggcccagaccatcaagaggcactatgagcagtaccacggctttgtggtgatccacggcacagacaccatggcctttgctgcctccatgctgtccttcatgctggagaacctgcagaagacagtcatcctgaccggggcccaggtgcccatccacgccctgtggagcgatggaagagagaacctgctgggcgccctgctgatggccggccagtatgtgattcctgaggtgtgcctcttcttccagaaccagctgttccggggcaacagagccaccaaggtggatgccaggagatttgctgccttctgcagccccaacctgctgcccctggccaccgtgggcgctgacatcaccatcaaccgggagctggtgaggaaggtggatggcaaggccggcctggtggtgcacagctccatggagcaggatgtgggcctgctgcggctgtacccaggcatcccagctgccctggtgcgggccttcctgcagccccccctgaagggcgtggtgatggagaccttcggcagcggaaatggccccaccaagccagacctgctgcaggagctgcgggtggccacagagcggggcctggtgattgtgaactgcacccactgcctgcagggcgctgtgaccacagattatgctgctggcatggccatggccggggccggggtcatcagcggctttgacatgaccagcgaggccgccctggccaagctgtcctatgtgctgggccagcccggcctgagcctggatgtgaggaaggagctgctgaccaaggacctgcggggggagatgaccccacccagcgtggaggagcggcggcccagcctgcagggcaacaccctgggcggcggcgtgtcctggctgctgagcctgagcggcagccaggaggctgatgccctgagaaatgccctggtgcccagcctggcctgtgccgccgcccatgctggagatgtggaggccctgcaggccctggtggagctgggcagtgacctgggcctggtggacttcaacggccagacccccctgcacgccgccgcccggggcggccacacagaagctgtgaccatgctgctgcagaggggcgtggatgtgaacacccgggacacagatggcttcagccccctgctgctggccgtgcggggccgccaccctggggtgattggcctgctgcgggaggccggggccagcctgagcacccaggagctggaggaggccggcacagagctgtgccgcctggcctacagagctgacctggagggcctgcaggtgtggtggcaggccggggctgacctgggccagcccggctatgatggccacagcgccctgcacgtggccgaggccgccggcaacctggccgtggtggccttcctgcagagcctggagggcgctgtgggcgcccaggccccctgcccctag

SEQ ID NO: 2994 - DNA, 1740 bp, Artificial Sequence
  Description of Artificial Sequence: Synthetic coding sequence
atggcccgggctgtgggccctgagcggcggctgctggccgtgtacacaggaggcaccatcggcatgaggtctgagctgggcgtgctggtgcccggcaccggcctggccgccatcctgcggaccctgcccatgtttcatgatgaggagcacgcccgggcccggggcctgtctgaggacaccctggtgctgcccccagccagcaggaaccagaggatcctgtacacagtgctggagtgccagcccctgtttgacagcagtgacatgaccatcgccgagtgggtgtgcctggcccagaccatcaagaggcactatgagcagtaccacggctttgtggtgatccacggcacagacaccatggcctttgctgcctccatgctgtccttcatgctggagaacctgcagaagacagtcatcctgaccggggcccaggtgcccatccacgccctgtggagcgatggaagagagaacctgctgggcgccctgctgatggccggccagtatgtgattcctgaggtgtgcctcttcttccagaaccagctgttccggggcaacagagccaccaaggtggatgccaggagatttgctgccttctgcagccccaacctgctgcccctggccaccgtgggcgctgacatcaccatcaaccgggagctggtgaggaaggtggatggcaaggccggcctggtggtgcacagctccatggagcaggatgtgggcctgctgcggctgtacccaggcatcccagctgccctggtgcgggccttcctgcagccccccctgaagggcgtggtgatggagaccttcggcagcggaaatggccccaccaagccagacctgctgcaggagctgcgggtggccacagagcggggcctggtgattgtgaactgcacccactgcctgcagggcgctgtgaccacagattatgctgctggcatggccatggccggggccggggtcatcagcggctttgacatgaccagcgaggccgccctggccaagctgtcctatgtgctgggccagcccggcctgagcctggatgtgaggaaggagctgctgaccaaggacctgcggggggagatgaccccacccagcgtggaggagcggcggcccagcctgcagggcaacaccctgggcggcggcgtgtcctggctgctgagcctgagcggcagccaggaggctgatgccctgagaaatgccctggtgcccagcctggcctgtgccgccgcccatgctggagatgtggaggccctgcaggccctggtggagctgggcagtgacctgggcctggtggacttcaacggccagacccccctgcacgccgccgcccggggcggccacacagaagctgtgaccatgctgctgcagaggggcgtggatgtgaacacccgggacacagatggcttcagccccctgctgctggccgtgcggggccgccaccctggggtgattggcctgctgcgggaggccggggccagcctgagcacccaggagctggaggaggccggcacagagctgtgccgcctggcctacagagctgacctggagggcctgcaggtgtggtggcaggccggggctgacctgggccagcccggctatgatggccacagcgccctgcacgtggccgaggccgccggcaacctggccgtggtggccttcctgcagagcctggagggcgctgtgggcgcccaggccccctgcccagagcccagctgcttccaggaggtgctgcccggggtgtag

SEQ ID NO: 2995 - DNA, 423 bp, Artificial Sequence
  Description of Artificial Sequence: Synthetic coding sequence
gctgctgcccggggcggccacacagaggccgtgaccatgctgctgcagaggggcgtggatgtgaacacccgggacacagatggcttcagccccctgctgctggccgtgcggggccgccaccctggggtcatcggcctgctgcgggaggccggggccagcctgagcacccaggagctggaggaggccggcacagagctgtgccgcctggcctacagagctgacctggagggcctgcaggtgtggtggcaggccggggctgacctgggccagcccggctatgatggccacagcgccctgcacgtggccgaggccgccggcaacctggccgtggtggccttcctgcagagcctggagggcgctgtgggcgcccaggccccctgcccagagcccagctgcttccaggaggtgctgcccggggtgtag

SEQ ID NO: 2996 - DNA, 1722 bp, Artificial Sequence
  Description of Artificial Sequence: Synthetic coding sequence
atggcccgggctgtgggccctgagcggcggctgctggccgtgtacacaggaggcaccatcggcatgaggtctgagctgggcgtgctggtgcccggcaccggcctggccgccatcctgcggaccctgcccatgtttcatgatgaggagcacgcccgggcccggggcctgtctgaggacaccctggtgctgcccccagccagcaggaaccagaggatcctgtacacagtgctggagtgccagcccctgtttgacagcagtgacatgaccatcgccgagtgggtgtgcctggcccagaccatcaagaggcactatgagcagtaccacggctttgtggtgatccacggcacagacaccatggcctttgctgcctccatgctgtccttcatgctggagaacctgcagaagacagtcatcctgaccggggcccaggtgcccatccacgccctgtggagcgatggaagagagaacctgctgggcgccctgctgatggccggccagtatgtgattcctgaggtgtgcctcttcttccagaaccagctgttccggggcaacagagccaccaaggtggatgccaggagatttgctgccttctgcagccccaacctgctgcccctggccaccgtgggcgctgacatcaccatcaaccgggagctggtgaggaaggtggatggcaaggccggcctggtggtgcacagctccatggagcaggatgtgggcctgctgcggctgtacccaggcatcccagctgccctggtgcgggccttcctgcagccccccctgaagggcgtggtgatggagaccttcggcagcggaaatggccccaccaagccagacctgctgcaggagctgcgggtggccacagagcggggcctggtgattgtgaactgcacccactgcctgcagggcgctgtgaccacagattatgctgctggcatggccatggccggggccggggtcatcagcggctttgacatgaccagcgaggccgccctggccaagctgtcctatgtgctgggccagcccggcctgagcctggatgtgaggaaggagctgctgaccaaggacctgcggggggagatgaccccacccagcgtggaggagcggcggcccagcctgcagggcaacaccctgggcggcggcgtgtcctggctgctgagcctgagcggcagccaggaggctgatgccctgagaaatgccctggtgcccagcctggcctgtgccgccgcccatgctggagatgtggaggccctgcaggccctggtggagctgggcagtgacctgggcctggtggacttcaacggccagacccccctgcacgccgccgcccggggcggccacacagaagctgtgaccatgctgctgcagaggggcgtggatgtgaacacccgggacacagatggcttcagccccctgctgctggccgtgcggggccgccaccctggggtgattggcctgctgcgggaggccggggccagcctgagcacccaggagctggaggaggccggcacagagctgtgccgcctggcctacagagctgacctggagggcctgcaggtgtggtggcaggccggggctgacctgggccagcccggctatgatggccacagcgccctgcacgtggccgaggccgccggcaacctggccgtggtggccttcctgcagagcctggagggcgctgtgggcgcccaggccccctgcccagaggtgctgcccggggtgtag

SEQ ID NO: 2997 - DNA, 942 bp, Artificial Sequence
  Description of Artificial Sequence: Synthetic coding sequence
atgaccagctgccacatcgccgaggagcacatccagaaggtggccatctttggaggcacccatggaaatgagctgactggagtcttcctggtgaagcactggctggagaatggagctgagatccagaggacaggcctggaggtgaagcccttcatcaccaaccccagggctgtgaagaagtgcacccgctacatcgactgtgacctgaaccgcatctttgacctggagaacctgggcaagaagatgtctgaggacctgccctatgaggtgagaagagcccaggagatcaaccacctgtttggccccaaggacagcgaggacagctatgacatcatctttgacctgcacaacaccaccagcaacatgggctgcaccctcatcctggaggacagcaggaacaacttcctgatccagatgttccactacatcaagaccagcctggcccccctgccctgctacgtgtacctgattgagcaccccagcctgaagtatgccaccaccaggagcatcgccaagtaccctgtgggcatcgaggtgggcccccagccccagggcgtgctgcgggctgacatcctggaccagatgaggaagatgatcaagcacgccctggacttcatccaccacttcaatgaaggcaaggagttccccccctgtgccatcgaggtgtacaagatcatcgagaaggtggactaccccagagatgaaaatggagaaattgctgccatcatccaccccaacctgcaggaccaggactggaagcccctgcaccctggggaccccatgttcctgaccctggatggcaagaccatccccctgggcggggactgcaccgtgtaccctgtgtttgtgaatgaggccgcctactatgagaagaaggaggcctttgccaagaccaccaagctgaccctgaatgccaagagcatccgctgctgcctgcactag

SEQ ID NO: 2998 - DNA, 942 bp, Artificial Sequence; identical to SEQ ID NO: 2997
  Description of Artificial Sequence: Synthetic coding sequence

SEQ ID NO: 2999 - DNA, 3756 bp, Artificial Sequence
  Description of Artificial Sequence: Synthetic coding sequence
atgagcacagagcgggacagcgagaccacctttgatgaggacagccagcccaatgatgaggtggtgccctacagtgatgatgaaacagaagatgagctggatgaccagggcagcgctgtggagcctgagcagaacagagtgaaccgggaggccgaggagaaccgggagcccttcagaaaagaatgtacctggcaggtgaaggccaatgacaggaagtaccacgagcagccccacttcatgaacaccaagttcctgtgcatcaaggagagcaaatatgccaacaatgccatcaagacctacaagtacaatgccttcaccttcatccccatgaacctgtttgagcagttcaagagagctgccaacctgtacttcctggccctgctgatcctgcaggccgtgccccagatcagcaccctggcctggtacaccaccctggtgcccctgctggtggtgctgggcgtgacagccatcaaggacctggtggatgatgtggcccggcacaagatggacaaggagatcaacaacagaacctgtgaggtgatcaaggatggccgcttcaaggtggccaagtggaaggagatccaggtgggagatgtgatccggctgaagaagaatgactttgtgcctgctgacatcctgctgctgagcagcagcgagcccaacagcctgtgctacgtggagacagctgagctggatggagagaccaacctgaagttcaagatgagcctggagatcacagaccagtacctgcagcgggaggacaccctggccacctttgatggcttcattgaatgtgaggagcccaacaaccggctggacaagttcaccggcaccctcttctggaggaacaccagcttccccctggatgctgacaagatcctgctgcggggctgcgtcatccggaacacagacttctgccacggcctggtgatctttgctggagctgacaccaagatcatgaagaacagcggcaagacccgcttcaagaggaccaagattgactacctgatgaactacatggtgtacaccatctttgtggtgctgatcctgctgtctgctggcctggccatcggccacgcctactgggaggcccaggtgggcaacagctcctggtacctgtatgatggagaagatgacacccccagctaccggggcttcctgatcttctggggctacatcatcgtgctgaacaccatggtgcccatcagcctgtatgtgtctgtggaggtgatccggctgggccagagccacttcatcaactgggacctgcagatgtactatgcagagaaggacaccccagccaaggcccggaccaccaccctgaatgagcagctgggccagatccactacatcttcagtgacaagacaggcaccctgacccagaacatcatgaccttcaagaagtgctgcatcaatggccagatctacggggaccacagagatgccagccagcacaaccacaacaagattgagcaggtggacttctcctggaacacctatgcagatggcaagctggccttctatgaccactacctgattgagcagatccagagcggcaaggagcctgaggtgcggcagttcttcttcctgctggccgtgtgccacacagtgatggtggacagaacagatggccagctgaactaccaggccgccagcccagatgagggcgccctggtgaatgctgccaggaactttggatttgccttcctggcccggacccagaacaccatcaccatcagcgagctgggcacagagaggacctacaacgtgctggccatcctggacttcaacagcgacaggaagaggatgagcatcatcgtgaggaccccagagggcaacatcaagctgtactgcaagggagctgacaccgtcatctatgaaaggctgcacaggatgaaccccaccaagcaggagacccaggatgccctggacatctttgccaatgagaccctgcggaccctgtgcctgtgctacaaggagattgaggagaaggagttcacagagtggaacaagaagttcatggccgcctctgtggccagcaccaacagagatgaggccctggacaaggtgtatgaggagattgagaaggacctgatcctgctgggcgccacagccatcgaggacaagctgcaggatggagtgcctgagaccatcagcaagctggccaaggctgacatcaagatctgggtgctgaccggggacaagaaggagacagctgagaacatcggctttgcctgtgagctgctgacagaggacaccaccatctgctatggagaggacatcaacagcctgctgcacgccaggatggagaaccagaggaacagaggaggagtgtatgccaagtttgcccctcctgtgcaggagagcttcttccccccaggcggcaacagagccctgatcatcaccggctcctggctgaatgagatcctgctggagaagaagaccaagaggaacaagatcctgaagctgaagttccccaggacagaggaggagaggaggatgaggacccagagcaagaggcggctggaggccaagaaggagcagaggcagaagaactttgtggacctggcctgtgaatgttctgctgtgatctgctgccgggtgacccccaagcagaaggccatggtggtggacctggtgaagcgctacaagaaggccatcaccctggccatcggagatggagccaatgatgtgaacatgatcaagacagcccacatcggcgtgggcatcagcggccaggagggcatgcaggccgtgatgagcagtgactacagctttgcccagttccgctacctgcagaggctgctgctggtgcacggccgctggagctacatccgcatgtgcaagttcctgcgctacttcttctacaagaactttgccttcaccctggtgcacttctggtacagcttcttcaacggctacagcgcccagacagcctatgaggactggttcatcaccctgtacaacgtgctgtacaccagcctgcctgtgctgctgatgggcctgctggaccaggatgtgtctgacaagctgagcctgcgcttccctggcctgtacatcgtgggccagagggacctgctcttcaactacaagcgcttctttgtgtccctgctgcatggagtgctgacctccatgatcctcttcttcatccccctgggcgcctacctgcagacagtgggccaggatggagaggcccccagcgactaccagagctttgctgtgaccatcgccagcgccctggtgatcaccgtgaacttccagatcggcctggacaccagctactggacctttgtgaatgccttcagcatcttcggcagcatcgccctgtacttcggcatcatgtttgacttccacagcgctggcatccacgtgctcttccccagcgccttccagttcaccggcacagccagcaatgccctgcggcagccctacatctggctgaccatcatcctggccgtggccgtgtgcctgctgcctgtggtggccatccgcttcctgtccatgaccatctggcccagcgagagtgacaagatccagaagcacaggaagaggctgaaggccgaggagcagtggcagaggcggcagcaggtgttcagaagaggagtgtccaccaggagaagtgcctatgccttcagccaccagaggggctacgccgacctgatcagcagcggccgcagcatcaggaagaagaggagccccctggatgccatcgtggctgatggaacagctgagtacagaagaactggagacagctag

SEQ ID NO: 3000 - DNA, 3756 bp, Artificial Sequence; identical to SEQ ID NO: 2999
  Description of Artificial Sequence: Synthetic coding sequence

SEQ ID NO: 3001 - DNA, 4398 bp, Artificial Sequence
  Description of Artificial Sequence: Synthetic coding sequence
atgcctgagcaggagcggcagatcacagcccgggagggcgccagcaggaagatcctgagcaagctgagcctgcccacccgggcctgggagcccgccatgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcaagagctgtgtgctgaacattgaagaaaatattggccagctgctgggcgtgcagagcatccaggtgtccctggagaacaagacagcccaggtgaagtatgaccccagctgcaccagccctgtggccctgcagagggccatcgaggccctgcccccaggcaacttcaaggtgtccctgcctgatggagctgagggcagcggcacagaccacaggagcagcagcagccacagccctggcagccccccaagaaaccaggtgcagggcacctgcagcaccaccctgattgccatcgccggcatgacctgtgccagctgtgtgcacagcattgagggcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctgagagctgcagcaccaaccccctgggcaaccacagcgctggcaacagcatggtgcagaccacagatggcacccccacctctgtgcaggaggtggccccccacacaggccgcctgcctgccaaccacgccccagacatcctggccaagagcccccagagcaccagggctgtggccccccagaagtgcttcctgcagatcaagggcatgacctgtgccagctgtgtgagcaacatcgagaggaacctgcagaaggaggccggcgtgctgtctgtgctggtggccctgatggccggcaaggccgagatcaagtatgaccctgaggtgatccagcccctggagatcgcccagttcatccaggacctgggctttgaagctgctgtgatggaggactatgccggcagtgatggcaacatcgagctgaccatcaccggcatgacctgtgccagctgtgtgcacaacatcgagagcaagctgaccaggaccaacggcatcacctacgcctctgtggccctggccaccagcaaggccctggtgaagtttgatcctgagatcatcggcccccgggacatcatcaagatcatcgaggagatcggcttccacgccagcctggcccagaggaaccccaatgcccaccacctggaccacaagatggagatcaagcagtggaagaagagcttcctgtgcagcctggtgtttggcatccctgtgatggccctgatgatctacatgctgatccccagcaatgagccccaccagagcatggtgctggaccacaacatcatccctggcctgagcatcctgaacctgatcttcttcatcctgtgcacctttgtgcagctgctgggcggctggtacttctacgtgcaggcctacaagagcctgcggcacaggtctgccaacatggatgtgctgattgtgctggccaccagcatcgcctacgtgtacagcctggtgatcctggtggtggccgtggccgagaaggccgagaggagccctgtgaccttctttgacaccccacccatgctgtttgtgttcatcgccctgggccgctggctggagcacctggccaagagcaagaccagcgaggccctggccaagctgatgagcctgcaggccacagaggccaccgtggtgaccctgggggaggacaacctgatcatccgggaggagcaggtgcccatggagctggtgcagagaggagacatcgtgaaggtggtgcctgggggcaagtttcctgtggatggcaaggtgctggagggcaacaccatggctgatgagagcctcatcaccggggaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaaggcccccatccagcagctggccgaccgcttcagcggctactttgtgcccttcatcatcatcatgagcaccctgaccctggtggtgtggatcgtcatcggcttcatcgactttggagtggtgcagcgctacttccccaaccccaacaagcacatcagccagacagaggtgatcatccgctttgccttccagaccagcatcaccgtgctgtgcatcgcctgcccctgcagcctgggcctggccacccccacagctgtgatggtgggcactggagtggccgcccagaatggcatcctgatcaagggcggcaagcccctggagatggcccacaagatcaagacagtgatgtttgacaagacaggcaccatcacccacggcgtgccccgggtgatgagggtgctgctgctgggagatgtggccaccctgcccctgaggaaggtgctggccgtggtgggcacagctgaggccagcagcgagcaccccctgggcgtggccgtgaccaagtactgcaaggaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaggccggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcaccggggacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcaccggcacagatgtggccatcgaggccgcagatgtggtgctgatcagaaatgacctgctggatgtggtggccagcatccacctgagcaagaggacagtgcggcgcatccgcatcaacctggtgctggccctgatctacaacctggtgggcatccccatcgccgccggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3002 - DNA, 3777 bp, Artificial Sequence
  Description of Artificial Sequence: Synthetic coding sequence
atgcctgagcaggagcggcagatcacagcccgggagggcgccagcaggaagatcctgagcaagctgagcctgcccacccgggcctgggagcccgccatgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcaagagctgtgtgctgaacattgaagaaaatattggccagctgctgggcgtgcagagcatccaggtgtccctggagaacaagacagcccaggtgaagtatgaccccagctgcaccagccctgtggccctgcagagggccatcgaggccctgcccccaggcaacttcaaggtgtccctgcctgatggagctgagggcagcggcacagaccacaggagcagcagcagccacagccctggcagccccccaagaaaccaggtgcagggcacctgcagcaccaccctgattgccatcgccggcatgacctgtgccagctgtgtgcacagcattgagggcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctgagagctgcagcaccaaccccctgggcaaccacagcgctggcaacagcatggtgcagaccacagatggcacccccacctctgtgcaggaggtggccccccacacaggccgcctgcctgccaaccacgccccagacatcctggccaagagcccccagagcaccagggctgtggccccccagaagtgcttcctgcagatcaagggcatgacctgtgccagctgtgtgagcaacatcgagaggaacctgcagaaggaggccggcgtgctgtctgtgctggtggccctgatggccggcaaggccgagatcaagtatgaccctgaggtgatccagcccctggagatcgcccagttcatccaggacctgggctttgaagctgctgtgatggaggactatgccggcagtgatggcaacatcgagctgaccatcaccggcatgacctgtgccagctgtgtgcacaacatcgagagcaagctgaccaggaccaacggcatcacctacgcctctgtggccctggccaccagcaaggccctggtgaagtttgatcctgagatcatcggcccccgggacatcatcaagatcatcgagagcaagaccagcgaggccctggccaagctgatgagcctgcaggccacagaggccaccgtggtgaccctgggggaggacaacctgatcatccgggaggagcaggtgcccatggagctggtgcagagaggagacatcgtgaaggtggtgcctgggggcaagtttcctgtggatggcaaggtgctggagggcaacaccatggctgatgagagcctcatcaccggggaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaagaaccccaacaagcacatcagccagacagaggtgatcatccgctttgccttccagaccagcatcaccgtgctgtgcatcgcctgcccctgcagcctgggcctggccacccccacagctgtgatggtgggcaccggggtggccgcccagaatggcatcctgatcaagggcggcaagcccctggagatggcccacaagatcaagacagtgatgtttgacaagacaggcaccatcacccatggagtgccccgggtgatgagggtgctgctgctgggagatgtggccaccctgcccctgaggaaggtgctggccgtggtgggcacagctgaggccagcagcgagcaccccctgggcgtggccgtgaccaagtactgcaaggaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaagctggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcactggagacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcactggaacagatgtggccattgaagctgctgatgtggtgctgatcagaaatgacctgctggatgtggtggccagcatccacctgagcaagaggacagtgcggcgcatccgcatcaacctggtgctggccctgatctacaacctggtgggcatccccatcgctgctggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3003 - DNA, 4065 bp, Artificial Sequence
  Description of Artificial Sequence: Synthetic coding sequence
atgcctgagcaggagcggcagatcacagcccgggagggcgccagcaggaagatcctgagcaagctgagcctgcccacccgggcctgggagcccgccatgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctgagagctgcagcaccaaccccctgggcaaccacagcgctggcaacagcatggtgcagaccacagatggcacccccacctctgtgcaggaggtggccccccacacaggccgcctgcctgccaaccacgccccagacatcctggccaagagcccccagagcaccagggctgtggccccccagaagtgcttcctgcagatcaagggcatgacctgtgccagctgtgtgagcaacattgaaagaaacctgcagaaggaggccggcgtgctgtctgtgctggtggccctgatggccggcaaggccgagatcaagtatgaccctgaggtgatccagcccctggagatcgcccagttcatccaggacctgggctttgaggccgctgtgatggaggactatgccggcagtgatggcaacatcgagctgaccatcaccggcatgacctgtgccagctgtgtgcacaacatcgagagcaagctgaccaggaccaacggcatcacctacgcctctgtggccctggccaccagcaaggccctggtgaagtttgatcctgagatcatcggcccccgggacatcatcaagatcatcgaggagatcggcttccacgccagcctggcccagaggaaccccaatgcccaccacctggaccacaagatggagatcaagcagtggaagaagagcttcctgtgcagcctggtgtttggcatccctgtgatggccctgatgatctacatgctgatccccagcaatgagccccaccagagcatggtgctggaccacaacatcatccctggcctgagcatcctgaacctgatcttcttcatcctgtgcacctttgtgcagctgctgggcggctggtacttctacgtgcaggcctacaagagcctgcggcacaggtctgccaacatggatgtgctgattgtgctggccaccagcatcgcctacgtgtacagcctggtgatcctggtggtggccgtggccgagaaggccgagaggagccctgtgaccttctttgacaccccacccatgctgtttgtgttcatcgccctgggccgctggctggagcacctggccaagagcaagaccagcgaggccctggccaagctgatgagcctgcaggccacagaggccaccgtggtgaccctgggggaggacaacctgatcatccgggaggagcaggtgcccatggagctggtgcagagaggagacatcgtgaaggtggtgcctgggggcaagtttcctgtggatggcaaggtgctggagggcaacaccatggctgatgagagcctcatcactggagaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaaggcccccatccagcagctggccgaccgcttcagcggctactttgtgcccttcatcatcatcatgagcaccctgaccctggtggtgtggatcgtgattggcttcatcgactttggagtggtgcagcgctacttccccaaccccaacaagcacatcagccagacagaggtgatcatccgctttgccttccagaccagcatcaccgtgctgtgcatcgcctgcccctgcagcctgggcctggccacccccacagctgtgatggtgggcaccggggtggccgcccagaatggcatcctgatcaagggcggcaagcccctggagatggcccacaagatcaagacagtgatgtttgacaagacaggcaccatcacccatggagtgccccgggtgatgagggtgctgctgctgggagatgtggccaccctgcccctgaggaaggtgctggccgtggtgggcacagctgaggccagcagcgagcaccccctgggcgtggccgtgaccaagtactgcaaggaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaagctggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcactggagacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcactggaacagatgtggccattgaagctgctgatgtggtgctgatcagaaatgacctgctggatgtggtggccagcatccacctgagcaagaggacagtgcggcgcatccgcatcaacctggtgctggccctgatctacaacctggtgggcatccccatcgctgctggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3004 - DNA, 3108 bp, Artificial Sequence
  Description of Artificial Sequence: Synthetic coding sequence
atgcctgagcaggagcggcagatcacagcccgggagggcgccagcaggaagatcctgagcaagctgagcctgcccacccgggcctgggagcccgccatgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcaagagctgtgtgctgaacattgaagaaaatattggccagctgctgggcgtgcagagcatccaggtgtccctggagaacaagacagcccaggtgaagtatgaccccagctgcaccagccctgtggccctgcagagggccatcgaggccctgcccccaggcaacttcaaggtgtccctgcctgatggagctgagggcagcggcacagaccacaggagcagcagcagccacagccctggcagccccccaagaaaccaggtgcagggcacctgcagcaccaccctgattgccatcgccggcatgacctgtgccagctgtgtgcacagcattgagggcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctggagaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaaggcccccatccagcagctggccgaccgcttcagcggctactttgtgcccttcatcatcatcatgagcaccctgaccctggtggtgtggatcgtcatcggcttcatcgactttggagtggtgcagcgctacttccccaaccccaacaagcacatcagccagacagaggtgatcatccgctttgccttccagaccagcatcaccgtgctgtgcatcgcctgcccctgcagcctgggcctggccacccccacagctgtgatggtgggcactggagtggccgcccagaatggcatcctgatcaagggcggcaagcccctggagatggcccacaagatcaagacagtgatgtttgacaagacaggcaccatcacccacggcgtgccccgggtgatgagggtgctgctgctgggagatgtggccaccctgcccctgaggaaggtgctggccgtggtgggcacagctgaggccagcagcgagcaccccctgggcgtggccgtgaccaagtactgcaaggaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaggccggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcaccggggacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcaccggcacagatgtggccatcgaggccgcagatgtggtgctgatcagaaatgacctgctggatgtggtggccagcatccacctgagcaagaggacagtgcggcgcatccgcatcaacctggtgctggccctgatctacaacctggtgggcatccccatcgccgccggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3005 - DNA, 2031 bp, Artificial Sequence
  Description of Artificial Sequence: Synthetic coding sequence
atggatgtgctgattgtgctggccaccagcatcgcctacgtgtacagcctggtgatcctggtggtggccgtggccgagaaggccgagaggagccctgtgaccttctttgacaccccacccatgctgtttgtgttcatcgccctgggccgctggctggagcacctggccaagagcaagaccagcgaggccctggccaagctgatgagcctgcaggccacagaggccaccgtggtgaccctgggggaggacaacctgatcatccgggaggagcaggtgcccatggagctggtgcagagaggagacatcgtgaaggtggtgcctgggggcaagtttcctgtggatggcaaggtgctggagggcaacaccatggctgatgagagcctcatcaccggggaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaaggcccccatccagcagctggccgaccgcttcagcggctactttgtgcccttcatcatcatcatgagcaccctgaccctggtggtgtggatcgtcatcggcttcatcgactttggagtggtgcagcgctacttccccaaccccaacaagcacatcagccagacagaggtgatcatccgctttgccttccagaccagcatcaccgtgctgtgcatcgcctgcccctgcagcctgggcctggccacccccacagctgtgatggtgggcactggagtggccgcccagaatggcatcctgatcaagggcggcaagcccctggagatggcccacaaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaagctggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcactggagacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcactggaacagatgtggccattgaagctgctgatgtggtgctgatcagaaatgacctgctggatgtggtggccagcatccacctgagcaagaggacagtgcggcgcatccgcatcaacctggtgctggccctgatctacaacctggtgggcatccccatcgctgctggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3006 - DNA, 4203 bp, Artificial Sequence
  Description of Artificial Sequence: Synthetic coding sequence
atgcctgagcaggagcggcagatcacagcccgggagggcgccagcaggaagatcctgagcaagctgagcctgcccacccgggcctgggagcccgccatgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcaagagctgtgtgctgaacattgaagaaaatattggccagctgctgggcgtgcagagcatccaggtgtccctggagaacaagacagcccaggtgaagtatgaccccagctgcaccagccctgtggccctgcagagggccatcgaggccctgcccccaggcaacttcaaggtgtccctgcctgatggagctgagggcagcggcacagaccacaggagcagcagcagccacagccctggcagccccccaagaaaccaggtgcagggcacctgcagcaccaccctgattgccatcgccggcatgacctgtgccagctgtgtgcacagcattgagggcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctgagagctgcagcaccaaccccctgggcaaccacagcgctggcaacagcatggtgcagaccacagatggcacccccacctctgtgcaggaggtggccccccacacaggccgcctgcctgccaaccacgccccagacatcctggccaagagcccccagagcaccagggctgtggccccccagaagtgcttcctgcagatcaagggcatgacctgtgccagctgtgtgagcaacatcgagaggaacctgcagaaggaggccggcgtgctgtctgtgctggtggccctgatggccggcaaggccgagatcaagtatgaccctgaggtgatccagcccctggagatcgcccagttcatccaggacctgggctttgaagctgctgtgatggaggactatgccggcagtgatggcaacatcgagctgaccatcaccggcatgacctgtgccagctgtgtgcacaacatcgagagcaagctgaccaggaccaacggcatcacctacgcctctgtggccctggccaccagcaaggccctggtgaagtttgatcctgagatcatcggcccccgggacatcatcaagatcatcgaggagatcggcttccacgccagcctggcccagaggaaccccaatgcccaccacctggaccacaagatggagatcaagcagtggaagaagagcttcctgtgcagcctggtgtttggcatccctgtgatggccctgatgatctacatgctgatccccagcaatgagccccaccagagcatggtgctggaccacaacatcatccctggcctgagcatcctgaacctgatcttcttcatcctgtgcacctttgtgcagctgctgggcggctggtacttctacgtgcaggcctacaagagcctgcggcacaggtctgccaacatggatgtgctgattgtgctggccaccagcatcgcctacgtgtacagcctggtgatcctggtggtggccgtggccgagaaggccgagaggagccctgtgaccttctttgacaccccacccatgctgtttgtgttcatcgccctgggccgctggctggagcacctggccaagagcaagaccagcgaggccctggccaagctgatgagcctgcaggccacagaggccaccgtggtgaccctgggggaggacaacctgatcatccgggaggagcaggtgcccatggagctggtgcagagaggagacatcgtgaaggtggtgcctgggggcaagtttcctgtggatggcaaggtgctggagggcaacaccatggctgatgagagcctcatcaccggggaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaaggcccccatccagcagctggccgaccgcttcagcggctactttgtgcccttcatcatcatcatgagcaccctgaccctggtggtgtggatcgtcatcggcttcatcgactttggagtggtgcagcgctacttccccatcaagacagtgatgtttgacaagacaggcaccatcacccatggagtgccccgggtgatgagggtgctgctgctgggagatgtggccaccctgcccctgaggaaggtgctggccgtggtgggcacagctgaggccagcagcgagcaccccctgggcgtggccgtgaccaagtactgcaaggaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaagctggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcactggagacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcactggaacagatgtggccattgaagctgctgatgtggtgctgatcagaaatgacctgctggatgtggtggccagcatccacctgagcaagaggacagtgcggcgcatccgcatcaacctggtgctggccctgatctacaacctggtgggcatccccatcgctgctggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3007 - DNA, 4164 bp, Artificial Sequence
  Description of Artificial Sequence: Synthetic coding sequence
atgcctgagcaggagcggcagatcacagcccgggagggcgccagcaggaagatcctgagcaagctgagcctgcccacccgggcctgggagcccgccatgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcaagagctgtgtgctgaacattgaagaaaatattggccagctgctgggcgtgcagagcatccaggtgtccctggagaacaagacagcccaggtgaagtatgaccccagctgcaccagccctgtggccctgcagagggccatcgaggccctgcccccaggcaacttcaaggtgtccctgcctgatggagctgagggcagcggcacagaccacaggagcagcagcagccacagccctggcagccccccaagaaaccaggtgcagggcacctgcagcaccaccctgattgccatcgccggcatgacctgtgccagctgtgtgcacagcattgagggcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctgagagctgcagcaccaaccccctgggcaaccacagcgctggcaacagcatggtgcagaccacagatggcacccccacctctgtgcaggaggtggccccccacacaggccgcctgcctgccaaccacgccccagacatcctggccaagagcccccagagcaccagggctgtggccccccagaagtgcttcctgcagatcaagggcatgacctgtgccagctgtgtgagcaacatcgagaggaacctgcagaaggaggccggcgtgctgtctgtgctggtggccctgatggccggcaaggccgagatcaagtatgaccctgaggtgatccagcccctggagatcgcccagttcatccaggacctgggctttgaagctgctgtgatggaggactatgccggcagtgatggcaacatcgagctgaccatcaccggcatgacctgtgccagctgtgtgcacaacatcgagagcaagctgaccaggaccaacggcatcacctacgcctctgtggccctggccaccagcaaggccctggtgaagtttgatcctgagatcatcggcccccgggacatcatcaagatcatcgaggagatcggcttccacgccagcctggcccagaggaaccccaatgcccaccacctggaccacaagatggagatcaagcagtggaagaagagcttcctgtgcagcctggtgtttggcatccctgtgatggccctgatgatctacatgctgatccccagcaatgagccccaccagagcatggtgctggaccacaacatcatccctggcctgagcatcctgaacctgatcttcttcatcctgtgcacctttgtgcagagcaagaccagcgaggccctggccaagctgatgagcctgcaggccacagaggccaccgtggtgaccctgggggaggacaacctgatcatccgggaggagcaggtgcccatggagctggtgcagagaggagacatcgtgaaggtggtgcctgggggcaagtttcctgtggatggcaaggtgctggagggcaacaccatggctgatgagagcctcatcaccggggaggccatgcctgtgaccaagaagccaggcagcacagtgattgctggcagcatcaatgcccacggctctgtgctgatcaaggccacccacgtgggcaatgacaccaccctggcccagatcgtgaagctggtggaggaggcccagatgagcaaggcccccatccagcagctggccgaccgcttcagcggctactttgtgcccttcatcatcatcatgagcaccctgaccctggtggtgtggatcgtcatcggcttcatcgactttggagtggtgcagcgctacttccccaaccccaacaagcacatcagccagacagaggtgatcatccgctttgccttccagaccagcatcaccgtgctgtgcatcgcctgcccctgcagcctgggcctggccacccccacagctgtgatggtgggcactggagtggccgcccagaatggcatcctgatcaagggcggcaagcccctggagatggcccacaagatcaagacagtgatgtttgacaagacaggcaccatcacccacggcgtgccccgggtgatgagggtgctgctgctgggagatgtggccaccctgcccctgaggaaggtgctggccgtggtgggcacagctgaggccagcagcgagcaccccctgggcgtggccgtgaccaagtactgcaaggaggagctgggcacagagaccctgggctactgcacagacttccaggccgtgcccggctgcggcatcggctgcaaggtgtccaatgtggagggcatcctggcccacagcgagcggcccctgagcgccccagccagccacctgaatgaggccggcagcctgcctgctgagaaggatgctgtgccccagaccttctctgtgctgattggcaaccgggagtggctgcggagaaatggcctgaccatcagcagtgatgtgtctgatgccatgacagaccacgagatgaagggccagacagccatcctggtggccattgatggagtgctgtgtggcatgattgccatcgcagatgctgtgaagcaggaggccgccctggccgtgcacaccctgcagagcatgggcgtggatgtggtgctgatcaccggggacaacaggaagacagcccgggccatcgccacccaggtgggcatcaacaaggtgtttgctgaggtgctgcccagccacaaggtggccaaggtgcaggagctgcagaacaagggcaagaaggtggccatggtgggagatggagtgaatgacagccctgccctggcccaggccgacatgggcgtggccatcggcaccggcacagatgtggccatcgaggccgcagatgtggtgctgatcagaaatgacctgctggatgtggtggccagcatccacctgagcaagaggacagtgcggcgcatccgcatcaacctggtgctggccctgatctacaacctggtgggcatccccatcgccgccggggtcttcatgcccatcggcatcgtgctgcagccctggatgggcagcgctgccatggccgccagctctgtgtctgtggtgctgagcagcctgcagctgaagtgctacaagaagccagacctggagagatatgaggcccaggcccacggccacatgaagcccctgacagccagccaggtgtctgtgcacatcggcatggatgaccgctggagggacagcccccgggccaccccctgggaccaggtgtcctatgtgtcccaggtgtccctgagcagcctgaccagtgacaagcccagccgccacagcgctgctgctgatgatgatggagacaagtggagcctgctgctgaatggaagagatgaggagcagtacatctag

SEQ ID NO: 3008 - DNA, 1587 bp, Artificial Sequence
  Description of Artificial Sequence: Synthetic coding sequence
atgaagaagagctttgcctttgacaacgtgggctatgagggcggcctggatggcctgggccccagcagccaggtggccaccagcacagtgcgcatcctgggcatgacctgccagagctgtgtgaagagcattgaagatcgcatcagcaacctgaagggcatcatctccatgaaggtgtccctggagcagggcagcgccaccgtgaagtatgtgcccagcgtggtgtgcctgcagcaggtgtgccaccagatcggggacatgggctttgaggccagcattgctgagggcaaggccgcctcctggcccagccgcagcctgcctgcccaggaggccgtggtgaagctgcgggtggagggcatgacctgccagagctgtgtgagcagcattgagggcaaggtgaggaagctgcagggcgtggtgcgggtgaaggtgtccctgagcaaccaggaggccgtcatcacctaccagccctacctgatccagcctgaggacctgcgggaccacgtgaatgacatgggctttgaggccgccatcaagagcaaggtggcccccctgagcctgggccccatcgacatcgagcggctgcagagcaccaaccccaagaggcccctgagcagcgccaaccagaacttcaacaacagcgagaccctgggccaccagggcagccacgtggtgaccctgcagctgagaattgatggcatgcactgcaagagctgtgtgctgaacattgaagaaaatattggccagctgctgggcgtgcagagcatccaggtgtccctggagaacaagacagcccaggtgaagtatgaccccagctgcaccagccctgtggccctgcagagggccatcgaggccctgcccccaggcaacttcaaggtgtccctgcctgatggagctgagggcagcggcacagaccacaggagcagcagcagccacagccctggcagccccccaagaaaccaggtgcagggcacctgcagcaccaccctgattgccatcgccggcatgacctgtgccagctgtgtgcacagcattgagggcatgatcagccagctggagggcgtgcagcagatctctgtgtccctggccgagggcacagccaccgtgctgtacaaccccagcgtcatcagccctgaggagctgcgggccgccatcgaggacatgggctttgaggcctctgtggtgtctgagagctgcagcaccaaccccctgggcaaccacagcgctggcaacagcatggtgcagaccacagatggcacccccacctctgtgcaggaggtggccccccacacaggccgcctgcctgccaaccacgccccagacatcctggccaagagcccccagagcaccagggctgtggccccccagaagtgcttcctgcagatcaagggcatgacctgtgccagctgtgtgagcaacatcgagaggaacctgcagaaggaggccgccccccgctgggtggtgctgctgcggagcggcctgcagatcagcgagacccaggtgtcccagcacggccgggcccaccggcccggccacaagcactgcctgtgcctcttcagcggccaccctgggggctgctgcggctag

SEQ ID NO: 3009 - DNA, 3966 bp, Artificial Sequence
  Description of Artificial Sequence: Synthetic coding sequence
atgtctgacagcgtcatcctgcggagcatcaagaagtttggagaggagaatgatggctttgaaagtgacaagagctacaacaatgacaagaagagccggctgcaggatgagaagaagggagatggagtgcgggtgggcttcttccagctgttccgcttcagcagcagcacagacatctggctgatgtttgtgggcagcctgtgtgccttcctgcacggcatcgcccagcccggggtgctgctgatcttcggcaccatgacagatgtgttcattgattatgatgtggagctgcaggagctgcagatccctgggaaggcctgtgtgaacaacaccatcgtgtggaccaacagcagcctgaaccagaacatgaccaacggcacccgctgtggcctgctgaacatcgagagcgagatgatcaagtttgccagctactatgccggcattgctgtggccgtgctgatcaccggctacatccagatctgcttctgggtgattgctgctgcccggcagatccagaagatgaggaagttctacttccgccgcatcatgaggatggagatcggctggtttgactgcaacagcgtgggggagctgaacacccgcttcagtgatgacatcaacaagatcaatgatgccatcgctgaccagatggccctcttcatccagaggatgaccagcaccatctgtggcttcctgctgggcttcttccggggctggaagctgaccctggtgatcatctctgtgagccccctcatcggcatcggggccgccaccatcggcctgtctgtgtccaagttcacagattatgagctgaaggcctatgccaaggccggcgtggtggctgatgaggtgatcagctccatgaggacagtggccgccttcggcggggagaagcgggaggtggagagatatgagaagaacctggtgtttgcccagcgctggggcatcaggaagggcatcgtgatgggcttcttcaccggctttgtgtggtgcctgatcttcctgtgctacgccctggccttctggtacggcagcaccctggtgctggatgaaggagagtacaccccaggcaccctggtgcagatcttcctgtctgtgattgtgggcgccctgaacctgggcaatgccagcccctgcctggaggcctttgccaccggccgggctgctgccaccagcatctttgagaccatcgacaggaagcccatcatcgactgcatgtctgaagatggctacaagctggaccgcatcaagggggagattgagttccacaacgtgaccttccactaccccagcaggcctgaggtgaagatcctgaatgacctgaacatggtgatcaagccaggagagatgacagccctggtgggccccagcggggccggcaagagcacagccctgcagctgatccagcgcttctatgacccctgtgagggcatggtgacagtggatggccatgacatccgcagcctgaacatccagtggctgcgggaccagatcggcatcgtggagcaggagcctgtgctcttcagcaccaccatcgccgagaacatccgctatggaagagaagatgccaccatggaggacatcgtgcaggccgccaaggaggccaatgcctacaacttcatcatggacctgccccagcagtttgacaccctggtgggggagggcggcggccagatgtctgggggccagaagcagagggtggccatcgcccgggccctgatccggaaccccaagatcctgctgctggacatggccaccagcgccctggacaatgaaagtgaggccatggtgcaggaggtgctgagcaagatccagcacggccacaccatcatctctgtggcccaccggctgagcacagtgcgggctgctgacaccatcattggatttgaacatggaacagctgtggagcggggcacccatgaggagctgctggagaggaaaggagtgtacttcaccctggtgaccctgcagagccagggcaaccaggccctgaatgaggaggacatcaaggatgccacagaagatgacatgctggcccggaccttcagccggggcagctaccaggacagcctgcgggccagcatccggcagaggagcaagagccagctgagctacctggtgcatgagccccccctggccgtggtggaccacaagagcacctatgaggaggacaggaaggacaaggacatccctgtgcaggaggaggtggagcccgcccctgtgcggcgcatcctgaagttcagcgcccctgagtggccctacatgctggtgggctctgtgggcgctgctgtgaatggaacagtgacccccctgtatgccttcctgttcagccagatcctgggcaccttcagcatcccagacaaggaggagcagaggagccagatcaacggggtgtgcctgctgtttgtggccatgggctgtgtgtccctcttcacccagttcctgcagggctacgcctttgccaagtctggagagctgctgaccaagaggctgaggaagtttggcttccgggccatgctgggccaggacatcgcctggtttgatgacctgaggaacagccctggggccctgaccacccggctggccacagatgccagccaggtgcagggcgccgccggcagccagatcggcatgattgtgaacagcttcaccaacgtgacagtggccatgatcatcgccttctccttctcctggaagctgagcctggtgatcctgtgcttcttccccttcctggccctgagcggggccacccagaccaggatgctgactggatttgccagccgggacaagcaggccctggagatggtgggccagatcaccaatgaggccctgagcaacatcagaacagtggccggcatcggcaaggagcggcgcttcatcgaggccctggagacagagctggagaagcccttcaagacagccatccagaaggccaacatctacggcttctgctttgcctttgcccagtgcatcatgttcatcgccaacagcgccagctaccgctatggaggctacctgatcagcaatgaaggcctgcacttctcctatgtgttccgggtcatctctgctgtggtgctgagcgccacagccctgggccgggccttctcctacacccccagctatgccaaggccaagatctctgctgcccgcttcttccagctgctggaccggcagccccccatctctgtgtacaacacagctggggagaagtgggacaacttccagggcaagattgactttgtggactgcaagttcacctaccccagcaggccagacagccaggtgctgaatggcctgtctgtgtccatcagccctggccagaccctggcctttgtgggcagcagcggctgcggcaagagcaccagcatccagctgctggagcgcttctatgaccctgaccagggcaaggtgatgattgatggccatgacagcaagaaggtgaatgtgcagttcctgcggagcaacatcggcatcgtgtcccaggagcctgtgctgtttgcctgcagcatcatggacaacatcaagtacggggacaacaccaaggagatccccatggagcgggtgattgctgctgccaagcaggcccagctgcatgactttgtgatgagcctgcctgagaagtatgagaccaacgtgggcagccagggcagccagctgagcagaggagagaagcagagaattgccatcgcccgggccatcgtgcgggaccccaagatcctgctgctggatgaggccaccagcgccctggacacagaaagtgagaagacagtgcaggtggccctggacaaggcccgggagggccgcacctgcatcgtgattgcccaccggctgagcaccatccagaatgctgacatcatcgctgtgatggcccagggcgtggtgattgagaagggcacccatgaggagctgatggcccagaagggggcctactacaagctggtgaccaccggcagccccatctcctag

SEQ ID NO: 3010 - DNA, 3861 bp, Artificial Sequence
  Description of Artificial Sequence: Synthetic coding sequence
atggacctggaggccgccaagaatggaacagcctggaggcccaccagcgctgagggggactttgagctgggcatcagcagcaagcagaagaggaagaagaccaagacagtgaagatgattggagtgctgaccctcttccgctacagcgactggcaggacaagctgttcatgagcctgggcaccatcatggccatcgcccacggcagcggcctgcccctgatgatgattgtgtttggagagatgacagacaagtttgtggacacagctggcaacttctccttccctgtgaacttcagcctgagcctgctgaaccctgggaagatcctggaggaggagatgaccaggtatgcctactactacagcggcctgggcgccggcgtgctggtggccgcctacatccaggtgtccttctggaccctggccgccggccggcagatcaggaagatccggcagaagttcttccacgccatcctgcggcaggagatcggctggtttgacatcaatgacaccacagagctgaacacccggctgacagatgacatcagcaagatcagcgagggcatcggggacaaggtgggcatgttcttccaggccgtggccaccttctttgctggcttcatcgtgggcttcatccggggctggaagctgaccctggtgatcatggccatcagccccatcctgggcctgtctgctgctgtgtgggccaagatcctgagcgccttcagtgacaaggagctggccgcctatgccaaggccggggctgtggccgaggaggccctgggcgccatcagaacagtgattgcctttggaggccagaacaaggagctggagcgctaccagaagcacctggagaatgccaaggagatcggcatcaagaaggccatcagcgccaacatctccatgggcatcgccttcctgctgatctatgccagctatgccctggccttctggtacggcagcaccctggtgatcagcaaggagtacaccatcggaaatgccatgacagtgttcttcagcatcctgattggagccttctctgtgggccaggccgccccctgcattgatgcctttgccaatgcccggggagctgcctacgtgatctttgacatcatcgacaacaaccccaagattgacagcttcagcgagcggggccacaagccagacagcatcaagggcaacctggagttcaatgatgtgcacttctcctaccccagccgggccaacgtgaagatcctgaagggcctgaacctgaaggtgcagagcggccagacagtggccctggtgggcagcagcggctgcggcaagagcaccaccgtgcagctgatccagaggctgtatgaccctgatgagggcaccatcaacattgatggccaggacatccggaacttcaacgtgaactacctgcgggagatcatcggcgtggtgtcccaggagcctgtgctcttcagcaccaccatcgccgagaacatctgctacggcagaggaaatgtgaccatggatgagatcaagaaggctgtgaaggaggccaatgcctatgagttcatcatgaagctgccccagaagtttgacaccctggtgggggagcggggggcccagctgagcggcggccagaagcagagaattgccatcgcccgggccctggtgaggaaccccaagatcctgctgctggatgaggccaccagcgccctggacacagaaagtgaagctgaggtgcaggccgccctggacaaggcccgggagggccgcaccaccatcgtgattgcccaccggctgagcacagtgagaaatgctgatgtgattgctggctttgaagatggagtcatcgtggagcagggcagccacagcgagctgatgaagaaggagggcgtgtacttcaagctggtgaacatgcagaccagcggcagccagatccagagcgaggagtttgagctgaatgatgagaaggccgccaccaggatggcccccaacggctggaagagccgcctcttccgccacagcacccagaagaacctgaagaacagccagatgtgccagaagagcctggatgtggagacagatggcctggaggccaacgtgccccctgtgtccttcctgaaggtgctgaagctgaacaagacagagtggccctactttgtggtgggcaccgtgtgtgccatcgccaatggaggcctgcagcctgccttcagcgtcatcttcagcgagatcatcgccatctttggacctggagatgatgctgtgaagcagcagaagtgcaacatcttcagcctcatcttcctgttcctgggcatcatctccttcttcaccttcttcctgcagggcttcaccttcggcaaggccggggagatcctgacccggcggctgcgctccatggccttcaaggccatgctgcggcaggacatgtcctggtttgatgaccacaagaacagcactggagccctgagcacccggctggccacagatgctgcccaggtgcagggcgccaccggcacccggctggccctgattgcccagaacatcgccaacctgggcaccggcatcatcatctccttcatctacggctggcagctgaccctgctgctgctggccgtggtgcccatcatcgctgtgtctggcatcgtggagatgaagctgctggccggaaatgccaagagggacaagaaggagctggaggccgccggcaagatcgccacagaggccatcgagaacatcagaacagtggtgtccctgacccaggagaggaagtttgagagcatgtatgtggagaagctgtatggcccctacagaaacagcgtgcagaaggcccacatctacggcatcaccttcagcatcagccaggccttcatgtacttctcctatgccggctgcttccgctttggagcctacctgattgtgaatggccacatgaggttcagagatgtgatcctggtgttcagcgccatcgtgtttggagctgtggccctgggccacgccagcagctttgccccagactatgccaaggccaagctgtctgctgcccacctgttcatgctgtttgagcggcagcccctgattgacagctacagcgaggagggcctgaagccagacaagtttgagggcaacatcaccttcaatgaggtggtgttcaactaccccacccgggccaacgtgcctgtgctgcagggcctgagcctggaggtgaagaagggccagaccctggccctggtgggcagcagcggctgcggcaagagcacagtggtgcagctgctggagcgcttctatgaccccctggccggcaccgtgtttgtggactttggcttccagctgctggatggccaggaggccaagaagctgaatgtgcagtggctgcgggcccagctgggcatcgtgtcccaggagcccatcctgtttgactgcagcattgctgaaaatattgcctatggagacaacagccgggtggtgtcccaggatgaaattgtgtctgctgccaaggccgccaacatccaccccttcatcgagaccctgccccacaagtatgagaccagggtgggggacaagggcacccagctgagcggcggccagaagcagagaattgccatcgcccgggccctgatccggcagccccagatcctgctgctggatgaggccaccagcgccctggacacagagagcgagaaggtggtgcaggaggccctggacaaggcccgggagggccgcacctgcatcgtcatcgcccaccggctgagcaccatccagaatgctgacctgattgtggtgttccagaatggccgggtgaaggagcacggcacccaccagcagctgctggcccagaagggcatctacttctccatggtgtctgtgcaggccggcacccagaacctgtag

SEQ ID NO: 3011 - DNA, 3699 bp, Artificial Sequence
  Description of Artificial Sequence: Synthetic coding sequence
atggacctggaggccgccaagaatggaacagcctggaggcccaccagcgctgagggggactttgagctgggcatcagcagcaagcagaagaggaagaagaccaagacagtgaagatgattggagtgctgaccctcttccgctacagcgactggcaggacaagctgttcatgagcctgggcaccatcatggccatcgcccacggcagcggcctgcccctgatgatgattgtgtttggagagatgacagacaagtttgtggacacagctggcaacttctccttccctgtgaacttcagcctgagcctgctgaaccctgggaagatcctggaggaggagatgaccaggtatgcctactactacagcggcctgggcgccggcgtgctggtggccgcctacatccaggtgtccttctggaccctggccgccggccggcagatcaggaagatccggcagaagttcttccacgccatcctgcggcaggagatcggctggtttgacatcaatgacaccacagagctgaacacccggctgacagatgacatcagcaagatcagcgagggcatcggggacaaggtgggcatgttcttccaggccgtggccaccttctttgctggcttcatcgtgggcttcatccggggctggaagctgaccctggtgatcatggccatcagccccatcctgggcctgtctgctgctgtgtgggccaagatcctgagcgccttcagtgacaaggagctggccgcctatgccaaggccggggctgtggccgaggaggccctgggcgccatcagaacagtgattgcctttggaggccagaacaaggagctggagcgctaccagaagcacctggagaatgccaaggagatcggcatcaagaaggccatcagcgccaacatctccatgggcatcgccttcctgctgatctatgccagctatgccctggccttctggtacggcagcaccctggtgatcagcaaggagtacaccatcggaaatgccatgacagtgttcttcagcatcctgattggagccttctctgtgggccaggccgccccctgcattgatgcctttgccaatgcccggggagctgcctacgtgatctttgacatcatcgacaacaaccccaagattgacagcttcagcgagcggggccacaagccagacagcatcaagggcaacctggagttcaatgatgtgcacttctcctaccccagccgggccaacgtgaagatcctgaagggcctgaacctgaaggtgcagagcggccagacagtggccctggtgggcagcagcggctgcggcaagagcaccaccgtgcagctgatccagaggctgtatgaccctgatgagggcaccatcaacattgatggccaggacatccggaacttcaacgtgaactacctgcgggagatcatcggcgtggtgtcccaggagcctgtgctcttcagcaccaccatcgccgagaacatctgctacggcagaggaaatgtgaccatggatgagatcaagaaggctgtgaaggaggccaatgcctatgagttcatcatgaagctgccccagaagtttgacaccctggtgggggagcggggggcccagctgagcggcggccagaagcagagaattgccatcgcccgggccctggtgaggaaccccaagatcctgctgctggatgaggccaccagcgccctggacacagaaagtgaagctgaggtgcaggccgccctggacaaggcccgggagggccgcaccaccatcgtgattgcccaccggctgagcacagtgagaaatgctgatgtgattgctggctttgaagatggagtcatcgtggagcagggcagccacagcgagctgatgaagaaggagggcgtgtacttcaagctggtgaacatgcagaccagcggcagccagatccagagcgaggagtttgagctgaatgatgagaaggccgccaccaggatggcccccaacggctggaagagccgcctcttccgccacagcacccagaagaacctgaagaacagccagatgtgccagaagagcctggatgtggagacagatggcctggaggccaacgtgccccctgtgtccttcctgaaggtgctgaagctgaacaagacagagtggccctactttgtggtgggcaccgtgtgtgccatcgccaatggaggcctgcagcctgccttcagcgtcatcttcagcgagatcatcgccatctttggacctggagatgatgctgtgaagcagcagaagtgcaacatcttcagcctcatcttcctgttcctgggcatcatctccttcttcaccttcttcctgcagggcttcaccttcggcaaggccggggagatcctgacccggcggctgcgctccatggccttcaaggccatgctgcggcaggacatgtcctggtttgatgaccacaagaacagcactggagccctgagcacccggctggccacagatgctgcccaggtgcagggcgccaccggcacccggctggccctgattgcccagaacatcgccaacctgggcaccggcatcatcatctccttcatctacggctggcagctgaccctgctgctgctggccgtggtgcccatcatcgctgtgtctggcatcgtggagatgaagctgctggccggaaatgccaagagggacaagaaggagctggaggccgccggcaagatcgccacagaggccatcgagaacatcagaacagtggtgtccctgacccaggagaggaagtttgagagcatgtatgtggagaagctgtatggcccctacagagtcttcagcgccatcgtgtttggagctgtggccctgggccacgccagcagctttgccccagactatgccaaggccaagctgtctgctgcccacctgttcatgctgtttgagcggcagcccctgattgacagctacagcgaggagggcctgaagccagacaagtttgagggcaacatcaccttcaatgaggtggtgttcaactaccccacccgggccaacgtgcctgtgctgcagggcctgagcctggaggtgaagaagggccagaccctggccctggtgggcagcagcggctgtgggaagagcacagtggtgcagctgctggagcgcttctatgaccccctggccggcaccgtgctgctggatggccaggaggccaagaagctgaatgtgcagtggctgcgggcccagctgggcatcgtgtcccaggagcccatcctgtttgactgcagcattgctgaaaatattgcctatggagacaacagccgggtggtgtcccaggatgaaattgtgtctgctgccaaggccgccaacatccaccccttcatcgagaccctgccccacaagtatgagaccagggtgggggacaagggcacccagctgagcggcggccagaagcagagaattgccatcgcccgggccctgatccggcagccccagatcctgctgctggatgaggccaccagcgccctggacacagagagcgagaaggtggtgcaggaggccctggacaaggcccgggagggccgcacctgcatcgtcatcgcccaccggctgagcaccatccagaatgctgacctgattgtggtgttccagaatggccgggtgaaggagcacggcacccaccagcagctgctggcccagaagggcatctacttctccatggtgtctgtgcaggccggcacccagaacctgtag

SEQ ID NO: 3012 - DNA, 3840 bp, Artificial Sequence
  Description of Artificial Sequence: Synthetic coding sequence
atggacctggaggccgccaagaatggaacagcctggaggcccaccagcgctgagggggactttgagctgggcatcagcagcaagcagaagaggaagaagaccaagacagtgaagatgattggagtgctgaccctcttccgctacagcgactggcaggacaagctgttcatgagcctgggcaccatcatggccatcgcccacggcagcggcctgcccctgatgatgattgtgtttggagagatgacagacaagtttgtggacacagctggcaacttctccttccctgtgaacttcagcctgagcctgctgaaccctgggaagatcctggaggaggagatgaccaggtatgcctactactacagcggcctgggcgccggcgtgctggtggccgcctacatccaggtgtccttctggaccctggccgccggccggcagatcaggaagatccggcagaagttcttccacgccatcctgcggcaggagatcggctggtttgacatcaatgacaccacagagctgaacacccggctgacagatgacatcagcaagatcagcgagggcatcggggacaaggtgggcatgttcttccaggccgtggccaccttctttgctggcttcatcgtgggcttcatccggggctggaagctgaccctggtgatcatggccatcagccccatcctgggcctgtctgctgctgtgtgggccaagatcctgagcgccttcagtgacaaggagctggccgcctatgccaaggccggggctgtggccgaggaggccctgggcgccatcagaacagtgattgcctttggaggccagaacaaggagctggagcgctaccagaagcacctggagaatgccaaggagatcggcatcaagaaggccatcagcgccaacatctccatgggcatcgccttcctgctgatctatgccagctatgccctggccttctggtacggcagcaccctggtgatcagcaaggagtacaccatcggaaatgccatgacagtgttcttcagcatcctgattggagccttctctgtgggccaggccgccccctgcattgatgcctttgccaatgcccggggagctgcctacgtgatctttgacatcatcgacaacaaccccaagattgacagcttcagcgagcggggccacaagccagacagcatcaagggcaacctggagttcaatgatgtgcacttctcctaccccagccgggccaacgtgaagatcctgaagggcctgaacctgaaggtgcagagcggccagacagtggccctggtgggcagcagcggctgcggcaagagcaccaccgtgcagctgatccagaggctgtatgaccctgatgagggcaccatcaacattgatggccaggacatccggaacttcaacgtgaactacctgcgggagatcatcggcgtggtgtcccaggagcctgtgctcttcagcaccaccatcgccgagaacatctgctacggcagaggaaatgtgaccatggatgagatcaagaaggctgtgaaggaggccaatgcctatgagttcatcatgaagctgccccagaagtttgacaccctggtgggggagcggggggcccagctgagcggcggccagaagcagagaattgccatcgcccgggccctggtgaggaaccccaagatcctgctgctggatgaggccaccagcgccctggacacagaaagtgaagctgaggtgcaggccgccctggacaaggcccgggagggccgcaccaccatcgtgattgcccaccggctgagcacagtgagaaatgctgatgtgattgctggctttgaagatggagtcatcgtggagcagggcagccacagcgagctgatgaagaaggagggcgtgtacttcaagctggtgaacatgcagaccagcggcagccagatccagagcgaggagtttgagctgaatgatgagaaggccgccaccaggatggcccccaacggctggaagagccgcctcttccgccacagcacccagaagaacctgaagaacagccagatgtgccagaagagcctggatgtggagacagatggcctggaggccaacgtgccccctgtgtccttcctgaaggtgctgaagctgaacaagacagagtggccctactttgtggtgggcaccgtgtgtgccatcgccaatggaggcctgcagcctgccttcagcgtcatcttcagcgagatcatcgccatctttggacctggagatgatgctgtgaagcagcagaagtgcaacatcttcagcctcatcttcctgttcctgggcatcatctccttcttcaccttcttcctgcagggcttcaccttcggcaaggccggggagatcctgacccggcggctgcgctccatggccttcaaggccatgctgcggcaggacatgtcctggtttgatgaccacaagaacagcactggagccctgagcacccggctggccacagatgctgcccaggtgcagggcgccaccggcacccggctggccctgattgcccagaacatcgccaacctgggcaccggcatcatcatctccttcatctacggctggcagctgaccctgctgctgctggccgtggtgcccatcatcgctgtgtctggcatcgtggagatgaagctgctggccggaaatgccaagagggacaagaaggagctggaggccgccggcaagatcgccacagaggccatcgagaacatcagaacagtggtgtccctgacccaggagaggaagtttgagagcatgtatgtggagaagctgtatggcccctacagaaacagcgtgcagaaggcccacatctacggcatcaccttcagcatcagccaggccttcatgtacttctcctatgccggctgcttccgctttggagcctacctgattgtgaatggccacatgaggttcagagatgtgatcctggtgttcagcgccatcgtgtttggagctgtggccctgggccacgccagcagctttgccccagactatgccaaggccaagctgtctgctgcccacctgttcatgctgtttgagcggcagcccctgattgacagctacagcgaggagggcctgaagccagacaagtttgagggcaacatcaccttcaatgaggtggtgttcaactaccccacccgggccaacgtgcctgtgctgcagggcctgagcctggaggtgaagaagggccagaccctggccctggtgggcagcagcggctgcggcaagagcacagtggtgcagctgctggagcgcttctatgaccccctggccggcaccgtgctgctggatggccaggaggccaagaagctgaatgtgcagtggctgcgggcccagctgggcatcgtgtcccaggagcccatcctgtttgactgcagcattgctgagaacatcgcctacggggacaacagccgggtggtgtcccaggatgagatcgtgtctgctgccaaggccgccaacatccaccccttcatcgagaccctgccccacaagtatgagaccagggtgggggacaagggcacccagctgagcggcggccagaagcagagaattgccatcgcccgggccctgatccggcagccccagatcctgctgctggatgaggccaccagcgccctggacacagaaagtgagaaggtggtgcaggaggccctggacaaggcccgggagggccgcacctgcatcgtgattgcccaccggctgagcaccatccagaatgctgacctgattgtggtgttccagaatggccgggtgaaggagcacggcacccaccagcagctgctggcccagaagggcatctacttctccatggtgtctgtgcaggccggcacccagaacctgtag

SEQ ID NO: 3013 - DNA, 186 bp, Artificial Sequence
  Description of Artificial Sequence: Synthetic coding sequence
atggacctggaggccgccaagaatggaacagcctggaggcccaccagcgctgagggggactttgagctgggcatcagcagcaagcagaagaggaagaagaccaagacagtgaagatgattggagtgctgaccctcttccgctacagcgactggcaggacaagctgttcatgagcctgggcacctag

SEQ ID NO: 3014 - DNA, 3699 bp, Artificial Sequence; identical to SEQ ID NO: 3011
  Description of Artificial Sequence: Synthetic coding sequence

SEQ ID NO: 3015 - DNA, 3840 bp, Artificial Sequence; identical to SEQ ID NO: 3012
  Description of Artificial Sequence: Synthetic coding sequence

SEQ ID NO: 3016 - DNA, 1464 bp, Artificial Sequence
  Description of Artificial Sequence: Synthetic coding sequence
atgagggagaacatggcccggggcccctgcaatgccccccgctgggccagcctgatggtgctggtggccatcggcacagctgtgacagctgctgtgaaccctggggtggtggtgcgcatcagccagaagggcctggactatgccagccagcagggcacagctgccctgcagaaggagctgaagaggatcaagatcccagactacagcgacagcttcaagatcaagcacctgggcaagggccactacagcttctacagcatggacatccgggagttccagctgcccagcagccagatctccatggtgcccaacgtgggcctgaagttcagcatcagcaatgccaacatcaagatcagcggcaagtggaaggcccagaagcgcttcctgaagatgagcggcaactttgacctgagcattgagggcatgagcatctctgctgacctgaagctgggcagcaaccccaccagcggcaagcccaccatcacctgcagcagctgcagcagccacatcaacagcgtgcacgtgcacatcagcaagagcaaggtgggctggctgatccagctgttccacaagaagattgaaagtgccctgaggaacaagatgaacagccaggtgtgtgagaaggtgaccaacagcgtgtcctctgagctgcagccctacttccagaccctgcctgtgatgaccaagattgacagcgtggccggcatcaactacggcctggtggcccccccagccaccacagctgagaccctggatgtgcagatgaagggggagttctacagcgagaaccaccacaaccccccaccatttgcccctcctgtgatggagttccctgctgcccatgacaggatggtgtacctgggcctgagtgactacttcttcaacacagctggcctggtgtaccaggaggccggcgtgctgaagatgaccctgagagatgacatgatccccaaggagagcaagttccggctgaccaccaagttcttcggcaccttcctgcctgaggtggccaagaagttccccaacatgaagatccagatccacgtgtctgccagcaccccaccccacctgtctgtgcagcccaccggcctgaccttctacccagctgtggatgtgcaggcctttgctgtgctgcccaacagcagcctggccagcctcttcctgattggcatgcacaccaccggctccatggaggtgtctgctgagagcaaccggctggtgggggagctgaagctggaccggctgctgctggagctgaagcacagcaacatcggccccttccctgtggagctgctgcaggacatcatgaactacatcgtgcccatcctggtgctgccccgggtgaatgagaagctgcagaagggcttccccctgcccaccccagcccgggtgcagctgtacaacgtggtgctgcagccccaccagaacttcctgctgtttggagcagatgtggtgtacaagtag

SEQ ID NO: 3017 - DNA, 1449 bp, Artificial Sequence
  Description of Artificial Sequence: Synthetic coding sequence
atggatgagggcatcccccacctgcaggagcggcagctgctggagcaccgggacttcatcggcctggactacagcagcctgtacatgtgcaagcccaagaggtccatgaagagagatgacaccaaggacacctacaagctgccccacaggctcatcgagaagaagaggcgggaccgcatcaatgaatgcatcgcccagctgaaggacctgctgcctgagcacctgaagctgaccaccctgggccacctggagaaggctgtggtgctggagctgaccctgaagcacctgaaggccctgacagccctgacagagcagcagcaccagaagatcatcgccctgcagaatggagagaggagcctgaagagccccatccagagcgacctggatgccttccacagcggcttccagacctgtgccaaggaggtgctgcagtacctgagcagatttgagagctggaccccccgggagccccgctgtgtgcagctgatcaaccacctgcatgctgtggccacccagttcctgcccaccccccagctgctgacccagcaggtgcccctgagcaagggcaccggggcccccagcgctgctggcagcgctgctgccccctgcctggagagagctggccagaagctggagcccctggcctactgtgtgcctgtgatccagaggacccagcccagcgctgagctggccgcagaaaatgacacagacacagacagcggctacggcggggaggccgaggcccggccagaccgggagaagggcaagggggccggggccagccgggtgaccatcaagcaggagcccccaggagaggacagccctgcccccaagaggatgaagctggacagccggggcggcggcagcggcggcggccctgggggcggcgctgctgctgctgctgctgccctgctgggccctgaccctgctgctgctgctgccctgctgcggccagatgctgccctgctgagcagcctggtggcctttggaggcggcggcggggcccccttcccccagcctgctgctgctgctgcccccttctgcctgcccttctgcttcctgagccccagcgctgctgctgcctacgtgcagcccttcctggacaagagcggcctggagaagtacctgtacccagctgctgctgctgcccccttccccctgctgtacccaggcatcccagccccagctgctgctgctgctgctgctgctgctgctgctgctgctgctgctgccttcccctgcctgagctctgtgctgagccccccacctgagaaggccggggctgctgctgccaccctgctgccccatgaggtggcccccctgggcgccccccacccccagcacccccacggccgcacccacctgccctttgctggcccccgggagcccggcaaccctgagagcagcgcccaggaggaccccagccagcccgggaaggaggccccctag

SEQ ID NO: 3018 - DNA, 1113 bp, Artificial Sequence
  Description of Artificial Sequence: Synthetic coding sequence
atggatgagggcatcccccacctgcaggagcggcagctgctggagcaccgggacttcatcggcctggactacagcagcctgtacatgtgcaagcccaagaggtccatgaagagagatgacaccaaggacacctacaagctgccccacaggctcatcgagaagaagaggcgggaccgcatcaatgaatgcatcgcccagctgaaggacctgctgcctgagcacctgaagctgaccaccctgggccacctggagaaggctgtggtgctggagctgaccctgaagcacctgaaggccctgacagccctgacagagcagcagcaccagaagatcatcgccctgcagaatggagagaggagcctgaagagccccatccagagcgacctggatgccttccacagcggcttccagacctgtgccaaggaggtgctgcagtacctgagcagatttgagagctggaccccccgggagccccgctgtgtgcagctgatcaaccacctgcatgctgtggccacccagttcctgcccaccccccagctgctgacccagcaggtgcccctgagcaagggcaccggggcccccagcgctgctggcagcgctgctgccccctgcctggagagagctggccagaagctggagcccctggcctactgtgtgcctgtgatccagaggacccagcccagcgctgagctggccgcagaaaatgacacagacacagacagcggctacggcggggaggccgaggcccggccagaccgggagaagggcaagggggccggggccagccgggtgaccatcaagcaggagcccccaggagaggacagccccccacctccacccaggagccctgcctgcccccgctgctgccggcccctgccccggcggcgggcccccccaccccggcccagctgcaggacccgctggaggcccctgggccgccgcacccccagcaccaggacagctgcccccacctgccccagccctggccctgccagccggggcacccggcgggccctgctgaggaagatccccaggagccaggagaggaagctgcctgagagcctgcggcctgagggccgccgcttcaagcagagcgagaagctgaagtacccctag

SEQ ID NO: 3019 - DNA, 1191 bp, Artificial Sequence
  Description of Artificial Sequence: Synthetic coding sequence
atggtggccggcacccgctgcctgctggccctgctgctgccccaggtgctgctgggcggggccgccggcctggtgcctgagctgggccgcaggaagtttgctgctgccagcagcggccggcccagcagccagcccagtgatgaggtgctgtctgaatttgagctgcggctgctgtccatgtttggcctgaagcagaggcccacccccagcagagatgctgtggtgcccccctacatgctggacctgtaccgccgccacagcggccagcccggcagccctgccccagaccaccggctggagcgggccgccagccgggccaacacagtgcgctccttccaccacgaggagagcctggaggagctgcctgagaccagcggcaagaccacccggcgcttcttcttcaacctgagcagcatccccacagaggagttcatcaccagcgctgagctgcaggtgttccgggagcagatgcaggatgccctgggcaacaacagcagcttccaccaccgcatcaacatctatgagatcatcaagccagccacagccaacagcaagtttcctgtgacccggctgctggacacccggctggtgaaccagaatgccagccgctgggagagctttgatgtgaccccagctgtgatgcgctggacagcccagggccacgccaaccacggctttgtggtggaggtggcccacctggaggagaagcagggcgtgtccaagagacatgtgcgcatcagccgcagcctgcaccaggatgagcacagctggagccagatccggcccctgctggtgacctttggacatgatggcaagggccaccccctgcacaagcgggagaagaggcaggccaagcacaagcagaggaagaggctgaagagcagctgcaagaggcaccccctgtatgtggacttcagtgatgtgggctggaatgactggatcgtggcccctcctggctaccacgccttctactgccacggggagtgccccttccccctggccgaccacctgaacagcaccaaccacgccatcgtgcagaccctggtgaacagcgtgaacagcaagatccccaaggcctgctgcgtgcccacagagctgagcgccatctccatgctgtacctggatgaaaatgagaaggtggtgctgaagaactaccaggacatggtggtggagggctgcggctgcaggtag

SEQ ID NO: 3020 - DNA, 1296 bp, Artificial Sequence
  Description of Artificial Sequence: Synthetic coding sequence
atgcacgtgcgcagcctgcgggctgctgccccccacagctttgtggccctgtgggcccccctcttcctgctgcggagcgccctggccgacttcagcctggacaatgaggtgcacagcagcttcatccaccggcggctgcggagccaggagcggcgggagatgcagcgggagatcctgagcatcctgggcctgccccaccggccccggccccacctgcagggcaagcacaacagcgcccccatgttcatgctggacctgtacaatgccatggctgtggaggagggcggcggccctgggggccagggcttctcctacccctacaaggctgtgttcagcacccagggcccccccctggccagcctgcaggacagccacttcctgacagatgctgacatggtgatgagctttgtgaacctggtggagcatgacaaggagttcttccacccccgctaccaccaccgggagttccgctttgacctgagcaagatccctgagggggaggccgtgacagctgctgagttccgcatctacaaggactacatccgggagagatttgacaatgagaccttccgcatctctgtgtaccaggtgctgcaggagcacctgggccgggagagtgacctcttcctgctggacagcaggaccctgtgggccagcgaggagggctggctggtgtttgacatcacagccaccagcaaccactgggtggtgaaccccaggcacaacctgggcctgcagctgtctgtggagaccctggatggccagagcatcaaccccaagctggccggcctgattggccgccacggcccccagaacaagcagcccttcatggtggccttcttcaaggccacagaggtgcacttccgcagcatccgcagcacaggcagcaagcagaggagccagaacagaagcaagacccccaagaaccaggaggccctgaggatggccaacgtggccgagaacagcagcagtgaccagaggcaggcctgcaagaagcatgagctgtatgtgtccttccgggacctgggctggcaggactggatcatcgcccctgagggctatgctgcctactactgtgagggggagtgtgccttccccctgaacagctacatgaatgccaccaaccacgccatcgtgcagaccctggtgcacttcatcaaccctgagaccgtgcccaagccctgctgtgcccccacccagctgaatgccatctctgtgctgtactttgatgacagcagcaatgtcatcctgaagaagtacagaaacatggtggtgcgggcctgtggctgccactag

SEQ ID NO: 3021 - DNA, 1098 bp, Artificial Sequence
  Description of Artificial Sequence: Synthetic coding sequence
atgcacgtgcgcagcctgcgggctgctgccccccacagctttgtggccctgtgggcccccctcttcctgctgcggagcgccctggccgacttcagcctggacaatgaggtgcacagcagcttcatccaccggcggctgcggagccaggagcggcgggagatgcagcgggagatcctgagcatcctgggcctgccccaccggccccggccccacctgcagggcaagcacaacagcgcccccatgttcatgctggacctgtacaatgccatggctgtggaggagggcggcggccctgggggccagggcttctcctacccctacaaggctgtgttcagcacccagggcccccccctggccagcctgcaggacagccacttcctgacagatgctgacatggtgatgagctttgtgaacctggtggagcatgacaaggagttcttccacccccgctaccaccaccgggagttccgctttgacctgagcaagatccctgagggggaggccgtgacagctgctgagttccgcatctacaaggactacatccgggagagatttgacaatgagaccttccgcatctctgtgtaccaggtgctgcaggagcacctgggccgggagagtgacctcttcctgctggacagcaggaccctgtgggccagcgaggagggctggctggtgtttgacatcacagccaccagcaaccactgggtggtgaaccccaggcacaacctgggcctgcagctgtctgtggagaccctggatgagaacagcagcagtgaccagaggcaggcctgcaagaagcatgagctgtatgtgtccttccgggacctgggctggcaggactggatcatcgcccctgagggctatgctgcctactactgtgagggggagtgtgccttccccctgaacagctacatgaatgccaccaaccacgccatcgtgcagaccctggtgcacttcatcaaccctgagaccgtgcccaagccctgctgtgcccccacccagctgaatgccatctctgtgctgtactttgatgacagcagcaatgtcatcctgaagaagtacagaaacatggtggtgcgggcctgtggctgccactag

SEQ ID NO: 3022 - DNA, 1656 bp, Artificial Sequence
  Description of Artificial Sequence: Synthetic coding sequence
atggccggggacctgtctgctggcttcttcatggaggagctgaacacctaccggcagaagcagggcgtggtgctgaagtaccaggagctgcccaacagcggcccccctcatgaccggcgcttcaccttccaggtgatcattgatggccgggagttccctgagggggagggccgcagcaagaaggaggccaagaatgctgctgccaagctggccgtggagatcctgaacaaggagaagaaggctgtgagccccctgctgctgaccaccaccaacagcagcgagggcctgtccatgggcaactacatcggcctcatcaaccgcatcgcccagaagaagaggctgactgtgaactatgagcagtgtgccagcggcgtgcacggccctgagggcttccactacaagtgcaagatgggccagaaggagtacagcatcggcaccggcagcaccaagcaggaggccaagcagctggccgccaagctggcctacctgcagatcctgtctgaggagacctctgtgaagagtgactacctgagcagcggcagctttgccaccacctgtgagagccagagcaacagcctggtgaccagcaccctggccagcgagagcagcagcgagggggacttctctgctgacaccagcgagatcaacagcaacagcgacagcctgaacagcagcagcctgctgatgaatggcctgaggaacaaccagaggaaggccaagaggagcctggcccccaggtttgacctgcctgacatgaaggagaccaagtacacagtggacaagagatttggcatggacttcaaggagattgagctgattggcagcggcggcttcggccaggtgttcaaggccaagcacagaattgatggcaagacctacgtgatcaagagggtgaagtacaacaatgagaaggccgagcgggaggtgaaggccctggccaagctggaccacgtgaacatcgtgcactacaacggctgctgggatggctttgattatgaccctgagaccagtgatgacagcctggagagcagtgactatgaccctgagaacagcaagaacagcagccgcagcaagaccaagtgcctcttcatccagatggagttctgtgacaagggcaccctggagcagtggattgagaagagaagaggagagaagctggacaaggtgctggccctggagctgtttgagcagatcaccaagggcgtggactacatccacagcaagaagctgatccaccgggacctgaagcccagcaacatcttcctggtggacaccaagcaggtgaagatcggggactttggcctggtgaccagcctgaagaatgatggcaagaggaccaggagcaagggcaccctgcgctacatgagccctgagcagatcagcagccaggactatggcaaggaggtggacctgtatgccctgggcctcatcctggccgagctgctgcacgtgtgtgacacagcctttgagaccagcaagttcttcacagacctgagagatggcatcatcagtgacatctttgacaagaaggagaagaccctgctgcagaagctgctgagcaagaagccagaggaccggcccaacaccagcgagatcctgcggaccctgactgtgtggaagaagagccctgagaagaatgaaagacacacctgctag

SEQ ID NO: 3023 - DNA, 366 bp, Artificial Sequence
  Description of Artificial Sequence: Synthetic coding sequence
atgacccgcatcctgacagccttcaaggtggtgaggaccctgaagacaggcttcggcttcaccaacgtgacagcccaccagaagtggaagttcagccggcccggcatccggctgctgtctgtgaaggcccagacagcccacatcgtgctggaggatggcaccaagatgaagggctacagctttggccaccccagctctgtggccggggaggtggtgttcaacacaggcctgggcggctacccagaggccatcacagatcctgcctacaagggccagatcctgaccatggccaaccccatcattggaaatggaggagccccagacaccacagccctggatgagctgggcctgagcaagtacctgtag

SEQ ID NO: 3024 - DNA, 4521 bp, Artificial Sequence
  Description of Artificial Sequence: Synthetic coding sequence
atgccccagatcatcaagatgacccgcatcctgacagccttcaaggtggtgaggaccctgaagacaggcttcggcttcaccaacgtgacagcccaccagaagtggaagttcagccggcccggcatccggctgctgtctgtgaaggcccagacagcccacatcgtgctggaggatggcaccaagatgaagggctacagctttggccaccccagctctgtggccggggaggtggtgttcaacacaggcctgggcggctacccagaggccatcacagatcctgcctacaagggccagatcctgaccatggccaaccccatcattggaaatggaggagccccagacaccacagccctggatgagctgggcctgagcaagtacctggagagcaatggcatcaaggtgtctggcctgctggtgctggactacagcaaggactacaaccactggctggccaccaagagcctgggccagtggctgcaggaggagaaggtgcctgccatctacggcgtggacaccaggatgctgaccaagatcatccgggacaagggcaccatgctgggcaagattgaatttgagggccagcctgtggactttgtggaccccaacaagcagaacctgattgctgaggtgtccaccaaggatgtgaaggtgtatggcaagggcaaccccaccaaggtggtggccgtggactgtggcatcaagaacaacgtcatccggctgctggtgaagagaggagctgaggtgcacctggtgccctggaaccacgacttcaccaagatggagtatgatggcatcctgattgctgggggccctggcaacccagccctggccgagcccctcatccagaatgtgaggaagatcctggagagtgacaggaaggagcccctgtttggcatcagcactggaaacctgatcaccggcctggccgccggggccaagacctacaagatgtccatggccaacagaggccagaaccagcctgtgctgaacatcaccaacaagcaggccttcatcacagcccagaaccacggctacgccctggacaacaccctgcctgctggctggaagcccctgtttgtgaatgtgaatgaccagaccaatgaaggcatcatgcatgagagcaagcccttctttgctgtgcagttccaccctgaggtgaccccaggccccatcgacacagagtacctgtttgacagcttcttcagcctcatcaagaagggcaaggccaccaccatcacctctgtgctgcccaagccagccctggtggccagccgggtggaggtgtccaaggtgctgatcctgggcagcggcggcctgagcatcggccaggccggggagtttgactacagcggcagccaggccgtgaaggccatgaaggaggagaatgtgaagacagtgctgatgaaccccaacatcgcctctgtgcagaccaatgaggtgggcctgaagcaggccgacacagtgtacttcctgcccatcaccccccagtttgtgacagaggtgatcaaggccgagcagccagatggcctcatcctgggcatgggcggccagacagccctgaactgtggggtggagctgttcaagaggggcgtgctgaaggagtatggagtgaaggtgctgggcacctctgtggagagcatcatggccacagaagatcggcagctgttcagtgacaagctgaatgagatcaatgagaagatcgcccccagctttgctgtggagagcattgaagatgccctgaaggctgctgacaccatcggctaccctgtgatgatccgcagcgcctatgccctgggcggcctgggcagcggcatctgccccaaccgggagaccctgatggacctgagcaccaaggcctttgccatgaccaaccagatcctggtggagaagtctgtgacaggctggaaggagattgaatatgaggtggtgagagatgctgatgacaactgtgtgacagtgtgcaacatggagaatgtggatgccatgggcgtgcacactggagacagcgtggtggtggccccagcccagaccctgagcaatgctgagttccagatgctgcggaggaccagcatcaacgtggtgcgccacctgggcatcgtgggggagtgcaacatccagtttgccctgcaccccacctccatggagtactgcatcatcgaggtgaatgcccggctgagccgcagcagcgccctggccagcaaggccaccggctaccccctggccttcatcgccgccaagatcgccctgggcatccccctgcctgagatcaagaatgtggtgtctgggaagaccagcgcctgctttgagcccagcctggactacatggtgaccaagatcccccgctgggacctggaccgcttccacggcaccagcagccgcatcggcagctccatgaagtctgtgggggaggtgatggccatcggccgcacctttgaggagagcttccagaaggccctgaggatgtgccaccccagcattgagggcttcaccccccggctgcccatgaacaaggagtggcccagcaacctggacctgaggaaggagctgtctgagcccagcagcacccgcatctatgccatcgccaaggccattgatgacaacatgagcctggatgaaattgagaagctgacctacatcgacaagtggttcctgtacaagatgagggacatcctgaacatggagaagaccctgaagggcctgaacagcgagagcatgacagaggagaccctgaagagggccaaggagatcggcttcagtgacaagcagatcagcaagtgcctgggcctgacagaggcccagacccgggagctgcggctgaagaagaacatccacccctgggtgaagcagattgacaccctggccgctgagtaccccagcgtgaccaactacctgtatgtgacctacaacggccaggagcatgatgtgaactttgatgaccacggcatgatggtgctgggctgcggcccctaccacatcggcagctctgtggagtttgactggtgtgctgtgagcagcatccgcaccctgcggcagctgggcaagaagacagtggtggtgaactgcaaccctgagaccgtgtccacagactttgatgaatgtgacaagctgtactttgaggagctgagcctggagcgcatcctggacatctaccaccaggaggcctgtggcggctgcatcatctctgtgggcggccagatccccaacaacctggccgtgcccctgtacaagaatggagtgaagatcatgggcaccagccccctgcagattgacagagcagaagatagaagcatcttctctgctgtgctggatgagctgaaggtggcccaggccccctggaaggctgtgaacaccctgaatgaggccctggagtttgccaagtctgtggactacccctgcctgctgcggcccagctatgtgctgagcggcagcgccatgaatgtggtgttttctgaagatgagatgaagaagttcctggaggaggccaccagggtgtcccaggagcaccctgtggtgctgaccaagtttgtggagggcgcccgggaggtggagatggatgctgtgggcaaggatggccgggtcatcagccacgccatcagcgagcacgtggaggatgctggggtgcacagcggagatgccaccctgatgctgcccacccagaccatcagccagggcgccatcgagaaggtgaaggatgccaccaggaagatcgccaaggcctttgccatcagcggccccttcaacgtgcagttcctggtgaagggaaatgatgtgctggtgattgagtgcaacctgcgggccagccgctccttcccctttgtgtccaagaccctgggcgtggacttcattgatgtggccaccaaggtgatgattggagaaaatgtggatgagaagcacctgcccaccctggaccaccccatcatcccagctgactatgtggccatcaaggcccccatgttctcctggccccggctgagagatgctgaccccatcctgcgctgtgagatggccagcactggagaggtggcctgcttcggggagggcatccacacagccttcctgaaggccatgctgagcacaggcttcaagatcccccagaagggcatcctgattggcatccagcagagcttccggccccgcttcctgggcgtggccgagcagctgcacaatgaaggcttcaagctgtttgccacagaggccaccagtgactggctgaatgccaacaacgtgcctgccacccctgtggcctggcccagccaggagggccagaaccccagcctgagcagcatcaggaagctgatcagagatggcagcattgacctggtgatcaacctgcccaacaacaacaccaagtttgtgcatgacaactacgtgatcagaagaacagctgtggacagcggcatccccctgctgaccaacttccaggtgaccaagctgtttgctgaggccgtgcagaagagcaggaaggtggacagcaagagcctcttccactaccggcagtacagcgctgggaaggccgcctag

SEQ ID NO: 3025 - DNA, 3150 bp, Artificial Sequence
  Description of Artificial Sequence: Synthetic coding sequence
atgaaggaggagaatgtgaagacagtgctgatgaaccccaacatcgcctctgtgcagaccaatgaggtgggcctgaagcaggccgacacagtgtacttcctgcccatcaccccccagtttgtgacagaggtgatcaaggccgagcagccagatggcctcatcctgggcatgggcggccagacagccctgaactgtggggtggagctgttcaagaggggcgtgctgaaggagtatggagtgaaggtgctgggcacctctgtggagagcatcatggccacagaggaccggcagctgttcagtgacaagctgaatgagatcaatgagaagatcgcccccagctttgctgtggagagcattgaagatgccctgaaggctgctgacaccatcggctaccctgtgatgatccgcagcgcctatgccctgggcggcctgggcagcggcatctgccccaaccgggagaccctgatggacctgagcaccaaggcctttgccatgaccaaccagatcctggtggagaagtctgtgacaggctggaaggagattgaatatgaggtggtgagagatgctgatgacaactgtgtgacagtgtgcaacatggagaatgtggatgccatgggcgtgcacactggagacagcgtggtggtggccccagcccagaccctgagcaatgctgagttccagatgctgcggaggaccagcatcaacgtggtgcgccacctgggcatcgtgggggagtgcaacatccagtttgccctgcaccccacctccatggagtactgcatcatcgaggtgaatgcccggctgagccgcagcagcgccctggccagcaaggccaccggctaccccctggccttcatcgccgccaagatcgccctgggcatccccctgcctgagatcaagaatgtggtgtctgggaagaccagcgcctgctttgagcccagcctggactacatggtgaccaagatcccccgctgggacctggaccgcttccacggcaccagcagcagaattggcagctccatgaagtctgtgggggaggtgatggccatcggccgcacctttgaggagagcttccagaaggccctgaggatgtgccaccccagcattgagggcttcaccccccggctgcccatgaacaaggagtggcccagcaacctggacctgaggaaggagctgtctgagcccagcagcacccgcatctatgccatcgccaaggccattgatgacaacatgagcctggatgaaattgagaagctgacctacatcgacaagtggttcctgtacaagatgagggacatcctgaacatggagaagaccctgaagggcctgaacagcgagagcatgacagaggagaccctgaagagggccaaggagatcggcttcagtgacaagcagatcagcaagtgcctgggcctgacagaggcccagacccgggagctgcggctgaagaagaacatccacccctgggtgaagcagattgacaccctggccgctgagtaccccagcgtgaccaactacctgtatgtgacctacaacggccaggagcatgatgtgaactttgatgaccacggcatgatggtgctgggctgcggcccctaccacatcggcagctctgtggagtttgactggtgtgctgtgagcagcatccgcaccctgcggcagctgggcaagaagacagtggtggtgaactgcaaccctgagaccgtgtccacagactttgatgaatgtgacaagctgtactttgaggagctgagcctggagcgcatcctggacatctaccaccaggaggcctgtggcggctgcatcatctctgtgggcggccagatccccaacaacctggccgtgcccctgtacaagaatggagtgaagatcatgggcaccagccccctgcagattgacagagctgaggacaggagcatcttctctgctgtgctggatgagctgaaggtggcccaggccccctggaaggctgtgaacaccctgaatgaggccctggagtttgccaagtctgtggactacccctgcctgctgcggcccagctatgtgctgagcggcagcgccatgaatgtggtgttttctgaagatgagatgaagaagttcctggaggaggccaccagggtgtcccaggagcaccctgtggtgctgaccaagtttgtggagggcgcccgggaggtggagatggatgctgtgggcaaggatggccgggtcatcagccacgccatcagcgagcacgtggaggatgctggggtgcacagcggagatgccaccctgatgctgcccacccagaccatcagccagggcgccatcgagaaggtgaaggatgccaccaggaagatcgccaaggcctttgccatcagcggccccttcaacgtgcagttcctggtgaagggaaatgatgtgctggtgattgagtgcaacctgcgggccagccgctccttcccctttgtgtccaagaccctgggcgtggacttcattgatgtggccaccaaggtgatgattggagaaaatgtggatgagaagcacctgcccaccctggaccaccccatcatcccagctgactatgtggccatcaaggcccccatgttctcctggccccggctgagagatgctgaccccatcctgcgctgtgagatggccagcactggagaggtggcctgctttggagagggcatccacacagccttcctgaaggccatgctgagcacaggcttcaagatcccccagaagggcatcctgattggcatccagcagagcttccggccccgcttcctgggcgtggccgagcagctgcacaatgaaggcttcaagctgtttgccacagaggccaccagtgactggctgaatgccaacaacgtgcctgccacccctgtggcctggcccagccaggagggccagaaccccagcctgagcagcatcaggaagctgatcagagatggcagcattgacctggtgatcaacctgcccaacaacaacaccaagtttgtgcatgacaactacgtgatccggaggacagctgtggacagcggcatccccctgctgaccaacttccaggtgaccaagctgtttgctgaggccgtgcagaagagcaggaaggtggacagcaagagcctcttccactaccggcagtacagcgctgggaaggccgcctag

SEQ ID NO: 3026 - DNA, 366 bp, Artificial Sequence; identical to SEQ ID NO: 3023
  Description of Artificial Sequence: Synthetic coding sequence

SEQ ID NO: 3027 - DNA, 1542 bp, Artificial Sequence
  Description of Artificial Sequence: Synthetic coding sequence
atgacccgcatcctgacagccttcaaggtggtgaggaccctgaagacaggcttcggcttcaccaacgtgacagcccaccagaagtggaagttcagccggcccggcatccggctgctgtctgtgaaggcccagacagcccacatcgtgctggaggatggcaccaagatgaagggctacagctttggccaccccagctctgtggccggggaggtggtgttcaacacaggcctgggcggctacccagaggccatcacagatcctgcctacaagggccagatcctgaccatggccaaccccatcattggaaatggaggagccccagacaccacagccctggatgagctgggcctgagcaagtacctggagagcaatggcatcaaggtgtctggcctgctggtgctggactacagcaaggactacaaccactggctggccaccaagagcctgggccagtggctgcaggaggagaaggtgcctgccatctacggcgtggacaccaggatgctgaccaagatcatccgggacaagggcaccatgctgggcaagattgaatttgagggccagcctgtggactttgtggaccccaacaagcagaacctgattgctgaggtgtccaccaaggatgtgaaggtgtatggcaagggcaaccccaccaaggtggtggccgtggactgtggcatcaagaacaacgtcatccggctgctggtgaagagaggagctgaggtgcacctggtgccctggaaccacgacttcaccaagatggagtatgatggcatcctgattgctgggggccctggcaacccagccctggccgagcccctcatccagaatgtgaggaagatcctggagagtgacaggaaggagcccctgtttggcatcagcactggaaacctgatcaccggcctggccgccggggccaagacctacaagatgtccatggccaacagaggccagaaccagcctgtgctgaacatcaccaacaagcaggccttcatcacagcccagaaccacggctacgccctggacaacaccctgcctgctggctggaagcccctgtttgtgaatgtgaatgaccagaccaatgaaggcatcatgcatgagagcaagcccttctttgctgtgcagttccaccctgaggtgaccccaggccccatcgacacagagtacctgtttgacagcttcttcagcctcatcaagaagggcaaggccaccaccatcacctctgtgctgcccaagccagccctggtggccagccgggtggaggtgtccaaggtgctgatcctgggcagcggcggcctgagcatcggccaggccggggagtttgactacagcggcagccaggccgtgaaggccatgaaggaggagaatgtgaagacagtgctgatgaaccccaacatcgcctctgtgcagaccaatgaggtgggcctgaagcaggccgacacagtgtacttcctgcccatcaccccccagtttgtgacagaggtgatcaaggccgagcagccagatggcctcatcctgggcatgggcgcccggcagctgtag

SEQ ID NO: 3028 - DNA, 4527 bp, Artificial Sequence
  Description of Artificial Sequence: Synthetic coding sequence
cggccccggccccagatcatcaagatgacccgcatcctgacagccttcaaggtggtgaggaccctgaagacaggcttcggcttcaccaacgtgacagcccaccagaagtggaagttcagccggcccggcatccggctgctgtctgtgaaggcccagacagcccacatcgtgctggaggatggcaccaagatgaagggctacagctttggccaccccagctctgtggccggggaggtggtgttcaacacaggcctgggcggctacccagaggccatcacagatcctgcctacaagggccagatcctgaccatggccaaccccatcattggaaatggaggagccccagacaccacagccctggatgagctgggcctgagcaagtacctggagagcaatggcatcaaggtgtctggcctgctggtgctggactacagcaaggactacaaccactggctggccaccaagagcctgggccagtggctgcaggaggagaaggtgcctgccatctacggcgtggacaccaggatgctgaccaagatcatccgggacaagggcaccatgctgggcaagattgaatttgagggccagcctgtggactttgtggaccccaacaagcagaacctgattgctgaggtgtccaccaaggatgtgaaggtgtatggcaagggcaaccccaccaaggtggtggccgtggactgtggcatcaagaacaacgtcatccggctgctggtgaagagaggagctgaggtgcacctggtgccctggaaccacgacttcaccaagatggagtatgatggcatcctgattgctgggggccctggcaacccagccctggccgagcccctcatccagaatgtgaggaagatcctggagagtgacaggaaggagcccctgtttggcatcagcactggaaacctgatcaccggcctggccgccggggccaagacctacaagatgtccatggccaacagaggccagaaccagcctgtgctgaacatcaccaacaagcaggccttcatcacagcccagaaccacggctacgccctggacaacaccctgcctgctggctggaagcccctgtttgtgaatgtgaatgaccagaccaatgaaggcatcatgcatgagagcaagcccttctttgctgtgcagttccaccctgaggtgaccccaggccccatcgacacagagtacctgtttgacagcttcttcagcctcatcaagaagggcaaggccaccaccatcacctctgtgctgcccaagccagccctggtggccagccgggtggaggtgtccaaggtgctgatcctgggcagcggcggcctgagcatcggccaggccggggagtttgactacagcggcagccaggccgtgaaggccatgaaggaggagaatgtgaagacagtgctgatgaaccccaacatcgcctctgtgcagaccaatgaggtgggcctgaagcaggccgacacagtgtacttcctgcccatcaccccccagtttgtgacagaggtgatcaaggccgagcagccagatggcctcatcctgggcatgggcggccagacagccctgaactgtggggtggagctgttcaagaggggcgtgctgaaggagtatggagtgaaggtgctgggcacctctgtggagagcatcatggccacagaagatcggcagctgttcagtgacaagctgaatgagatcaatgagaagatcgcccccagctttgctgtggagagcattgaagatgccctgaaggctgctgacaccatcggctaccctgtgatgatccgcagcgcctatgccctgggcggcctgggcagcggcatctgccccaaccgggagaccctgatggacctgagcaccaaggcctttgccatgaccaaccagatcctggtggagaagtctgtgacaggctggaaggagattgaatatgaggtggtgagagatgctgatgacaactgtgtgacagtgtgcaacatggagaatgtggatgccatgggcgtgcacactggagacagcgtggtggtggccccagcccagaccctgagcaatgctgagttccagatgctgcggaggaccagcatcaacgtggtgcgccacctgggcatcgtgggggagtgcaacatccagtttgccctgcaccccacctccatggagtactgcatcatcgaggtgaatgcccggctgagccgcagcagcgccctggccagcaaggccaccggctaccccctggccttcatcgccgccaagatcgccctgggcatccccctgcctgagatcaagaatgtggtgtctgggaagaccagcgcctgctttgagcccagcctggactacatggtgaccaagatcccccgctgggacctggaccgcttccacggcaccagcagccgcatcggcagctccatgaagtctgtgggggaggtgatggccatcggccgcacctttgaggagagcttccagaaggccctgaggatgtgccaccccagcattgagggcttcaccccccggctgcccatgaacaaggagtggcccagcaacctggacctgaggaaggagctgtctgagcccagcagcacccgcatctatgccatcgccaaggccattgatgacaacatgagcctggatgaaattgagaagctgacctacatcgacaagtggttcctgtacaagatgagggacatcctgaacatggagaagaccctgaagggcctgaacagcgagagcatgacagaggagaccctgaagagggccaaggagatcggcttcagtgacaagcagatcagcaagtgcctgggcctgacagaggcccagacccgggagctgcggctgaagaagaacatccacccctgggtgaagcagattgacaccctggccgctgagtaccccagcgtgaccaactacctgtatgtgacctacaacggccaggagcatgatgtgaactttgatgaccacggcatgatggtgctgggctgcggcccctaccacatcggcagctctgtggagtttgactggtgtgctgtgagcagcatccgcaccctgcggcagctgggcaagaagacagtggtggtgaactgcaaccctgagaccgtgtccacagactttgatgaatgtgacaagctgtactttgaggagctgagcctggagcgcatcctggacatctaccaccaggaggcctgtggcggctgcatcatctctgtgggcggccagatccccaacaacctggccgtgcccctgtacaagaatggagtgaagatcatgggcaccagccccctgcagattgacagagcagaagatagaagcatcttctctgctgtgctggatgagctgaaggtggcccaggccccctggaaggctgtgaacaccctgaatgaggccctggagtttgccaagtctgtggactacccctgcctgctgcggcccagctatgtgctgagcggcagcgccatgaatgtggtgttttctgaagatgagatgaagaagttcctggaggaggccaccagggtgtcccaggagcaccctgtggtgctgaccaagtttgtggagggcgcccgggaggtggagatggatgctgtgggcaaggatggccgggtcatcagccacgccatcagcgagcacgtggaggatgctggggtgcacagcggagatgccaccctgatgctgcccacccagaccatcagccagggcgccatcgagaaggtgaaggatgccaccaggaagatcgccaaggcctttgccatcagcggccccttcaacgtgcagttcctggtgaagggaaatgatgtgctggtgattgagtgcaacctgcgggccagccgctccttcccctttgtgtccaagaccctgggcgtggacttcattgatgtggccaccaaggtgatgattggagaaaatgtggatgagaagcacctgcccaccctggaccaccccatcatcccagctgactatgtggccatcaaggcccccatgttctcctggccccggctgagagatgctgaccccatcctgcgctgtgagatggccagcactggagaggtggcctgcttcggggagggcatccacacagccttcctgaaggccatgctgagcacaggcttcaagatcccccagaagggcatcctgattggcatccagcagagcttccggccccgcttcctgggcgtggccgagcagctgcacaatgaaggcttcaagctgtttgccacagaggccaccagtgactggctgaatgccaacaacgtgcctgccacccctgtggcctggcccagccaggagggccagaaccccagcctgagcagcatcaggaagctgatcagagatggcagcattgacctggtgatcaacctgcccaacaacaacaccaagtttgtgcatgacaactacgtgatcagaagaacagctgtggacagcggcatccccctgctgaccaacttccaggtgaccaagctgtttgctgaggccgtgcagaagagcaggaaggtggacagcaagagcctcttccactaccggcagtacagcgctgggaaggccgcctag

SEQ ID NO: 3029 - DNA, 213 bp, Artificial Sequence
  Description of Artificial Sequence: Synthetic coding sequence
atgacccgcatcctgacagccttcaaggtggtgaggaccctgaagacaggcttcggcttcaccaacgtgacagcccaccagaagtggaagttcagccggcccggcatccggctgctgtctgtgaaggcccagacagcccacatcgtgctggaggacagagatgctgacaccccagcccccctgctgaaccagcctgagccccacgtgatctag

SEQ ID NO: 3030 - DNA, 606 bp, Artificial Sequence
  Description of Artificial Sequence: Synthetic coding sequence
atgagcagaagagagggcagcctggaggacccccagacagacagctctgtgtccctgctgccccacctggaggccaagatccggcagacccacagcctggcccacctgctgaccaagtatgcagagcagctgctgcaggagtatgtgcagctgcagggcgaccccttcggcctgcccagcttcagccccccccggctgcctgtggccggcctgagcgccccagcccccagccatgctggcctgcctgtgcatgagcggctgcggctggatgctgctgccctggccgccctgccccccctgctggatgctgtgtgccggcggcaggccgagctgaacccccgggccccccggctgctgcggcggctggaggatgctgcccggcaggcccgggccctgggcgctgctgtggaggccctgctggccgccctgggcgccgccaacagaggccccagggctgagcccccagctgccacagccagcgctgccagcgccactggagtcttccctgccaaggtgctgggcctgcgggtgtgtggcctgtaccgggagtggctgagcaggacagaaggagacctgggccagctgctgcccggcggcagcgcctag

SEQ ID NO: 3031 - DNA, 603 bp, Artificial Sequence
  Description of Artificial Sequence: Synthetic coding sequence
atgagcagaagagagggcagcctggacccccagacagacagctctgtgtccctgctgccccacctggaggccaagatccggcagacccacagcctggcccacctgctgaccaagtatgcagagcagctgctgcaggagtatgtgcagctgcagggcgaccccttcggcctgcccagcttcagccccccccggctgcctgtggccggcctgagcgccccagcccccagccacgccggcctgcctgtgcatgagcggctgcggctggatgctgctgccctggccgccctgccccccctgctggatgctgtgtgccggcggcaggccgagctgaacccccgggccccccggctgctgcggcggctggaggatgctgcccggcaggcccgggccctgggcgctgctgtggaggccctgctggccgccctgggcgccgccaacagaggccccagggctgagcccccagctgccacagccagcgctgccagcgccaccggggtcttccctgccaaggtgctgggcctgcgggtgtgtggcctgtaccgggagtggctgagcaggacagaaggagacctgggccagctgctgcccggcggcagcgcctag

SEQ ID NO: 3032 - DNA, 513 bp, Artificial Sequence
  Description of Artificial Sequence: Synthetic coding sequence
atgaagacccagagagatggccacagcctgggccgctggagcctggtgctgctgctgctgggcctggtgatgcccctggccatcatcgcccaggtgctgagctacaaggaggccgtgctgcgggccattgatggcatcaaccagaggagcagtgatgccaacctgtaccgcctgctggacctggacccccggcccaccatggatggagaccctgacacccccaagcctgtgtccttcaccgtgaaggagaccgtgtgccccaggaccacccagcagagccctgaggactgtgacttcaagaaggatggcctggtgaagcgctgcatgggcaccgtgaccctgaaccaggcccggggcagctttgacatcagctgtgacaaggacaacaagagatttgccctgctgggggacttcttcaggaagagcaaggagaagattggcaaggagttcaagagaattgtgcagaggatcaaggacttcctgaggaacctggtgcccaggacagagagctag

SEQ ID NO: 3033 - DNA, 1692 bp, Artificial Sequence
  Description of Artificial Sequence: Synthetic coding sequence
gcctgctgctgcggcggcggctgcacctgctgcggctgcacctgcaccaccggctgctgcaccacctgcacctgctgtgcctgtgcctgcaccaccggcaccaccaccggggccggggcctgctgcacaggaggctgtgccgccggcggcaccggctgcggcggggccggctgctgctgcacctgctgtgccggggctgctggcaccggctgcggcggcacctgtgccgccggctgcggcggctgtgccggctgcggcggggccggggcctgtggcggctgtggggccggctgctgtgccggcggggccgcctgctgcacctgctgctgctgctgctgcggctgcggcacctgctgctgctgtgccggctgcaccacctgctgctgtgccggctgcggcaccggcggctgcggcggctgcggcggggccgcctgctgctgctgctgcggcggggccggggctgctgctggggccgccacagctgctgctggggcctgcacaggaggagccacagcctgtgccggcggcacctgctgtgccaccacagcctgtggcacctgtgccaccacctgcaccggctgtgccggcggctgctgtgccgccaccaccacagccaccggggccggcggggccgccacctgctgtgccgccggggccaccggggccgccaccaccaccggcggggccggctgtgccggcggggccggggccggcggctgctgcggcaccaccaccggcacctgcaccggctgtgccggcaccggctgctgctgctgtgccggcggctgcaccggctgcacctgctgctgtgccggctgcggctgcaccacctgctgctgtgccgcctgtgccggggccggcggggcctgctgtgccacctgcacaggagccaccggggccaccacctgtgccacagctgggggctgtgcctgtgccgccgcctgtgccactggagctgctgccaccggggcctgcaccaccaccggggctgctggcaccaccacctgctgcaccacctgtgccgccacagctgctgctgctgcctgtgccggggcctgtgccgccacagccaccggcaccacagccacctgtgccggggccacctgtgccgccgcctgcacctgctgcggggcctgctgctgctgtgccgcctgtggggccggggccaccacctgctgcaccggggctgctggagctgcctgcaccggctgtggggccggcggggccggcggcaccggcggcggctgctgcacctgcaccacctgtgccggctgtggggccggctgcaccggcggggcctgcaccggctgcacctgctgctgcaccggcggggccggctgtgcctgtggggccggcaccacctgtgccggcggggccgccggcggctgcacctgtgccggcggggccgccggggccggcggggccggggccggctgtgccggctgtgccgccggctgcggcggggccgccacagccacctgcacctgtggggccaccggctgtgccacagctgccaccggctgtgccggcaccaccggcggcactggaggcggcggctgctgtgccactggagcctgtggcggcggcggctgctgctgcggcggggccgcctgcacctgtgcctgctgtgccggctgcaccacagctggctgtgccggctgcggctgcacctgtggcggctgcaccggctag

SEQ ID NO: 3034 - DNA, 555 bp, Artificial Sequence
  Description of Artificial Sequence: Synthetic coding sequence
atggctgaccacctgatgctggccgagggctaccgcctggtgcagaggcctccttctgctgctgctgcccacggcccccacgccctgcggaccctgcccccctatgccggccctggcctggacagcggcctgcggcccaggggggcccccctgggccccccaccaccccggcagcccggggccctggcctacggggcctttggaccacccagcagcttccagcccttccctgctgtgcccccacctgctgctggcatcgcccacctgcagcctgtggccaccccctacccaggccgggctgctgcccccccaaatgcccctgggggccccccaggcccccagcctgcccccagcgctgctgcccctcctcctccagcccacgccctgggcggcatggatgctgagctgattgatgaggaggccctgaccagcctggagctggagctgggcctgcaccgggtgcgggagctgcctgagctgttcctgggccagagcgagtttgactgcttcagtgacctgggcagcgcccctcctgctggctctgtgtcctgctag

SEQ ID NO: 3035 - DNA, 3198 bp, Artificial Sequence
  Description of Artificial Sequence: Synthetic coding sequence
atgaagatcctgatcctgggcatcttcctgttcctgtgcagcaccccagcctgggccaaggagaagcactactacatcggcatcatcgagaccacctgggactatgccagtgaccatggagagaagaagctgatctctgtggacacagagcacagcaacatctacctgcagaatggaccagacagaattggccgcctgtacaagaaggccctgtacctgcagtacacagatgagaccttccgcaccaccatcgagaagcctgtgtggctgggcttcctgggccccatcatcaaggccgagactggagacaaggtgtatgtgcacctgaagaacctggccagccggccctacaccttccacagccacggcatcacctactacaaggagcacgagggcgccatctacccagacaacaccacagacttccagagagcagatgacaaggtgtacccaggagagcagtacacctacatgctgctggccacagaggagcagagccctggagaaggagatggcaactgtgtgacccgcatctaccacagccacattgatgcccccaaggacatcgccagcggcctcatcggccccctcatcatctgcaagaaggacagcctggacaaggagaaggagaagcacatcgaccgggagtttgtggtgatgttttctgtggtggatgagaacttctcctggtacctggaggacaacatcaagacctactgcagcgagcctgagaaggtggacaaggacaatgaagacttccaggagagcaacaggatgtacagcgtgaatggctacaccttcggcagcctgcccggcctgtccatgtgtgccgaggacagagtgaagtggtacctgtttggcatgggaaatgaggtggatgtgcacgccgccttcttccacggccaggccctgaccaacaagaactacagaattgacaccatcaacctcttccctgccaccctgtttgatgcctacatggtggcccagaaccctggagagtggatgctgagctgccagaacctgaaccacctgaaggccggcctgcaggccttcttccaggtgcaggagtgcaacaagagcagcagcaaggacaacatccggggcaagcacgtgcgccactactacatcgctgctgaggagatcatctggaactatgcccccagcggcatcgacatcttcaccaaggagaacctgacagcccctggcagtgacagcgctgtgttctttgagcagggcaccacccgcatcggcggcagctacaagaagctggtgtaccgggagtacacagatgccagcttcaccaacaggaaggagcggggccctgaggaggagcacctgggcatcctgggccctgtgatctgggccgaggtgggggacaccatccgggtgaccttccacaacaagggggcctaccccctgagcattgagcccatcggcgtgcgcttcaacaagaacaatgaaggcacctactacagccccaactacaacccccagagccgctctgtgcccccatctgccagccacgtggcccccacagagaccttcacctatgagtggacagtgcccaaggaggtgggccccaccaatgctgaccctgtgtgcctggccaagatgtactacagcgctgtggagcccaccaaggacatcttcaccggcctcatcggccccatgaagatctgcaagaagggcagcctgcacgccaacggccggcagaaggatgtggacaaggagttctacctgttccccaccgtgtttgatgaaaatgaaagcctgctgctggaggacaacatccgcatgttcaccacagccccagaccaggtggacaaggaggatgaggacttccaggagagcaacaagatgcacagcatgaatggcttcatgtatggcaaccagcccggcctgaccatgtgcaagggggacagcgtggtgtggtacctgttctctgctggaaatgaagcagatgtgcacggcatctacttcagcggcaacacctacctgtggagaggagagcggcgggacacagccaacctcttcccccagaccagcctgaccctgcacatgtggccagacacagagggcaccttcaacgtggagtgcctgaccacagaccactacacaggaggcatgaagcagaagtacacagtgaaccagtgccggcggcagagcgaggacagcaccttctacctgggggagaggacctactacatcgctgctgtggaggtggagtgggactacagcccccagcgggagtgggagaaggagctgcaccacctgcaggagcagaatgtgtccaatgccttcctggacaagggggagttctacatcggcagcaagtacaagaaggtggtgtaccggcagtacacagacagcaccttccgggtgcctgtggagaggaaggccgaggaggagcacctgggcatcctgggcccccagctgcacgcagatgtgggggacaaggtgaagatcatcttcaagaacatggccacccggccctacagcatccacgcccatggagtgcagacagagagcagcacagtgacccccaccctgcctggagagaccctgacctacgtgtggaagatccctgagaggtctggagctggaacagaggacagcgcctgcatcccctgggcctactacagcacagtggaccaggtgaaggacctgtacagcggcctcatcggccccctcatcgtgtgcagaagaccctacctgaaggtgttcaaccccaggaggaagctggagtttgccctgctcttcctggtgtttgatgaaaatgaatcctggtacctggatgacaacatcaagacctacagcgaccaccctgagaaggtgaacaaggatgatgaggagttcatcgagagcaacaagatgcacgccatcaatggccgcatgtttggaaacctgcagggcctgaccatgcacgtgggagatgaggtgaactggtacctgatgggcatgggaaatgaaattgacctgcacacagtgcacttccacggccacagcttccagtacaagcacagaggagtgtacagcagtgatgtgtttgacatcttccctggcacctaccagaccctggagatgttccccaggaccccaggcatctggctgctgcactgccacgtgacagaccacatccacgccggcatggagaccacctacacagtgctgcagaatgaagacaccaagagcggctag

SEQ ID NO: 3036 - DNA, 603 bp, Artificial Sequence
  Description of Artificial Sequence: Synthetic coding sequence
atggccttcacagagcacagccccctgaccccccacagaagagacctgtgcagccgcagcatctggctggccaggaagatccgcagtgacctgacagccctgacagagagctatgtgaagcaccagggcctgaacaagaacatcaacctggacagcgcagatggcatgcctgtggccagcacagaccagtggagcgagctgacagaggccgagcggctgcaggagaacctgcaggcctaccgcaccttccacgtgctgctggcccggctgctggaggaccagcaggtgcacttcacccccacagaaggagacttccaccaggccatccacaccctgctgctgcaggtggccgcctttgcctaccagatcgaggagctgatgatcctgctggagtacaagatccccagaaatgaagcagatggcatgcccatcaacgtgggagatggcggcctgtttgagaagaagctgtggggcctgaaggtgctgcaggagctgagccagtggacagtgcgcagcatccatgacctgcgcttcatcagcagccaccagacaggcatcccagcccggggcagccactacatcgccaacaacaagaagatgtag

SEQ ID NO: 3037 - DNA, 1869 bp, Artificial Sequence
  Description of Artificial Sequence: Synthetic coding sequence
atggcccacgtgcggggcctgcagctgcccggctgcctggccctggccgccctgtgcagcctggtgcacagccagcacgtgttcctggccccccagcaggcccggagcctgctgcagagggtgcggcgggccaacaccttcctggaggaggtgaggaaaggaaacctggagagagaatgtgtggaggagacctgcagctatgaggaggcctttgaggccctggagagcagcacagccacagatgtgttctgggccaagtacacagcctgtgaaacagcccggaccccccgggacaagctggccgcctgcctggagggcaactgtgccgagggcctgggcaccaactaccggggccacgtgaacatcaccaggtctggaattgagtgccagctgtggaggagccgctacccccacaagccagagatcaacagcaccacccaccctggagctgacctgcaggagaacttctgcaggaacccagacagcagcaccaccggcccctggtgctacaccacagaccccaccgtgcggcggcaggagtgcagcatccctgtgtgtggccaggaccaggtgacagtggccatgacccccaggtctgagggcagctctgtgaacctgagcccccccctggagcagtgtgtgcctgaccggggccagcagtaccagggccgcctggccgtgaccacccacggcctgccctgcctggcctgggccagcgcccaggccaaggccctgagcaagcaccaggacttcaacagcgctgtgcagctggtggagaacttctgcagaaatccagatggagatgaggagggcgtgtggtgctacgtggccggcaagccaggggactttggctactgtgacctgaactactgtgaggaggccgtggaggaggagactggagatggcctggatgaagattctgaccgggccatcgagggccgcacagccaccagcgagtaccagaccttcttcaaccccaggacctttggaagtggagaggccgactgtggcctgcggcccctgtttgagaagaagagcctggaggacaagacagagcgggagctgctggagagctacattgatggccgcatcgtggagggcagtgatgctgagatcggcatgagcccctggcaggtgatgctgttcaggaagagcccccaggagctgctgtgtggggccagcctcatcagtgaccgctgggtgctgacagctgcccactgcctgctgtacccaccctgggacaagaacttcacagaaaatgacctgctggtgcgcatcggcaagcacagcaggaccaggtatgaaagaaacatcgagaagatctccatgctggagaagatctacatccacccccgctacaactggagggagaacctggaccgggacatcgccctgatgaagctgaagaagcctgtggccttcagtgactacatccaccctgtgtgcctgcctgaccgggagacagctgccagcctgctgcaggccggctacaagggccgggtgacaggctggggcaacctgaaggagacctggacagccaacgtgggcaagggccagcccagcgtgctgcaggtggtgaacctgcccatcgtggagaggcctgtgtgcaaggacagcacccgcatccgcatcacagacaacatgttctgtgccggctacaagccagatgagggcaagagaggagatgcctgtgagggggacagcggcggcccctttgtgatgaagagccccttcaacaaccgctggtaccagatgggcatcgtgtcctggggcgagggctgtgacagagatggcaagtatggcttctacacccacgtgttccggctgaagaagtggatccagaaggtgattgaccagtttggagagtag

SEQ ID NO: 3038 - DNA, 195 bp, Artificial Sequence
  Description of Artificial Sequence: Synthetic coding sequence
ctgcagggcgagttcctgccccagccccggcagcagcaccacggcaccctggtgctgcactaccggccccaccgggaggaggccggcatgcagcacccctgcctgtggccaggcagcagccactgcagtgatgacagcaccctgcggcggctgcagtgtgagagcgtgaccagcattggagctgtgtgcccctag

SEQ ID NO: 3039 - DNA, 1752 bp, Artificial Sequence
  Description of Artificial Sequence: Synthetic coding sequence
atggcccacgtgcggggcctgcagctgcccggctgcctggccctggccgccctgtgcagcctggtgcacagccagcacgtgttcctggccccccagcaggcccggagcctgctgcagagggtgcggcgggccaacaccttcctggaggaggtgaggaaaggaaacctggagagagaatgtgtggaggagacctgcagctatgaggaggcctttgaggccctggagagcagcacagccacagatgtgttctgggccaagtacacagcctgtgaaacagcccggaccccccgggacaagctggccgcctgcctggagggcaactgtgccgagggcctgggcaccaactaccggggccacgtgaacatcaccaggtctggaattgagtgccagctgtggaggagccgctacccccacaagccagagatcaacagcaccacccaccctggagctgacctgcaggagaacttctgcaggaacccagacagcagcaccaccggcccctggtgctacaccacagaccccaccgtgcggcggcaggagtgcagcatccctgtgtgtggccaggaccaggtgacagtggccatgacccccaggtctgagggcagctctgtgaacctgagcccccccctggagcagtgtgtgcctgaccggggccagcagtaccagggccgcctggccgtgaccacccacggcctgccctgcctggcctgggccagcgcccaggccaaggccctgagcaagcaccaggacttcaacagcgctgtgcagctggtggagaacttctgcagaaatccagatggagatgaggagggcgtgtggtgctacgtggccggcaagccaggggactttggctactgtgacctgaactactgtgaggaggccgtggaggaggagactggagatggcctggatgaagattctgaccgggccatcgagggccgcacagccaccagcgagtaccagaccttcttcaaccccaggacctttggaagtggagaggccgactgtggcctgcggcccctgtttgagaagaagagcctggaggacaagacagagcgggagctgctggagagctacattgatggccgcatcgtggagggcagtgatgctgagatcggcatgagcccctggcaggtgatgctgttcaggaagagcccccaggagctgctgtgtggggccagcctcatcagtgaccgctgggtgctgacagctgcccactgcctgctgtacccaccctgggacaagaacttcacagaaaatgacctgctggtgcgcatcggcaagcacagcaggaccaggtatgaaagaaacatcgagaagatctccatgctggagaagatctacatccaccccagcctgctgcaggccggctacaagggccgggtgacaggctggggcaacctgaaggagacctggacagccaacgtgggcaagggccagcccagcgtgctgcaggtggtgaacctgcccatcgtggagaggcctgtgtgcaaggacagcacccgcatccgcatcacagacaacatgttctgtgccggctacaagccagatgagggcaagagaggagatgcctgtgagggggacagcggcggcccctttgtgatgaagagccccttcaacaaccgctggtaccagatgggcatcgtgtcctggggcgagggctgtgacagagatggcaagtatggcttctacacccacgtgttccggctgaagaagtggatccagaaggtgattgaccagtttggagagtag

SEQ ID NO: 3040 - DNA, 888 bp, Artificial Sequence
  Description of Artificial Sequence: Synthetic coding sequence
atggagaccccagcctggccccgggtgcccaggcctgagacagctgtggcccggaccctgctgctgggctgggtgtttgcccaggtggccggggccagcggcaccaccaacacagtggccgcctacaacctgacctggaagagcaccaacttcaagaccatcctggagtgggagcccaagcctgtgaaccaggtgtacacagtgcagatcagcaccaagagcggggactggaagagcaagtgcttctacaccacagacacagaatgtgacctgacagatgaaattgtgaaggatgtgaagcagacctacctggcccgggtcttctcctacccagctggaaatgtggagagcacaggcagcgctggggagcccctgtatgagaacagccctgagttcaccccctacctggagaccaacctgggccagcccaccatccagagctttgagcaggtgggcaccaaggtgaatgtgacagtggaggatgagaggaccctggtgagaagaaacaacaccttcctgagcctgagagatgtgtttgggaaggacctgatctacaccctgtactactggaagagcagcagcagcggcaagaagacagccaagaccaacaccaatgagttcctgattgatgtggacaagggggagaactactgcttctctgtgcaggccgtcatccccagcaggacagtgaacaggaagagcacagacagccctgtggagtgcatgggccaggagaagggggagttccgggagatcttctacatcatcggggctgtggtgtttgtggtgatcatcctggtgatcatcctggccatcagcctgcacaagtgcaggaaggccggcgtgggccagagctggaaggagaacagccccctgaatgtgtcctag

SEQ ID NO: 3041 - DNA, 717 bp, Artificial Sequence
  Description of Artificial Sequence: Synthetic coding sequence
atggagaccccagcctggccccgggtgcccaggcctgagacagctgtggcccggaccctgctgctgggctgggtgtttgcccaggtggccggggccagcggcaccaccaacacagtggccgcctacaacctgacctggaagagcaccaacttcaagaccatcctggagtgggagcccaagcctgtgaaccaggtgtacacagtgcagatcagcaccaagagcggggactggaagagcaagtgcttctacaccacagacacagaatgtgacctgacagatgaaattgtgaaggatgtgaagcagacctacctggcccgggtcttctcctacccagctggaaatgtggagagcacaggcagcgctggggagcccctgtatgagaacagccctgagttcaccccctacctggagaccaacctgggccagcccaccatccagagctttgagcaggtgggcaccaaggtgaatgtgacagtggaggatgagaggaccctggtgagaagaaacaacaccttcctgagcctgagagatgtgtttgggaaggacctgatctacaccctgtactactggaagagcagcagcagcggcaagaagtacagcaccagcctggagctgtggtacctgtggagcagcagcctgagcagctcctggctgtacctgtacacctctgtggagcggcaggagtggggccgggccggccgccgcaccccccactag

SEQ ID NO: 3042 - DNA, 3807 bp, Artificial Sequence
  Description of Artificial Sequence: Synthetic coding sequence
atgattgctgcccctgagatccccacagacttcaacctgctgcaggagagcgagacccacttcagcagtgacacagactttgaggacatcgagggcaagaaccagaagcagggcaagggcaagacctgcaagaagggcaagaagggccctgctgagaagggcaaaggaggaaatggaggcggcaagcccccatctggccccaacaggatgaatggccaccaccagcagaatggagtggagaacatgatgctgtttgaggtggtgaagatgggcaagagcgccatgcagagcgtggtggatgactggattgagagctacaagcatgaccgggacatcgccctgctggacctgatcaacttcttcatccagtgcagcggctgcaagggcgtggtgacagctgagatgttccgccacatgcagaacagcgagatcatcaggaagatgacagaggagtttgatgaggacagcggggactaccccctgaccatggccggcccccagtggaagaagttcaagagcagcttctgtgagttcatcggcgtgctggtgcggcagtgccagtacagcatcatctatgatgagtacatgatggacaccgtcatcagcctgctgaccggcctgagtgacagccaggtgcgggccttccgccacaccagcaccctggccgccatgaagctgatgacagccctggtgaatgtggccctgaacctgagcatcaacatggacaacacccagaggcagtatgaggccgagaggaacaagatgattggcaagagggccaatgaaaggctggagctgctgctgcagaagaggaaggagctgcaggagaaccaggatgaaattgagaacatgatgaatgccatcttcaagggcgtgtttgtgcaccgctacagagatgccatcgccgagatccgggccatctgcatcgaggagatcggcatctggatgaagatgtacagtgatgccttcctgaatgacagctacctgaagtatgtgggctggaccatgcatgacaagcagggcgaggtgcggctgaagtgcctgacagccctgcagggcctgtactacaacaaggagctgaacagcaagctggagctgttcaccagccgcttcaaggacagaattgtgtccatgaccctggacaaggagtatgatgtggccgtgcaggccatcaagctgctgaccctggtgctgcagagcagcgaggaggtgctgacagctgaggactgtgaaaatgtgtaccacctggtgtacagcgcccacaggcctgtggccgtggccgccggggagttcctgtacaagaagctgttcagcagaagagatcctgaggaggatggcatgatgaagaggcggggccggcagggccccaatgccaacctggtgaagaccctggtgttcttcttcctggagagcgagctgcacgagcacgccgcctacctggtggacagcatgtgggactgtgccacagagctgctgaaggactgggagtgcatgaacagcctgctgctggaggagcccctgagcggggaggaggccctgacagaccggcaggagagcgccctgattgagatcatgctgtgcaccatccggcaggccgctgagtgccacccccctgtgggccggggcaccgggaagagggtgctgacagccaaggagaagaagacccagctggatgacaggaccaagatcacagagctgtttgctgtggccctgccccagctgctggccaagtacagcgtggatgctgagaaggtgaccaacctgctgcagctgccccagtactttgacctggagatctacaccaccggccgcctggagaagcacctggatgccctgctgcggcagatcagaaatattgtggagaagcacacagacacagatgtgctggaggcctgcagcaagacctaccacgccctgtgcaatgaggagttcaccatcttcaacagagtggacatcagccgcagccagctgattgatgagctggccgacaagttcaaccggctgctggaggacttcctgcaggagggggaggagccagatgaagatgatgcctaccaggtgctgagcaccctgaagaggatcacagccttccacaatgcccatgacctgagcaagtgggacctgtttgcctgcaactacaagctgctgaagacaggaattgaaaatggagacatgcctgagcagatcgtcatccacgccctgcagtgcacccactacgtgatcctgtggcagctggccaagatcacagagagcagcagcaccaaggaggacctgctgcggctgaagaagcagatgagggtcttctgccagatctgccagcactacctgaccaacgtgaacaccaccgtgaaggagcaggccttcaccatcctgtgtgacatcctgatgatcttcagccaccagatcatgtctgggggccgggacatgctggagcccctggtgtacaccccagacagcagcctgcagagcgagctgctgtccttcatcctggaccacgtgttcatcgagcaggatgatgacaacaacagcgcagatggccagcaggaggatgaggccagcaagattgaggccctgcacaagagaagaaacctgctggccgccttctgcaagctgattgtgtacacagtggtggagatgaacacagctgctgacatcttcaagcagtacatgaagtactacaatgactatggagacatcatcaaggagaccatgagcaagacccggcagattgacaagatccagtgtgccaagaccctcatcctgagcctgcagcagctgttcaatgagatgatccaggagaatggctacaactttgacaggagcagcagcaccttcagcggcatcaaggagctggccaggagatttgccctgaccttcggcctggaccagctgaagacccgggaggccatcgccatgctgcacaaggatggcatcgagtttgccttcaaggagcccaacccccagggcgagagccacccccccctgaacctggccttcctggacatcctgtctgagttcagcagcaagctgctgcggcaggacaagaggacagtgtatgtgtacctggagaagttcatgaccttccagatgagcctgcggagagaagatgtgtggctgcccctgatgagctacagaaacagcctgctggccggaggagatgatgacaccatgtctgtcatcagcggcatcagcagccggggcagcacagtgcgcagcaagaagagcaagcccagcacaggcaagaggaaggtggtggagggcatgcagctgagcctgacagaggagagcagcagcagtgacagcatgtggctgagccgggagcagaccctgcacacccctgtgatgatgcagaccccccagctgaccagcaccatcatgagggagcccaagaggctgcggccagaagattccttcatgtctgtgtaccccatgcagacagagcaccaccagacccccctggactacaacacccaggtgacctggatgctggcccagaggcagcaggaggaggcccggcagcagcaggagcgggccgccatgtcctatgtgaagctgcggaccaacctgcagcacgccatccggcggggcaccagcctgatggaggatgatgaggagcccatcgtggaggatgtgatgatgagcagcgagggcagaattgaggacctgaatgaaggcatggactttgacaccatggacatcgacctgccccccagcaagaacagaagagagaggacagagctgaagccagacttctttgatcctgccagcatcatggatgaatctgtgctgggcgtgtccatgttttag

SEQ ID NO: 3043 - DNA, 1272 bp, Artificial Sequence
  Description of Artificial Sequence: Synthetic coding sequence
atgcagagggtgaacatgatcatggccgagagccctggcctcatcaccatctgcctgctgggctacctgctgtctgcagaatgtactgtgttcctggaccatgaaaatgccaacaagatcctgaaccggcccaagcgctacaacagcggcaagctggaggagtttgtgcagggcaacctggagcgggagtgcatggaggagaagtgcagctttgaggaggcccgggaggtgtttgaaaatacagagaggaccacagagttctggaagcagtatgtggatgtgacctgcaacatcaagaatggccgctgtgagcagttctgcaagaacagcgctgacaacaaggtggtgtgcagctgcacagagggctaccgcctggccgagaaccagaagagctgtgagcctgctgtgcccttcccctgtggccgggtgtctgtgtcccagaccagcaagctgaccagggctgagaccgtcttcccagatgtggactatgtgaacagcacagaagctgagaccatcctggacaacatcacccagagcacccagagcttcaatgacttcaccagggtggtgggcggagaagatgccaagccaggccagttcccctggcaggtggtgctgaatggcaaggtggatgccttctgtggcggcagcatcgtgaatgagaagtggatcgtgacagctgcccactgtgtggagactggagtgaagatcaccgtggtggccggggagcacaacatcgaggagacagagcacacagagcagaagagaaatgtcatccgcatcatcccccaccacaactacaatgctgccatcaacaagtacaaccacgacatcgccctgctggagctggatgagcccctggtgctgaacagctatgtgacccccatctgcatcgctgacaaggagtacaccaacatcttcctgaagtttggcagcggctacgtgtctggctggggccgggtcttccacaagggccgcagcgccctggtgctgcagtacctgcgggtgcccctggtggaccgggccacctgcctgcggagcaccaagttcaccatctacaacaacatgttctgtgccggcttccacgagggcggccgggacagctgccagggcgacagcggcggcccccacgtgacagaggtggagggcaccagcttcctgaccggcatcatctcctggggcgaggagtgtgccatgaagggcaagtatggcatctacaccaaggtgagccgctacgtgaactggatcaaggagaagaccaagctgacctag

SEQ ID NO: 3044 - DNA, 6690 bp, Artificial Sequence
  Description of Artificial Sequence: Synthetic coding sequence
atgtttcctggctgcccccggctgtgggtgctggtggtgctgggcacctcctgggtgggctggggcagccagggcacagaggccgcccagctgcggcagttctacgtggccgcccagggcatctcctggagctacagacctgagcccaccaacagcagcctgaacctgtctgtgaccagcttcaagaagatcgtgtaccgggagtatgagccctacttcaagaaggagaagccccagagcaccatcagcggcctgctgggccccaccctgtatgcagaggtgggggacatcatcaaggtgcacttcaagaacaaggctgacaagcccctgagcatccacccccagggcatccgctacagcaagctgtctgagggcgccagctacctggaccacaccttccctgctgagaagatggatgatgctgtggcccctggccgggagtacacctatgagtggagcatcagcgaggacagcggccccacccatgatgatcctccctgcctgacccacatctactacagccatgagaacctgattgaggacttcaacagcggcctgattggccccctgctgatctgcaagaagggcaccctgacagaaggaggcacccagaagacctttgacaagcagatcgtgctgctgtttgctgtgtttgatgagagcaagtcctggagccagagcagcagcctgatgtacacagtgaatggctacgtgaatggcaccatgccagacatcaccgtgtgtgcccatgaccacatctcctggcacctgctgggcatgagcagcggccctgagctgttcagcatccacttcaacggccaggtgctggagcagaaccaccacaaggtgtctgccatcaccctggtgtctgccaccagcaccacagccaacatgacagtgggccctgagggcaagtggatcatcagcagcctgacccccaagcacctgcaggccggcatgcaggcctacatcgacatcaagaactgccccaagaagaccaggaacctgaagaagatcacccgggagcagaggaggcacatgaagcgctgggagtacttcatcgctgctgaggaggtgatctgggactatgcccctgtgatcccagccaacatggacaagaagtaccgcagccagcacctggacaacttcagcaaccagatcggcaagcactacaagaaggtgatgtacacccagtatgaagatgagagcttcaccaagcacacagtgaaccccaacatgaaggaggatggcatcctgggccccatcatccgggcccaggtgcgggacaccctgaagatcgtgttcaagaacatggccagccggccctacagcatctacccccacggcgtgaccttcagcccctatgaagatgaggtgaacagcagcttcaccagcggcaggaacaacaccatgatccgggctgtgcagcctggagagacctacacctacaagtggaacatcctggagtttgatgagcccacagaaaatgatgcccagtgcctgacccggccctactacagtgatgtggacatcatgagggacatcgccagcggcctcatcggcctgctgctgatctgcaagagccgcagcctggaccggcagggcatccagagagctgctgacatcgagcagcaggccgtgtttgctgtgtttgatgagaacaagtcctggtacctggaggacaacatcaacaagttctgtgagaacccagatgaggtgaagagagatgaccccaagttctatgagagcaacatcatgagcaacttcaccctgagcgccatcaatggctacgtgcctgagagcatcaccaccctgggcttctgctttgatgacacagtgcagtggcacttctgcagcgtgggcacccagaatgagatcctgaccatccacttcaccggccacagcttcatctacggcaagagacatgaggacaccctgaccctcttccccatgagaggagagagcgtgacagtgaccatggacaacgtgggcacctggatgctgacctccatgaacagcagccccaggagcaagaagctgcggctgaagttcagagatgtgaagtgcatcccagatgatgatgaagattcctatgagatctttgagcccccagagagcacagtgatggccaccaggaagatgcatgaccggctggagccagaagatgaggagagtgatgctgactatgactaccagaaccggctggccgccgccctgggcatccgctccttcaggaacagcagcctgaaccaggaggaggaggagttcaacctgacagccctggccctggagaatggaacagaatttgtgagcagcaacacagacatcatcgtgggcagcaactacagcagccccagcaacatcagcaagttcaccgtgaacaacctggccgagccccagaaggcccccagccaccagcaggccaccacagctggcagccccctgcggcacctgattggcaagaacagcgtgctgaacagcagcacagctgagcacagcagcccctacagcgaggaccccatcgaggaccccctgcagccagatgtgacaggcatccggctgctgagcctgggcgctggggagttcaagagccaggagcacgccaagcacaagggccccaaggtggagcgggaccaggccgccaagcaccgcttctcctggatgaagctgctggcccacaaggtgggccgccacctgagccaggacaccggcagccccagcggcatgaggccctgggaggacctgcccagccaggacaccggcagccccagcaggatgaggccctggaaggacccccccagcgacctgctgctgctgaagcagagcaacagcagcaagatcctggtgggccgctggcacctggccagcgagaagggcagctatgagatcatccaggacacagatgaggacacagctgtgaacaactggctgatcagcccccagaatgccagccgggcctggggcgagagcacccccctggccaacaagccaggcaagcagagcggccaccccaagttcccccgggtgcgccacaagagcctgcaggtgcggcaggacggcggcaagagccggctgaagaagagccagttcctgatcaagaccaggaagaagaagaaggagaagcacacccaccacgcccccctgagccccaggaccttccaccccctgcggtctgaggcctacaacaccttcagcgagcggcggctgaagcacagcctggtgctgcacaagagcaatgagaccagcctgcccacagacctgaaccagaccctgcccagcatggactttggctggatcgccagcctgcctgaccacaaccagaacagcagcaatgacaccggccaggccagctgccccccaggcctgtaccagacagtgcccccagaggagcactaccagaccttccccatccaggaccctgaccagatgcacagcaccagtgaccccagccacaggagcagcagccctgagctgtctgagatgctggagtatgacaggagccacaagagcttccccacagacatcagccagatgagccccagcagcgagcacgaggtgtggcagaccgtcatcagcccagacctgagccaggtgaccctgagccctgagctgagccagaccaacctgagcccagacctgagccacaccaccctgagccctgagctgatccagaggaacctgagccctgccctgggccagatgcccatcagcccagacctgagccacaccaccctgagcccagacctgagccacaccaccctgagcctggacctgagccagaccaacctgagccctgagctgagccagaccaacctgagccctgccctgggccagatgcccctgagcccagacctgagccacaccaccctgagcctggacttcagccagaccaacctgagccctgagctgagccacatgaccctgagccctgagctgagccagaccaacctgagccctgccctgggccagatgcccatcagcccagacctgagccacaccaccctgagcctggacttcagccagaccaacctgagccctgagctgagccagaccaacctgagccctgccctgggccagatgcccctgagcccagaccccagccacaccaccctgagcctggacctgagccagaccaacctgagccctgagctgagccagaccaacctgagcccagacctgtctgagatgcccctgtttgctgacctgagccagatccccctgaccccagacctggaccagatgaccctgagcccagacctgggggagacagacctgagccccaactttggccagatgagcctgagcccagacctgagccaggtgaccctgagcccagacatcagtgacaccaccctgctgcctgacctgagccagatcagccccccaccagacctggaccagatcttctaccccagcgagagcagccagagcctgctgctgcaggagttcaatgaaagcttcccctacccagacctgggccagatgcccagccccagcagccccaccctgaatgacaccttcctgagcaaggagttcaaccccctggtgattgtgggcctgagcaaggatggaacagactacatcgagatcatccccaaggaggaggtgcagagcagtgaagatgattatgcagaaattgattatgtgccctatgatgacccctacaagacagatgtgaggaccaacatcaacagcagccgggaccctgacaacattgctgcctggtacctgcggagcaacaatggaaacagaagaaactactacatcgctgctgaggagatctcctgggactacagcgagtttgtgcagcgggagacagacattgaagattctgatgacatccctgaggacaccacctacaagaaggtggtgttcaggaagtacctggacagcaccttcaccaagagggaccccagaggagaatatgaggagcacctgggcatcctgggccccatcatccgggcagaggtggatgatgtgatccaggtgcgcttcaagaacctggccagccggccctacagcctgcacgcccacggcctgtcctatgagaagagcagcgagggcaagacctatgaagatgacagccctgagtggttcaaggaggacaatgctgtgcagcccaacagcagctacacctacgtgtggcacgccacagagaggagcggccctgagagccctggcagcgcctgccgggcctgggcctactacagcgctgtgaaccctgagaaggacatccacagcggcctcatcggccccctgctgatctgccagaagggcatcctgcacaaggacagcaacatgcccatggacatgagggagtttgtgctgctcttcatgacctttgatgagaagaagtcctggtactatgagaagaagagccgcagctcctggaggctgaccagcagcgagatgaagaagagccatgagttccacgccatcaatggcatgatctacagcctgcccggcctgaagatgtatgagcaggagtgggtgcggctgcacctgctgaacatcggcggcagccaggacatccacgtggtgcacttccacggccagaccctgctggagaatggaaacaagcagcaccagctgggcgtgtggcccctgctgcccggcagcttcaagaccctggagatgaaggccagcaagccaggctggtggctgctgaacacagaggtgggggagaaccagagagctggcatgcagacccccttcctgatcatggaccgggactgcaggatgcccatgggcctgagcacaggcatcatcagtgacagccagatcaaggccagcgagttcctgggctactgggagccccggctggcccggctgaacaacggcggcagctacaatgcctggagcgtggagaagctggccgctgagtttgccagcaagccctggatccaggtggacatgcagaaggaggtgatcatcaccggcatccagacccagggcgccaagcactacctgaagagctgctacaccacagagttctacgtggcctacagcagcaaccagatcaactggcagatcttcaagggcaacagcaccagaaatgtgatgtacttcaacggcaacagtgatgccagcaccatcaaggagaaccagtttgatcctcccatcgtggcccgctacatccgcatcagccccacccgggcctacaaccggcccaccctgcggctggagctgcagggctgtgaggtgaatggctgcagcacccccctgggcatggagaatggcaagattgagaacaagcagatcacagccagcagcttcaagaagtcctggtggggagactactgggagcccttccgggcccggctgaatgcccagggccgggtgaatgcctggcaggccaaggccaacaacaacaagcagtggctggagattgacctgctgaagatcaagaagatcacagccatcatcacccagggctgcaagagcctgagcagcgagatgtatgtgaagagctacaccatccactacagcgagcagggcgtggagtggaagccctaccgcctgaagagctccatggtggacaagatctttgagggcaacaccaacaccaagggccacgtgaagaacttcttcaacccccccatcatcagccgcttcatccgggtcatccccaagacctggaaccagagcatcgccctgcggctggagctgtttggctgtgacatctactag

SEQ ID NO: 3045 - DNA, 6675 bp, Artificial Sequence
  Description of Artificial Sequence: Synthetic coding sequence
atgtttcctggctgcccccggctgtgggtgctggtggtgctgggcacctcctgggtgggctggggcagccagggcacagaggccgcccagctgcggcagttctacgtggccgcccagggcatctcctggagctacagacctgagcccaccaacagcagcctgaacctgtctgtgaccagcttcaagaagatcgtgtaccgggagtatgagccctacttcaagaaggagaagccccagagcaccatcagcggcctgctgggccccaccctgtatgcagaggtgggggacatcatcaaggtgcacttcaagaacaaggctgacaagcccctgagcatccacccccagggcatccgctacagcaagctgtctgagggcgccagctacctggaccacaccttccctgctgagaagatggatgatgctgtggcccctggccgggagtacacctatgagtggagcatcagcgaggacagcggccccacccatgatgatcctccctgcctgacccacatctactacagccatgagaacctgattgaggacttcaacagcggcctgattggccccctgctgatctgcaagaagggcaccctgacagaaggaggcacccagaagacctttgacaagcagatcgtgctgctgtttgctgtgtttgatgagagcaagtcctggagccagagcagcagcctgatgtacacagtgaatggctacgtgaatggcaccatgccagacatcaccgtgtgtgcccatgaccacatctcctggcacctgctgggcatgagcagcggccctgagctgttcagcatccacttcaacggccaggtgctggagcagaaccaccacaaggtgtctgccatcaccctggtgtctgccaccagcaccacagccaacatgacagtgggccctgagggcaagtggatcatcagcagcctgacccccaagcacctgcaggccggcatgcaggcctacatcgacatcaagaactgccccaagaagaccaggaacctgaagaagatcacccgggagcagaggaggcacatgaagcgctgggagtacttcatcgctgctgaggaggtgatctgggactatgcccctgtgatcccagccaacatggacaagaagtaccgcagccagcacctggacaacttcagcaaccagatcggcaagcactacaagaaggtgatgtacacccagtatgaagatgagagcttcaccaagcacacagtgaaccccaacatgaaggaggatggcatcctgggccccatcatccgggcccaggtgcgggacaccctgaagatcgtgttcaagaacatggccagccggccctacagcatctacccccacggcgtgaccttcagcccctatgaagatgaggtgaacagcagcttcaccagcggcaggaacaacaccatgatccgggctgtgcagcctggagagacctacacctacaagtggaacatcctggagtttgatgagcccacagaaaatgatgcccagtgcctgacccggccctactacagtgatgtggacatcatgagggacatcgccagcggcctcatcggcctgctgctgatctgcaagagccgcagcctggaccggcagggcatccagagagctgctgacatcgagcagcaggccgtgtttgctgtgtttgatgagaacaagtcctggtacctggaggacaacatcaacaagttctgtgagaacccagatgaggtgaagagagatgaccccaagttctatgagagcaacatcatgagcaccatcaatggctacgtgcctgagagcatcaccaccctgggcttctgctttgatgacacagtgcagtggcacttctgcagcgtgggcacccagaatgagatcctgaccatccacttcaccggccacagcttcatctacggcaagagacatgaggacaccctgaccctcttccccatgagaggagagagcgtgacagtgaccatggacaacgtgggcacctggatgctgacctccatgaacagcagccccaggagcaagaagctgcggctgaagttcagagatgtgaagtgcatcccagatgatgatgaggacagctatgagatctttgagcccccagagagcacagtgatggccaccaggaagatgcatgaccggctggagccagaagatgaggagagtgatgctgactatgactaccagaaccggctggccgccgccctgggcatccgctccttcaggaacagcagcctgaaccaggaggaggaggagttcaacctgacagccctggccctggagaatggaacagaatttgtgagcagcaacacagacatcatcgtgggcagcaactacagcagccccagcaacatcagcaagttcaccgtgaacaacctggccgagccccagaaggcccccagccaccagcaggccaccacagctggcagccccctgcggcacctgattggcaagaacagcgtgctgaacagcagcacagctgagcacagcagcccctacagcgaggaccccatcgaggaccccctgcagccagatgtgacaggcatccggctgctgagcctgggcgctggggagttcaagagccaggagcacgccaagcacaagggccccaaggtggagcgggaccaggccgccaagcaccgcttctcctggatgaagctgctggcccacaaggtgggccgccacctgagccaggacaccggcagccccagcggcatgaggccctgggaggacctgcccagccaggacaccggcagccccagcaggatgaggccctggaaggaccccccaagtgacctgctgctgctgaagcagagcaacagcagcaagatcctggtgggccgctggcacctggccagcgagaagggcagctatgagatcatccaggacacagatgaggacacagctgtgaacaactggctgatcagcccccagaatgccagccgggcctggggcgagagcacccccctggccaacaagccaggcaagcagagcggccaccccaagttcccccgggtgcgccacaagagcctgcaggtgcggcaggacggcggcaagagccggctgaagaagagccagttcctgatcaagaccaggaagaagaagaaggagaagcacacccaccacgcccccctgagccccaggaccttccaccccctgcggtctgaggcctacaacaccttcagcgagcggcggctgaagcacagcctggtgctgcacaagagcaatgagaccagcctgcccacagacctgaaccagaccctgcccagcatggactttggctggatcgccagcctgcctgaccacaaccagaacagcagcaatgacaccggccaggccagctgccccccaggcctgtaccagacagtgcccccagaggagcactaccagaccttccccatccaggaccctgaccagatgcacagcaccagtgaccccagccacaggagcagcagccctgagctgtctgagatgctggagtatgacaggagccacaagagcttccccacagacatcagccagatgagccccagcagcgagcacgaggtgtggcagaccgtcatcagcccagacctgagccaggtgaccctgagccctgagctgagccagaccaacctgagcccagacctgagccacaccaccctgagccctgagctgatccagaggaacctgagccctgccctgggccagatgcccatcagcccagacctgagccacaccaccctgagcccagacctgagccacaccaccctgagcctggacctgagccagaccaacctgagccctgagctgagccagaccaacctgagccctgccctgggccagatgcccctgagcccagacctgagccacaccaccctgagcctggacttcagccagaccaacctgagccctgagctgagccacatgaccctgagccctgagctgagccagaccaacctgagccctgccctgggccagatgcccatcagcccagacctgagccacaccaccctgagcctggacttcagccagaccaacctgagccctgagctgagccagaccaacctgagccctgccctgggccagatgcccctgagcccagaccccagccacaccaccctgagcctggacctgagccagaccaacctgagccctgagctgagccagaccaacctgagcccagacctgtctgagatgcccctgtttgctgacctgagccagatccccctgaccccagacctggaccagatgaccctgagcccagacctgggggagacagacctgagccccaactttggccagatgagcctgagcccagacctgagccaggtgaccctgagcccagacatcagtgacaccaccctgctgcctgacctgagccagatcagccccccaccagacctggaccagatcttctaccccagcgagagcagccagagcctgctgctgcaggagttcaatgaaagcttcccctacccagacctgggccagatgcccagccccagcagccccaccctgaatgacaccttcctgagcaaggagttcaaccccctggtgattgtgggcctgagcaaggatggaacagactacatcgagatcatccccaaggaggaggtgcagagcagtgaagatgattatgcagaaattgattatgtgccctatgatgacccctacaagacagatgtgaggaccaacatcaacagcagccgggaccctgacaacattgctgcctggtacctgcggagcaacaacggcaacagaagaaactactacatcgctgctgaggagatctcctgggactacagcgagtttgtgcagcgggagacagacatcgaggacagtgatgacatccctgaggacaccacctacaagaaggtggtgttcaggaagtacctggacagcaccttcaccaagagggaccccagaggagaatatgaggagcacctgggcatcctgggccccatcatccgggcagaggtggatgatgtgatccaggtgcgcttcaagaacctggccagccggccctacagcctgcacgcccacggcctgtcctatgagaagagcagcgagggcaagacctatgaagatgacagccctgagtggttcaaggaggacaatgctgtgcagcccaacagcagctacacctacgtgtggcacgccacagagaggagcggccctgagagccctggcagcgcctgccgggcctgggcctactacagcgctgtgaaccctgagaaggacatccacagcggcctgattggccccctgctgatctgccagaagggcatcctgcacaaggacagcaacatgcccatggacatgagggagtttgtgctgctcttcatgacctttgatgagaagaagtcctggtactatgagaagaagagccgcagctcctggaggctgaccagcagcgagatgaagaagagccatgagttccacgccatcaatggcatgatctacagcctgcccggcctgaagatgtatgagcaggagtgggtgcggctgcacctgctgaacattggaggcagccaggacatccacgtggtgcacttccacggccagaccctgctggagaatggaaacaagcagcaccagctgggcgtgtggcccctgctgcccggcagcttcaagaccctggagatgaaggccagcaagccaggctggtggctgctgaacacagaggtgggggagaaccagagagctggcatgcagacccccttcctgatcatggaccgggactgcaggatgcccatgggcctgagcacaggcatcatcagtgacagccagatcaaggccagcgagttcctgggctactgggagccccggctggcccggctgaacaatggaggcagctacaatgcctggagcgtggagaagctggccgctgagtttgccagcaagccctggatccaggtggacatgcagaaggaggtgatcatcaccggcatccagacccagggcgccaagcactacctgaagagctgctacaccacagagttctacgtggcctacagcagcaaccagatcaactggcagatcttcaagggcaacagcaccagaaatgtgatgtacttcaatggaaacagtgatgccagcaccatcaaggagaaccagtttgacccccccatcgtggcccgctacatccgcatcagccccacccgggcctacaaccggcccaccctgcggctggagctgcagggctgtgaggtgaatggctgcagcacccccctgggcatggagaatggcaagattgagaacaagcagatcacagccagcagcttcaagaagtcctggtggggagactactgggagcccttccgggcccggctgaatgcccagggccgggtgaatgcctggcaggccaaggccaacaacaacaagcagtggctggagattgacctgctgaagatcaagaagatcacagccatcatcacccagggctgcaagagcctgagcagcgagatgtatgtgaagagctacaccatccactacagcgagcagggcgtggagtggaagccctaccgcctgaagagctccatggtggacaagatctttgagggcaacaccaacaccaagggccacgtgaagaacttcttcaacccccccatcatcagccgcttcatccgggtcatccccaagacctggaaccagagcatcgccctgcggctggagctgtttggctgtgacatctactag

SEQ ID NO: 3046 - DNA, 999 bp, Artificial Sequence
  Description of Artificial Sequence: Synthetic coding sequence
atggatgatgctgtggcccctggccgggagtacacctatgagtggagcatcagtgaagattctggccccacccatgatgaccccccctgcctgacccacatctactacagccatgagaacctgattgaggacttcaacagcggcctcatcggccccctgctgatctgcaagaagggcaccctgacagagggcggcacccagaagacctttgacaagcagatcgtgctgctgtttgctgtgtttgatgagagcaagtcctggagccagagcagcagcctgatgtacacagtgaatggctacgtgaatggcaccatgccagacatcaccgtgtgtgcccatgaccacatctcctggcacctgctgggcatgagcagcggccctgagctgttcagcatccacttcaacggccaggtgctggagcagaaccaccacaaggtgtctgccatcaccctggtgtctgccaccagcaccacagccaacatgacagtgggccctgagggcaagtggatcatcagcagcctgacccccaagcacctgcaggccggcatgcaggcctacatcgacatcaagaactgccccaagaagaccaggaacctgaagaagatcacccgggagcagaggaggcacatgaagcgctgggagtacttcatcgctgctgaggaggtgatctgggactatgcccctgtgatcccagccaacatggacaagaagtaccgcagccagcacctggacaacttcagcaaccagatcggcaagcactacaagaaggtgatgtacacccagtatgaagatgagagcttcaccaagcacacagtgaaccccaacatgaaggaggatggcatcctgggccccatcatccgggcccaggtgcgggacaccctgaagatcgtgttcaagaacatggccagccggccctacagcatctacccccatggagtgaccttcagcccctatgaagatgaggtgaacagcagcttcaccagcggcaccaccccctag

SEQ ID NO: 3047 - DNA, 1335 bp, Artificial Sequence
  Description of Artificial Sequence: Synthetic coding sequence
atggtgtcccaggccctgcggctgctgtgcctgctgctgggcctgcagggctgcctggccgctgtgtttgtgacccaggaggaggcccacggcgtgctgcacagaagaagaagagccaatgccttcctggaggagctgcggcccggcagcctggagcgggagtgcaaggaggagcagtgcagctttgaggaggcccgggagatcttcaaggatgctgagaggaccaagctgttctggatctcctacagtgatggagaccagtgtgccagcagcccctgccagaatggaggcagctgcaaggaccagctgcagagctacatctgcttctgcctgcctgcctttgagggcaggaactgtgagacccacaaggatgaccagctgatctgtgtgaatgaaaatggaggctgtgagcagtactgcagcgaccacacaggcaccaagaggagctgccgctgccacgagggctacagcctgctggctgatggagtgtcctgcacccccaccgtggagtacccctgtgggaagatccccatcctggagaagagaaatgccagcaagccccagggcagaattgtgggcggcaaggtgtgccccaagggagaatgtccctggcaggtgctgctgctggtgaatggagcccagctgtgtggcggcaccctcatcaacaccatctgggtggtgtctgctgcccactgctttgacaagatcaagaactggaggaacctgattgctgtgctgggggagcatgacctgtctgaacatgatggagatgagcagagcagaagagtggcccaggtgatcatccccagcacctacgtgcccggcaccaccaaccacgacatcgccctgctgcggctgcaccagcctgtggtgctgacagaccacgtggtgcccctgtgcctgcctgagaggaccttcagcgagaggaccctggcctttgtgcgcttcagcctggtgtctggctggggccagctgctggacagaggagccacagccctggagctgatggtgctgaatgtgccccggctgatgacccaggactgcctgcagcagagcaggaaggtgggggacagccccaacatcacagagtacatgttctgtgccggctacagtgatggcagcaaggacagctgcaagggggacagcggcggcccccacgccacccactaccggggcacctggtacctgactggaattgtgtcctggggccagggctgtgccaccgtgggccactttggagtgtacaccagggtgtcccagtacatcgagtggctgcagaagctgatgaggtctgagcccaggcctggggtgctgctgcgggcccccttcccctag

SEQ ID NO: 3048 - DNA, 1401 bp, Artificial Sequence
  Description of Artificial Sequence: Synthetic coding sequence
atggtgtcccaggccctgcggctgctgtgcctgctgctgggcctgcagggctgcctggccgccggcggcgtggccaaggccagcggcggggagacccgggacatgccctggaagccaggcccccaccgggtgtttgtgacccaggaggaggcccacggcgtgctgcacagaagaagaagagccaatgccttcctggaggagctgcggcccggcagcctggagcgggagtgcaaggaggagcagtgcagctttgaggaggcccgggagatcttcaaggatgctgagaggaccaagctgttctggatctcctacagtgatggagaccagtgtgccagcagcccctgccagaatggaggcagctgcaaggaccagctgcagagctacatctgcttctgcctgcctgcctttgagggcaggaactgtgagacccacaaggatgaccagctgatctgtgtgaatgaaaatggaggctgtgagcagtactgcagcgaccacacaggcaccaagaggagctgccgctgccacgagggctacagcctgctggctgatggagtgtcctgcacccccaccgtggagtacccctgtgggaagatccccatcctggagaagagaaatgccagcaagccccagggcagaattgtgggcggcaaggtgtgccccaagggagaatgtccctggcaggtgctgctgctggtgaatggagcccagctgtgtggcggcaccctcatcaacaccatctgggtggtgtctgctgcccactgctttgacaagatcaagaactggaggaacctgattgctgtgctgggggagcatgacctgtctgaacatgatggagatgagcagagcagaagagtggcccaggtgatcatccccagcacctacgtgcccggcaccaccaaccacgacatcgccctgctgcggctgcaccagcctgtggtgctgacagaccacgtggtgcccctgtgcctgcctgagaggaccttcagcgagaggaccctggcctttgtgcgcttcagcctggtgtctggctggggccagctgctggacagaggagccacagccctggagctgatggtgctgaatgtgccccggctgatgacccaggactgcctgcagcagagcaggaaggtgggggacagccccaacatcacagagtacatgttctgtgccggctacagtgatggcagcaaggacagctgcaagggggacagcggcggcccccacgccacccactaccggggcacctggtacctgactggaattgtgtcctggggccagggctgtgccaccgtgggccactttggagtgtacaccagggtgtcccagtacatcgagtggctgcagaagctgatgaggtctgagcccaggcctggggtgctgctgcgggcccccttcccctag

SEQ ID NO: 3049 - DNA, 1194 bp, Artificial Sequence
  Description of Artificial Sequence: Synthetic coding sequence
atgggaaatgtgaaccggcagggccagcactgccgggacttcatcatggtgtcccaggccctgcggctgctgtgcctgctgctgggcctgcagggctgcctggccgcagatggagaccagtgtgccagcagcccctgccagaatggaggcagctgcaaggaccagctgcagagctacatctgcttctgcctgcctgcctttgagggcaggaactgtgagacccacaaggatgaccagctgatctgtgtgaatgaaaatggaggctgtgagcagtactgcagcgaccacacaggcaccaagaggagctgccgctgccacgagggctacagcctgctggctgatggagtgtcctgcacccccaccgtggagtacccctgtgggaagatccccatcctggagaagagaaatgccagcaagccccagggccgcatcgtgggcggcaaggtgtgccccaagggggagtgcccctggcaggtgctgctgctggtgaatggagcccagctgtgtggcggcaccctcatcaacaccatctgggtggtgtctgctgcccactgctttgacaagatcaagaactggaggaacctgattgctgtgctgggggagcatgacctgtctgaacatgatggagatgagcagagccggcgggtggcccaggtgatcatccccagcacctacgtgcccggcaccaccaaccacgacatcgccctgctgcggctgcaccagcctgtggtgctgacagaccacgtggtgcccctgtgcctgcctgagaggaccttcagcgagaggaccctggcctttgtgcgcttcagcctggtgtctggctggggccagctgctggacagaggagccacagccctggagctgatggtgctgaatgtgccccggctgatgacccaggactgcctgcagcagagcaggaaggtgggggacagccccaacatcacagagtacatgttctgtgccggctacagtgatggcagcaaggacagctgcaagggggacagcggcggcccccacgccacccactaccggggcacctggtacctgaccggcatcgtgtcctggggccagggctgtgccaccgtgggccactttggagtgtacaccagggtgtcccagtacatcgagtggctgcagaagctgatgaggtctgagcccaggcctggggtgctgctgcgggcccccttcccctag

SEQ ID NO: 3050 - DNA, 651 bp, Artificial Sequence
  Description of Artificial Sequence: Synthetic coding sequence
atgaggatccaggaccccgggaaggtgttctttggaaatgtggacagcagcggcatcaagcacaacatcttcaacccccccatcatcgcccgctacatccggctgcaccccacccactacagcatccgcagcaccctgaggatggagctgatgggctgtgacctgaacagctgcagcatgcccctgggcatggagagcaaggccatcagtgatgcccagatcacagccagcagctacttcaccaacatgtttgccacctggagccccagcaaggcccggctgcacctgcagggccgcagcaatgcctggaggccccaggtgaacaaccccaaggagtggctgcaggtggacttccagaagaccatgaaggtgactggagtgaccacccagggcgtgaagagcctgctgacctccatgtatgtgaaggagttcctgatcagcagcagccaggacggccaccagtggaccctcttcttccagaatggcaaggtgaaggtgttccagggcaaccaggacagcttcacccctgtggtgaacagcctggacccccccctgctgacccgctacctgcgcatccacccccagagctgggtgcaccagatcgccctgaggatggaggtgctgggctgtgaggcccaggacctgtactag

SEQ ID NO: 3051 - DNA, 7056 bp, Artificial Sequence
  Description of Artificial Sequence: Synthetic coding sequence
atgcagatcgagctgagcacctgcttcttcctgtgcctgctgcgcttctgcttcagcgccacccggcgctactacctgggcgctgtggagctgtcctgggactacatgcagagcgacctgggggagctgcctgtggatgcccgcttccccccccgggtgcccaagagcttccccttcaacacctctgtggtgtacaagaagaccctgtttgtggagttcacagaccacctgttcaacatcgccaagcccaggcctccctggatgggcctgctgggccccaccatccaggccgaggtgtatgacacagtggtgatcaccctgaagaacatggccagccaccctgtgtccctgcatgctgtgggcgtgtcctactggaaggccagcgagggcgcagaatatgatgaccagaccagccagcgggagaaggaggatgacaaggtgtttcctgggggcagccacacctacgtgtggcaggtgctgaaggaaaatggccccatggccagtgaccccctgtgcctgacctacagctacctgagccacgtggacctggtgaaggacctgaacagcggcctcatcggggccctgctggtgtgccgggagggcagcctggccaaggagaagacccagaccctgcacaagttcatcctgctgtttgctgtgtttgatgagggcaagtcctggcacagcgagaccaagaacagcctgatgcaggacagagatgctgccagcgcccgggcctggcccaagatgcacacagtgaatggctacgtgaacagaagcctgcccggcctgattggctgccacaggaagtctgtgtactggcacgtgattggcatgggcaccaccccagaggtgcacagcatcttcctggagggccacaccttcctggtgaggaaccaccggcaggccagcctggagatcagccccatcaccttcctgacagcccagaccctgctgatggacctgggccagttcctgctcttctgccacatcagcagccaccagcatgatggcatggaggcctacgtgaaggtggacagctgcccagaggagccccagctgaggatgaagaacaatgaggaggctgaagattatgatgatgacctgacagacagcgagatggatgtggtgcgctttgatgatgacaacagccccagcttcatccagatccgctctgtggccaagaagcaccccaagacctgggtgcactacatcgctgctgaggaggaggactgggactatgcccccctggtgctggccccagatgacaggagctacaagagccagtacctgaacaacggcccccagagaattggaaggaagtacaagaaggtgcgcttcatggcctacacagatgagaccttcaagacccgggaggccatccagcatgaaagtggcatcctgggccccctgctgtatggagaggtgggggacaccctgctgatcatcttcaagaaccaggccagccggccctacaacatctacccccacggcatcacagatgtgcggcccctgtacagccggcggctgcccaagggcgtgaagcacctgaaggacttccccatcctgcccggggagatcttcaagtacaagtggacagtgacagtggaggatggccccaccaagagtgacccccgctgcctgacccgctactacagcagctttgtgaacatggagcgggacctggccagcggcctgattggccccctgctgatctgctacaaggagagcgtggaccagaggggcaaccagatcatgtctgacaagagaaatgtcatcctcttctctgtgtttgatgagaacagatcctggtacctgacagagaacatccagcgcttcctgcccaacccagctggggtgcagctggaggaccctgagttccaggccagcaacatcatgcacagcatcaatggctacgtgtttgacagcctgcagctgtctgtgtgcctgcacgaggtggcctactggtacatcctgagcattggagcccagacagacttcctgtctgtgttcttcagcggctacaccttcaagcacaagatggtgtatgaggacaccctgaccctcttccccttctctggagagaccgtcttcatgtccatggagaaccctggcctgtggatcctgggctgccacaacagcgacttcaggaacagaggcatgacagccctgctgaaggtgagcagctgtgacaagaacacaggagactactatgaagattcctatgaggacatcagcgcctacctgctgagcaagaacaatgccatcgagcccaggagcttcagccagaacagccgccaccccagcacccggcagaagcagttcaatgccaccaccatcccagaaaatgacatcgagaagacagacccctggtttgcccacaggacccccatgcccaagatccagaatgtgagcagcagtgacctgctgatgctgctgcggcagagccccaccccccacggcctgagcctgagtgacctgcaggaggccaagtatgagaccttcagtgatgaccccagccctggggccatcgacagcaacaacagcctgtctgagatgacccacttccggccccagctgcaccacagcggggacatggtgttcaccccagagagcggcctgcagctgcggctgaatgagaagctgggcaccacagctgccacagagctgaagaagctggacttcaaggtgagcagcaccagcaacaacctgatcagcaccatccccagcgacaacctggccgccggcacagacaacaccagcagcctgggccccccatccatgcctgtgcactatgacagccagctggacaccaccctgtttgggaagaagagcagccccctgacagaaagtggcggccccctgagcctgtctgaggagaacaatgacagcaagctgctggagagcggcctgatgaacagccaggagagctcctggggcaagaatgtgagcagcacagagagcggccgcctcttcaagggcaagagggcccacggccctgccctgctgaccaaggacaatgccctcttcaaggtgtccatcagcctgctgaagaccaacaagaccagcaacaacagcgccaccaacaggaagacccacattgatggccccagcctgctgattgagaacagccccagcgtgtggcagaacatcctggagagtgacacagagttcaagaaggtgacccccctcatccatgacaggatgctgatggacaagaatgccacagccctgcggctgaaccacatgagcaacaagaccaccagcagcaagaacatggagatggtgcagcagaagaaggagggccccatccccccagatgcccagaacccagacatgtccttcttcaagatgctgttcctgcctgagagcgcccgctggatccagaggacccacggcaagaacagcctgaacagcggccagggccccagccccaagcagctggtgtccctgggccctgagaagtctgtggagggccagaacttcctgtctgagaagaacaaggtggtggtgggcaaaggagagttcaccaaggatgtgggcctgaaggagatggtgttccccagcagcaggaacctcttcctgaccaacctggacaacctgcacgagaacaacacccacaaccaggagaagaagatccaggaggagattgagaagaaggagaccctcatccaggagaatgtggtgctgccccagatccacacagtgacaggcaccaagaacttcatgaagaacctcttcctgctgagcacccggcagaatgtggagggcagctatgatggagcctatgcccctgtgctgcaggacttccgcagcctgaatgacagcaccaacagaaccaagaagcacacagcccacttcagcaagaagggggaggaggagaacctggagggcctgggcaaccagaccaagcagatcgtggagaagtatgcctgcaccacccgcatcagccccaacaccagccagcagaactttgtgacccagaggagcaagagggccctgaagcagttccggctgcccctggaggagacagagctggagaagaggatcatcgtggatgacaccagcacccagtggagcaagaacatgaagcacctgacccccagcaccctgacccagattgactacaatgagaaggagaagggggccatcacccagagccccctgagtgactgcctgaccaggagccacagcatcccccaggccaacagaagccccctgcccatcgccaaggtgagcagcttccccagcatccggcccatctacctgaccagggtgctcttccaggacaacagcagccacctgcctgctgccagctacaggaagaaggacagcggcgtgcaggagagcagccacttcctgcagggcgccaagaagaacaacctgagcctggccatcctgaccctggagatgaccggggaccagcgggaggtgggcagcctgggcaccagcgccaccaacagcgtgacctacaagaaggtggagaacacagtgctgcccaagccagacctgcccaagaccagcggcaaggtggagctgctgcccaaggtgcacatctaccagaaggacctcttccccacagagaccagcaatggcagccctggccacctggacctggtggagggcagcctgctgcagggcacagagggcgccatcaagtggaatgaggccaacagacctgggaaggtgcccttcctgcgggtggccacagagagcagcgccaagacccccagcaagctgctggaccccctggcctgggacaaccactacggcacccagatccccaaggaggagtggaagagccaggagaagagccctgagaagacagccttcaagaagaaggacaccatcctgagcctgaatgcctgtgagagcaaccacgccatcgccgccatcaatgaaggccagaacaagccagaaattgaggtgacctgggccaagcagggccgcacagagcggctgtgcagccagaacccccctgtgctgaagaggcaccagcgggagatcaccaggaccaccctgcagagcgaccaggaggagattgattatgatgacaccatctctgtggagatgaagaaggaggactttgacatctatgatgaagatgagaaccagagccccaggagcttccagaagaagaccaggcactacttcatcgctgctgtggagcggctgtgggactatggcatgagcagcagcccccacgtgctgaggaacagagcccagagcggctctgtgccccagttcaagaaggtggtgttccaggagttcacagatggcagcttcacccagcccctgtacagaggagagctgaatgagcacctgggcctgctgggcccctacatccgggcagaggtggaggacaacatcatggtgaccttcaggaaccaggccagccggccctacagcttctacagcagcctcatctcctatgaggaggaccagaggcagggcgctgagcccaggaagaactttgtgaagcccaatgagaccaagacctacttctggaaggtgcagcaccacatggcccccaccaaggatgaatttgactgcaaggcctgggcctacttcagtgatgtggacctggagaaggatgtgcacagcggcctgattggccccctgctggtgtgccacaccaacaccctgaacccagcccacggccggcaggtgacagtgcaggagtttgccctcttcttcaccatctttgatgagaccaagtcctggtacttcacagagaacatggagaggaactgccgggccccctgcaacatccagatggaggaccccaccttcaaggagaactaccgcttccacgccatcaatggctacatcatggacaccctgcccggcctggtgatggcccaggaccagaggatccgctggtacctgctgtccatgggcagcaatgaaaacatccacagcatccacttcagcggccacgtgttcaccgtgaggaagaaggaggagtacaagatggccctgtacaacctgtacccaggagtgtttgagaccgtggagatgctgcccagcaaggccggcatctggagggtggagtgcctgattggagagcacctgcatgctggcatgagcaccctcttcctggtgtacagcaacaagtgccagacccccctgggcatggccagcggccacatccgggacttccagatcacagccagcggccagtatggccagtgggcccccaagctggcccggctgcactacagcggcagcatcaatgcctggagcaccaaggagcccttctcctggatcaaggtggacctgctggcccccatgatcatccacggcatcaagacccagggcgcccggcagaagttcagcagcctgtacatcagccagttcatcatcatgtacagcctggatggcaagaagtggcagacctaccggggcaacagcacaggcaccctgatggtgttctttggaaatgtggacagcagcggcatcaagcacaacatcttcaacccccccatcatcgcccgctacatccggctgcaccccacccactacagcatccgcagcaccctgaggatggagctgatgggctgtgacctgaacagctgcagcatgcccctgggcatggagagcaaggccatcagtgatgcccagatcacagccagcagctacttcaccaacatgtttgccacctggagccccagcaaggcccggctgcacctgcagggccgcagcaatgcctggaggccccaggtgaacaaccccaaggagtggctgcaggtggacttccagaagaccatgaaggtgactggagtgaccacccagggcgtgaagagcctgctgacctccatgtatgtgaaggagttcctgatcagcagcagccaggacggccaccagtggaccctcttcttccagaatggcaaggtgaaggtgttccagggcaaccaggacagcttcacccctgtggtgaacagcctggacccccccctgctgacccgctacctgcgcatccacccccagagctgggtgcaccagatcgccctgaggatggaggtgctgggctgtgaggcccaggacctgtactag

SEQ ID NO: 3052 - DNA, 999 bp, Artificial Sequence
  Description of Artificial Sequence: Synthetic coding sequence
atgggccggcccctgcacctggtgctgctgagcgccagcctggccggcctgctgctgctgggggagagcctcttcatcagaagagagcaggccaacaacatcctggcccgggtgacccgggccaacagcttcctggaggagatgaagaagggccacctggagcgggagtgcatggaggagacctgcagctatgaggaggcccgggaggtgtttgaggacagcgacaagaccaatgagttctggaacaagtacaaggatggagaccagtgtgagaccagcccctgccagaaccagggcaagtgcaaggatggcctgggggagtacacctgcacctgcctggagggctttgagggcaagaactgtgagctgttcaccaggaagctgtgcagcctggacaatggagactgtgaccagttctgccacgaggagcagaacagcgtggtgtgcagctgtgcccggggctacaccctggccgacaacgggaaggcctgcatccccaccggcccctacccctgtgggaagcagaccctggagaggaggaagaggtctgtggcccaggccaccagcagcagtggagaggccccagacagcatcacctggaagccctatgatgctgctgacctggaccccacagagaacccctttgacctgctggacttcaaccagacccagcctgagcggggggacaacaacctgaccagaattgtgggcggccaggagtgcaaggatggagaatgtccctggcaggccctgctgatcaatgaggagaatgaaggcttctgtggcggcaccatcctgtctgagttctacatcctgacagctgcccactgcctgtaccaggccaagcgcttcaagggcaccggcaccaggagcagaagaagagctgtgcggcgctgcacccgctggcgctggagcagcagcaccaccggcagccagaggcggcccatgaccagcaccagcccctgcagcggcagcaggcctcccagccccagcgcctag

SEQ ID NO: 3053 - DNA, 1467 bp, Artificial Sequence
  Description of Artificial Sequence: Synthetic coding sequence
atgggccggcccctgcacctggtgctgctgagcgccagcctggccggcctgctgctgctgggggagagcctcttcatcagaagagagcaggccaacaacatcctggcccgggtgacccgggccaacagcttcctggaggagatgaagaagggccacctggagcgggagtgcatggaggagacctgcagctatgaggaggcccgggaggtgtttgaggacagcgacaagaccaatgagttctggaacaagtacaaggatggagaccagtgtgagaccagcccctgccagaaccagggcaagtgcaaggatggcctgggggagtacacctgcacctgcctggagggctttgagggcaagaactgtgagctgttcaccaggaagctgtgcagcctggacaatggagactgtgaccagttctgccacgaggagcagaacagcgtggtgtgcagctgtgcccggggctacaccctggccgacaacgggaaggcctgcatccccaccggcccctacccctgtgggaagcagaccctggagaggaggaagaggtctgtggcccaggccaccagcagcagtggagaggccccagacagcatcacctggaagccctatgatgctgctgacctggaccccacagagaacccctttgacctgctggacttcaaccagacccagcctgagcggggggacaacaacctgaccagaattgtgggcggccaggagtgcaaggatggagaatgtccctggcaggccctgctgatcaatgaggagaatgaaggcttctgtggcggcaccatcctgtctgagttctacatcctgacagctgcccactgcctgtaccaggccaagcgcttcaaggtgcgggtgggggacaggaacacagagcaggaggagggcggggaggccgtgcatgaggtggaggtggtgatcaagcacaaccgcttcaccaaggagacctatgactttgatattgctgtgctgcggctgaagacccccatcaccttcaggatgaatgtggccccagcctgcctgcctgagcgggactgggccgagagcaccctgatgacccagaagacaggcatcgtgtctggcttcggccgcacccatgagaagggccggcagagcacccggctgaagatgctggaggtgccctacgtggacaggaacagctgcaagctgagcagcagcttcatcatcacccagaacatgttctgtgccggctatgacaccaagcaggaggatgcctgccagggcgacagcggcggcccccacgtgacccgcttcaaggacacctactttgtgacaggcatcgtgtcctggggcgagggctgtgccaggaagggcaagtatggcatctacaccaaggtgacagccttcctgaagtggattgaccgctccatgaagacccggggcctgcccaaggccaagagccacgcccctgaggtgatcaccagcagccccctgaagtag

SEQ ID NO: 3054 - DNA, 1005 bp, Artificial Sequence
  Description of Artificial Sequence: Synthetic coding sequence
atgggccggcccctgcacctggtgctgctgagcgccagcctggccggcctgctgctgctgggggagagcctcttcatcagaagagagcaggccaacaacatcctggcccgggtgacccgggccaacagcttcctggaggagatgaagaagggccacctggagcgggagtgcatggaggagacctgcagctatgaggaggcccgggaggtgtttgaggacagcgacaagaccaatgagttctggaacaagtacaaggatggagaccagtgtgagaccagcccctgccagaaccagggcaagtgcaaggatggcctgggggagtacacctgcacctgcctggagggctttgagggcaagaactgtgagctgttcaccaggaagctgtgcagcctggacaatggagactgtgaccagttctgccacgaggagcagaacagcgtggtgtgcagctgtgcccggggctacaccctggccgacaacgggaaggcctgcatccccaccggcccctacccctgtgggaagcagaccctggagaggaggaagaggtctgtggcccaggccaccagcagcagtggagaggccccagacagcatcacctggaagccctatgatgctgctgacctggaccccacagagaacccctttgacctgctggacttcaaccagacccagcctgagcggggggacaacaacctgaccagaattgtgggcggccaggagtgcaaggatggagaatgtccctggcaggccctgctgatcaatgaggagaatgaaggcttctgtggcggcaccatcctgtctgagttctacatcctgacagctgcccactgcctgtaccaggccaagcgcttcaaggtgcggggcaccggcaccaggagcagaagaagagctgtgcggcgctgcacccgctggcgctggagcagcagcaccaccggcagccagaggcggcccatgaccagcaccagcccctgcagcggcagcaggcctcccagccccagcgcctag

SEQ ID NO: 3055 - DNA, 1722 bp, Artificial Sequence
  Description of Artificial Sequence: Synthetic coding sequence
atgatcttcctgtaccaggtggtgcacttcatcctcttcacctctgtgtctggagaatgtgtgacccagctgctgaaggacacctgctttgagggcggggacatcaccaccgtcttcacccccagcgccaagtactgccaggtggtgtgcacctaccacccccgctgcctgctcttcaccttcaccgctgagagccccagcgaggaccccacccgctggttcacctgtgtgctgaaggacagcgtgacagagaccctgccccgggtgaacagaacagctgccatcagcggctacagcttcaagcagtgcagccaccagatctctgtgaacaacatctgcctgctgaagcacacccagacaggcacccccacccgcatcaccaagctggacaaggtggtgtctggcttcagcctgaagagctgtgccctgagcaacctggcctgcatccgggacatcttccccaacacagtgtttgctgacagcaacattgattctgtgatggccccagatgcctttgtgtgtggccgcatctgcacccaccaccctggctgcctcttcttcaccttcttcagccaggagtggcccaaggagagccagaggaacctgtgcctgctgaagaccagcgagagcggcctgcccagcacccgcatcaagaagagcaaggccctgagcggcttcagcctgcagagctgccgccacagcatccctgtgttctgccacagcagcttctaccatgacacagacttcctgggggaggagctggacatcgtggccgccaagagccatgaggcctgccagaagctgtgcaccaatgctgtgcgctgccagttcttcacctacaccccagcccaggccagctgcaatgaaggcaagggcaagtgctacctgaagctgagcagcaatggcagccccaccaagatcctgcacggccggggcggcatcagcggctacaccctgcggctgtgcaagatggacaatgaatgtaccaccaagatcaagccccgcatcgtgggcggcacagcctctgtgcggggggagtggccctggcaggtgaccctgcacaccaccagccccacccagaggcacctgtgtggcggcagcatcatcggcaaccagtggatcctgacagctgcccactgcttctacggcgtggagagccccaagatcctgcgggtgtacagcggcatcctgaaccagagcgagatcaaggaggacaccagcttctttggagtgcaggagatcatcatccatgaccagtacaagatggccgagagcggctatgacatcgccctgctgaagctggagaccaccgtgaactacacagacagccagaggcccatctgcctgcccagcaagggggacagaaatgtcatctacacagactgctgggtgacaggctggggctacaggaagctgcgggacaagatccagaacaccctgcagaaggccaagatccccctggtgaccaatgaggagtgccagaagcgctaccggggccacaagatcacccacaagatgatctgtgccggctaccgggagggcggcaaggatgcctgcaagggggacagcggcggccccctgagctgcaagcacaatgaggtgtggcacctggtgggcatcacctcctggggcgagggctgtgcccagcgggagaggcctggggtgtacaccaacgtggtggagtatgtggactggatcctggagaagacccaggccgtgtag

SEQ ID NO: 3056 - DNA, 1878 bp, Artificial Sequence
  Description of Artificial Sequence: Synthetic coding sequence
atgatcttcctgtaccaggtggtgcacttcatcctcttcacctctgtgtctggagaatgtgtgacccagctgctgaaggacacctgctttgagggcggggacatcaccaccgtcttcacccccagcgccaagtactgccaggtggtgtgcacctaccacccccgctgcctgctcttcaccttcaccgctgagagccccagcgaggaccccacccgctggttcacctgtgtgctgaaggacagcgtgacagagaccctgccccgggtgaacagaacagctgccatcagcggctacagcttcaagcagtgcagccaccagatcagcgcctgcaacaaggacatctacgtggacctggacatgaagggcatcaactacaacagctctgtggccaagagcgcccaggagtgccaggagcgctgcacagatgatgtgcactgccacttcttcacctacgccacccggcagttccccagcctggagcacaggaacatctgcctgctgaagcacacccagacaggcacccccacccgcatcaccaagctggacaaggtggtgtctggcttcagcctgaagagctgtgccctgagcaacctggcctgcatccgggacatcttccccaacacagtgtttgctgacagcaacattgattctgtgatggccccagatgcctttgtgtgtggccgcatctgcacccaccaccctggctgcctcttcttcaccttcttcagccaggagtggcccaaggagagccagaggaacctgtgcctgctgaagaccagcgagagcggcctgcccagcacccgcatcaagaagagcaaggccctgagcggcttcagcctgcagagctgccgccacagcatccctgtgttctgccacagcagcttctaccatgacacagacttcctgggggaggagctggacatcgtggccgccaagagccatgaggcctgccagaagctgtgcaccaatgctgtgcgctgccagttcttcacctacaccccagcccaggccagctgcaatgaaggcaagggcaagtgctacctgaagctgagcagcaatggcagccccaccaagatcctgcacggccggggcggcatcagcggctacaccctgcggctgtgcaagatggacaatgaatgtaccaccaagatcaagccccgcatcgtgggcggcacagcctctgtgcggggggagtggccctggcaggtgaccctgcacaccaccagccccacccagaggcacctgtgtggcggcagcatcatcggcaaccagtggatcctgacagctgcccactgcttctacggcgtggagagccccaagatcctgcgggtgtacagcggcatcctgaaccagagcgagatcaaggaggacaccagcttctttggagtgcaggagatcatcatccatgaccagtacaagatggccgagagcggctatgacatcgccctgctgaagctggagaccaccgtgaactacacagacagccagaggcccatctgcctgcccagcaagggggacagaaatgtcatctacacagactgctgggtgacaggctggggctacaggaagctgcgggacaagatccagaacaccctgcagaaggccaagatccccctggtgaccaatgaggagtgccagaagcgctaccggggccacaagatcacccacaagatgatctgtgccggctaccgggagggcggcaaggatgcctgcaagggggacagcggcggccccctgagctgcaagcacaatgaggtgtggcacctggtgggcatcacctcctggggcgagggctgtgcccagcgggagaggcctggggtgtacaccaacgtggtggagtatgtggactggatcctggagaagacccaggccgtgtag

SEQ ID NO: 3057 - DNA, 633 bp, Artificial Sequence
  Description of Artificial Sequence: Synthetic coding sequence
tgaagcggcttcagcctgaagagctgtgccctgagcaacctggcctgcatccgggacatcttccccaacacagtgtttgctgacagcaacattgattctgtgatggccccagatgcctttgtgtgtggccgcatctgcacccaccaccctggctgcctcttcttcaccttcttcagccaggagtggcccaaggagagccagaggaacctgtgcctgctgaagaccagcgagagcggcctgcccagcacccgcatcaagaagagcaaggccctgagcggcttcagcctgcagagctgccgccacagcatccctgtgttctgccacagcagcttctaccatgacacagacttcctgggggaggagctggacatcgtggccgccaagagccatgaggcctgccagaagctgtgcaccaatgctgtgcgctgccagttcttcacctacaccccagcccaggccagctgcaatgaaggcaagggcaagtgctacctgaagctgagcagcaatggcagccccaccaagatcctgcacggccggggcggcatcagcggctacaccctgcggctgtgcaagatggacaatgagctgcggggggcccccatgaagatcagcggctggctgaagaccagctag

SEQ ID NO: 3058 - DNA, 2199 bp, Artificial Sequence
  Description of Artificial Sequence: Synthetic coding sequence
atgtctgagaccagcaggacagcctttggaggccggcgggctgtgccccccaacaacagcaatgctgctgaagatgacctgcccaccgtggagctgcagggcgtggtgccccggggcgtgaacctgcaggagttcctgaatgtgacctctgtgcacctgttcaaggagcgctgggacaccaacaaggtggaccaccacacagacaagtatgagaacaacaagctgattgtgcggcggggccagagcttctacgtgcagattgacttcagccggccctatgacccccggcgggacctcttccgggtggagtatgtgattggccgctacccccaggagaacaagggcacctacatccctgtgcccatcgtgtctgagctgcagagcggcaagtggggcgccaagatcgtgatgagagaagatagatctgtgcggctgagcatccagagcagccccaagtgcatcgtgggcaagttcaggatgtatgtggccgtgtggaccccctacggcgtgctgcggaccagcagaaatcctgagacagacacctacatcctcttcaacccctggtgtgaagatgatgctgtgtacctggacaatgagaaggagcgggaggagtatgtgctgaatgacatcggggtcatcttctatggagaggtgaatgacatcaagaccaggtcctggagctatggccagtttgaagatggcatcctggacacctgcctgtatgtgatggaccgggcccagatggacctgagcggccggggcaaccccatcaaggtgtcccgggtgggcagcgccatggtgaatgccaaggatgatgagggcgtgctggtgggctcctgggacaacatctatgcctacggcgtgcccccatctgcctggacaggctctgtggacatcctgctggagtaccgcagcagtgaaaatcctgtgcgctatggccagtgctgggtgtttgctggggtcttcaacaccttcctgcgctgcctgggcatcccagccagaattgtgaccaactacttcagcgcccatgacaatgatgccaacctgcagatggacatcttcctggaggaggatggaaatgtgaacagcaagctgaccaaggacagcgtgtggaactaccactgctggaatgaggcctggatgaccaggccagacctgcctgtgggctttggaggctggcaggccgtggacagcaccccccaggagaacagtgatggcatgtaccgctgtggccctgcctctgtgcaggccatcaagcacggccacgtgtgcttccagtttgatgccccctttgtgtttgctgaggtgaacagcgacctgatctacatcacagccaagaaggatggcacccacgtggtggagaatgtggatgccacccacatcggcaagctgattgtgaccaagcagattggaggagatggcatgatggacatcacagacacctacaagttccaggagggccaggaggaggagcggctggccctggagacagccctgatgtatggagccaagaagcccctgaacacagaaggagtgatgaagagccgcagcaatgtggacatggactttgaggtggagaatgctgtgctgggcaaggacttcaagctgagcatcaccttcaggaacaacagccacaaccgctacaccatcacagcctacctgagcgccaacatcaccttctacacaggagtgcccaaggccgagttcaagaaggagacctttgatgtgaccctggagcccctgtccttcaagaaggaggccgtgctgatccaggccggggagtacatgggccagctgctggagcaggccagcctgcacttctttgtgacagcccgcatcaatgagaccagagatgtgctggccaagcagaagagcacagtgctgaccatccctgagatcatcatcaaggtgcggggcacccaggtggtgggcagtgacatgacagtgacagtggagttcaccaaccccctgaaggagaccctgagaaatgtgtgggtgcacctggatggccctggggtgacccggcccatgaagaagatgttccgggagatccggcccaacagcacagtgcagtgggaggaggtgtgccggccctgggtgtctggccacaggaagctgattgcctccatgagcagtgacagcctgcggcacgtgtatggagagctggatgtgcagatccagaggcggcccagcatgtag

SEQ ID NO: 3059 - DNA, 417 bp, Artificial Sequence
  Description of Artificial Sequence: Synthetic coding sequence
atgtctgagaccagcaggacagcctttggaggccggcgggctgtgccccccaacaacagcaatgctgctgaagatgacctgcccaccgtggagctgcagggcgtggtgccccggggcgtgaacctgcaggagttcctgaatgtgacctctgtgcacctgttcaaggagcgctgggacaccaacaaggtggaccaccacacagacaagtatgagaacaacaagctgattgtgcggcggggccagagcttctacgtgcagattgacttcagccggccctatgacccccggcgggacctcttccgggtggagtatgtgattggccgctacccccaggagaacaagggcacctacatccctgtgcccatcgtgtctgagctgcagagcggcaagtggggcgccaagatcgtgatgaggtag

SEQ ID NO: 3060 - DNA, 1881 bp, Artificial Sequence
  Description of Artificial Sequence: Synthetic coding sequence
atgtctgagaccagcaggacagcctttggaggccggcgggctgtgccccccaacaacagcaatgctgctgaagatgacctgcccaccgtggagctgcagggcgtggtgccccggggcgtgaacctgcagggccgctacccccaggagaacaagggcacctacatccctgtgcccatcgtgtctgagctgcagagcggcaagtggggcgccaagatcgtgatgagggaggacagatctgtgcggctgagcatccagagcagccccaagtgcatcgtgggcaagttcaggatgtatgtggccgtgtggaccccctatggagtgctgcggaccagcaggaaccctgagacagacacctacatcctcttcaacccctggtgtgaagatgatgctgtgtacctggacaatgagaaggagcgggaggagtatgtgctgaatgacattggagtcatcttctacggggaggtgaatgacatcaagaccaggtcctggagctatggccagtttgaagatggcatcctggacacctgcctgtatgtgatggaccgggcccagatggacctgagcggccggggcaaccccatcaaggtgtcccgggtgggcagcgccatggtgaatgccaaggatgatgaaggagtgctggtgggctcctgggacaacatctatgcctatggagtgccccccagcgcctggacaggctctgtggacatcctgctggagtaccgcagcagcgagaaccctgtgcgctatggccagtgctgggtgtttgctggggtcttcaacaccttcctgcgctgcctgggcatcccagcccgcatcgtgaccaactacttcagcgcccatgacaatgatgccaacctgcagatggacatcttcctggaggaggatggaaatgtgaacagcaagctgaccaaggacagcgtgtggaactaccactgctggaatgaggcctggatgaccaggccagacctgcctgtgggctttggaggctggcaggccgtggacagcaccccccaggagaacagtgatggcatgtaccgctgtggccctgcctctgtgcaggccatcaagcacggccacgtgtgcttccagtttgatgccccctttgtgtttgctgaggtgaacagcgacctgatctacatcacagccaagaaggatggcacccacgtggtggagaatgtggatgccacccacatcggcaagctgattgtgaccaagcagattggaggagatggcatgatggacatcacagacacctacaagttccaggagggccaggaggaggagcggctggccctggagacagccctgatgtacggggccaagaagcccctgaacacagagggcgtgatgaagagccgcagcaatgtggacatggactttgaggtggagaatgctgtgctgggcaaggacttcaagctgagcatcaccttcaggaacaacagccacaaccgctacaccatcacagcctacctgagcgccaacatcaccttctacacaggagtgcccaaggccgagttcaagaaggagacctttgatgtgaccctggagcccctgtccttcaagaaggaggccgtgctgatccaggccggggagtacatgggccagctgctggagcaggccagcctgcacttctttgtgacagcccgcatcaatgagaccagagatgtgctggccaagcagaagagcacagtgctgaccatccctgagatcatcatcaaggtgcggggcacccaggtggtgggcagtgacatgacagtgacagaggtgtgccggccctgggtgtctggccacaggaagctgattgcctccatgagcagtgacagcctgcggcacgtgtatggagagctggatgtgcagatccagaggcggcccagcatgtag

SEQ ID NO: 3061 - DNA, 8835 bp, Artificial Sequence
  Description of Artificial Sequence: Synthetic coding sequence
atgaccctgcggctgctggtggccgccctgtgtgccggcatcctggccgaggccccccgggtgcgggcccagcaccgggagcgggtgacctgcacccggctgtatgctgctgacatcgtgttcctgctggatggcagcagcagcatcggccgcagcaacttccgggaggtgcgctccttcctggagggcctggtgctgcccttctctggagctgccagcgcccagggcgtgcgctttgccaccgtgcagtacagtgatgaccccaggacagaatttggcctggatgccctgggcagcggaggagatgtgatccgggccatccgggagctgagctacaagggcggcaacaccaggactggagctgccatcctgcacgtggccgaccacgtgttcctgccccagctggcccggcctggggtgcccaaggtgtgcatcctgatcacagatggcaagagccaggacctggtggacacagctgcccagaggctgaagggccagggcgtgaagctgtttgctgtgggcatcaagaatgctgaccctgaggagctgaagagggtggccagccagcccaccagtgacttcttcttctttgtgaatgacttcagcatcctgcggaccctgctgcccctggtgtccagaagagtgtgcaccacagctggaggagtgcctgtgacccggcccccagatgacagcaccagcgccccccgggacctggtgctgtctgagcccagcagccagagcctgcgggtgcagtggacagctgccagcggccctgtgacaggctacaaggtgcagtacacccccctgaccggcctgggccagcccctgcccagcgagcggcaggaggtgaatgtgcctgctggggagacctctgtgcggctgcggggcctgcggcccctgacagagtaccaggtgaccgtcatcgccctgtatgccaacagcattggagaggccgtgtctggaacagcccggaccacagccctggagggccctgagctgaccatccagaacaccacagcccacagcctgctggtggcctggaggtctgtgcctggggccaccggctacagagtgacctggagggtgctgagcggcggccccacccagcagcaggagctgggccctggccagggctctgtgctgctgcgggacctggagcctggaacagattatgaggtgacagtgtccaccctgtttggccgctctgtgggccctgccaccagcctgatggccaggacagatgcctctgtggagcagaccctgcggcctgtgatcctgggccccaccagcatcctgctgtcctggaacctggtgcctgaggcccggggctaccgcctggagtggaggcgggagaccggcctggagcccccccagaaggtggtgctgcccagtgatgtgacccgctaccagctggatggcctgcagcccggcacagagtaccgcctgaccctgtacaccctgctggagggccacgaggtggccaccccagccaccgtggtgcccaccggccctgagctgcctgtgtcccctgtgacagacctgcaggccacagagctgcccggccagagggtgcgggtgtcctggagccctgtgcctggggccacccagtaccgcatcatcgtgcgcagcacccagggcgtggagaggaccctggtgctgcccggcagccagacagcctttgacctggatgatgtgcaggccggcctgagctacacagtgcgggtgtctgcccgggtgggcccccgggagggcagcgcctctgtgctgactgtgcggcgggagcctgagacccccctggccgtgcccggcctgcgggtggtggtgtctgatgccaccagggtgcgggtggcctggggccctgtgcctggggccagcggcttccgcatctcctggagcactggaagtggccctgagagcagccagaccctgcccccagacagcacagccacagacatcaccggcctgcagcccggcaccacctaccaggtggccgtgtctgtgctgcggggccgggaggagggccctgctgctgtgattgtggccaggacagaccccctgggccctgtgaggacagtgcacgtgacccaggccagcagcagctctgtgaccatcacctggaccagggtgcctggggccaccggctacagagtgtcctggcacagcgcccacggccctgagaagagccagctggtgtctggagaggccaccgtggccgagctggatggcctggagccagacacagagtacacagtgcacgtgcgggcccacgtggccggcgtggatggccccccagcctctgtggtggtgaggacagcccctgagcctgtgggccgggtgtcccggctgcagatcctgaatgccagcagtgatgtgctgcgcatcacctgggtgggcgtgactggagccacagcctaccgcctggcctggggccgctctgagggcggccccatgaggcaccagatcctgcccggcaacacagacagcgctgagatccggggcctggagggcggcgtgtcctacagcgtgcgggtgacagccctggtgggggaccgggagggcacccctgtgtccatcgtggtgaccaccccacctgaggcccccccagccctgggcaccctgcacgtggtgcagagaggagagcacagcctgcggctgcgctgggagcctgtgccccgggcccagggcttcctgctgcactggcagcctgagggcggccaggagcagagccgggtgctgggccctgagctgagcagctaccacctggatggcctggagcccgccacccagtacagagtgcggctgtctgtgctgggccctgctggggagggccccagcgctgaggtgacagccaggacagagagcccccgggtgcccagcattgagctgcgggtggtggacaccagcattgattctgtgaccctggcctggacccctgtgtcccgggccagcagctacatcctgtcctggaggcccctgcggggccctggccaggaggtgcccggcagcccccagaccctgcccggcatcagcagcagccagagggtgacaggcctggagcccggggtgtcctacatcttcagcctgacccctgtgctggatggagtgcggggccctgaggcctctgtgacccagacccctgtgtgcccccggggcctggctgatgtggtgttcctgccccacgccacccaggacaatgcccacagagctgaggccaccaggagagtgctggagcggctggtgctggccctgggccccctgggcccccaggccgtgcaggtgggcctgctgagctacagccaccggcccagccccctcttccccctgaatggcagccatgacctgggcatcatcctgcagaggatccgggacatgccctacatggaccccagcggcaacaacctgggcacagctgtggtgacagcccaccgctacatgctggccccagatgcccctggaagacggcagcacgtgcctggggtgatggtgctgctggtggatgagcccctgcggggggacatcttcagccccatccgggaggcccaggccagcggcctgaatgtggtgatgctgggcatggccggggctgaccctgagcagctgcggcggctggcccctggcatggattctgtgcagaccttctttgctgtggatgatggccccagcctggaccaggccgtgtctggcctggccacagccctgtgccaggccagcttcaccacccagcccaggcctgagccctgccctgtgtactgccccaagggccagaagggggagcctggagagatgggcctgcggggccaggtgggccccccaggggaccccggcctgcccggccgcactggagcccctggcccccagggccccccaggcagcgccacagccaagggggagcggggcttccctggagcagatggccggcccggcagccctggccgggccggcaaccctggcacccctggggcccctggcctgaagggcagccctggcctgcccggccccaggggggaccctggagagcggggcccccggggccccaagggggagcccggggcccctggccaggtgattggaggagagggccctggcctgcccggcaggaaaggagaccccggccccagcggccccccaggcccccggggccccctgggggaccccggcccccggggccccccaggcctgcccggcacagccatgaagggggacaagggggacagaggagagcggggccccccaggccctggagagggcggcatcgcccctggagagcccggcctgcccggcctgcccggcagccctggcccccagggccctgtgggccccccaggcaagaagggggagaagggggacagtgaagatggagcccctggcctgcccggccagcccggcagccctggagagcagggcccccggggccccccaggggccatcggccccaagggggaccggggcttccctggccccctgggggaggccggggagaagggggagcggggccccccaggccctgctggcagccggggcctgcccggggtggccggccggcctggggccaagggccctgagggccccccaggccccaccggccggcagggcgagaagggggagcccggccggcctggggaccctgctgtggtgggccctgctgtggccggccccaagggggagaagggagatgtgggccctgctggccccaggggggccaccggggtgcagggcgagcggggccccccaggcctggtgctgcccggggaccccggccccaagggggaccccggggaccggggccccatcggcctgaccggccgggccggccccccaggggacagcggccccccaggagagaagggggaccccggccggcccggccccccaggccctgtgggcccccggggcagagatggagaggtgggggagaagggagatgagggccccccaggggaccccggcctgcccgggaaggccggggagcggggcctgcggggggcccctggggtgcggggccctgtgggggagaagggggaccagggcgaccccggggaggatggaagaaatggcagccctggcagcagcggccccaagggggacagaggagagcccggccccccaggccccccaggccgcctggtggacaccggccctggggcccgggagaagggggagcccggggaccggggccaggagggcccccggggccccaagggggaccccggcctgcccggggcccctggagagcggggcatcgagggcttccggggccccccaggcccccagggcgaccccggggtgcggggccctgctggggagaagggggaccggggccccccaggcctggatggccgcagcggcctggatggcaagccaggagctgctggccccagcggccccaacggggctgctgggaaggccggggaccccggcagagatggcctgcccggcctgcggggggagcagggcctgcccggccccagcggccccccaggcctgcccgggaagccaggagaagatggcaagccaggcctgaatggcaagaatggagagcccggggaccccggggaggatggcaggaagggggagaagggggacagcggggccagcggccgggagggcagagatggccccaagggggagcggggggcccctggcatcctgggcccccagggccccccaggcctgcccggccctgtgggccccccaggccagggcttccctggggtgcctgggggcaccggccccaagggggacagaggagagaccggcagcaaaggagagcagggcctgcctggagagcggggcctgcggggggagcccggctctgtgcccaacgtggaccggctgctggagacagctggcatcaaggccagcgccctgcgggagatcgtggagacctgggatgagagcagcggcagcttcctgcctgtgcctgagaggagaagaggccccaagggggacagcggggagcagggccccccaggcaaggagggccccatcggcttccctggagagcggggcctgaagggggacagaggagaccccggcccccagggccccccaggcctggccctgggggagcggggccccccaggccccagcggcctggccggggagcccgggaagccaggcatccctggcctgcccggccgggccggcggcgtgggggaggccggccggcctggagagcggggggagcggggggagaagggggagcggggggagcagggcagagatggccccccaggcctgcccggcaccccaggccccccaggccccccaggccccaaggtgtctgtggatgagcccggccctggcctgagcggggagcagggccccccaggcctgaagggggccaagggggagcccggcagcaatggagaccagggccccaagggggaccggggcgtgcccggcatcaagggggacagaggagagcccggcccccggggccaggacggcaaccctggcctgcctggagagcggggcatggccggccctgagggcaagccaggcctgcagggcccccggggccccccaggccctgtgggcggccacggggaccccggccccccaggggcccctggcctggccggccctgctggcccccagggccccagcggcctgaagggggagcctggagagaccggccccccaggccggggcctgaccggccccactggagctgtgggcctgcccggccccccaggccccagcggcctggtgggcccccagggcagccctggcctgcccggccaggtgggggagaccgggaagccaggggcccctggaagagatggagccagcggcaaggatggagaccggggcagccctggggtgcccggcagccctggcctgcccggccctgtgggccccaagggggagcccggccccactggagcccctggccaggccgtggtgggcctgcccggggccaagggggagaagggggcccctgggggcctggccggggacctggtgggggagcccggggccaagggggaccggggcctgcccggccccagaggagagaagggggaggccggccgggccggggagcccggggaccctggagaagatggccagaagggggcccctggccccaagggcttcaagggggaccccggggtgggcgtgcccggcagccctggccccccaggccccccaggagtgaagggggacctgggcctgcccggcctgcccggggcccctggggtggtgggcttccctggccagacaggccccagaggagagatgggccagcccggccccagcggggagcggggcctggccggccccccaggccgggagggcatccctggccccctgggccccccaggccccccaggctctgtgggccccccaggggccagcggcctgaagggggacaagggggaccccggggtgggcctgcccggccccagaggagagcggggggagcccggcatccggggggaggatggccggcccggccaggagggcccccggggcctgactggacctcctggcagcagaggagagcggggggagaagggagatgtgggcagcgctggcctgaagggggacaagggggacagcgctgtgatcctgggccccccaggccccaggggggccaagggggacatgggagagcggggcccccggggcctggatggagacaagggccccaggggggacaacggggaccccggggacaagggcagcaaaggagagcccggggacaagggcagcgctggcctgcccggcctgcggggcctgctgggcccccagggccagcctggagctgctggcatccctggggaccccggcagccctgggaaggatggagtgcccggcatccggggggagaagggagatgtgggcttcatgggcccccggggcctgaagggggagcggggcgtgaagggggcctgtggcctggatggagagaagggggacaagggggaggccggccccccaggccggcccggcctggccggccacaagggggagatgggagagcccggggtgcccggccagagcggggcccctgggaaggagggcctgattggccccaagggggaccggggctttgatggccagcccggccccaagggggaccagggcgagaagggggagcggggcaccccaggcatcggcggcttccctggccccagcggaaatgatggcagcgctggccccccaggccccccaggctctgtgggcccccggggccctgagggcctgcagggccagaagggggagcggggccccccaggagagcgggtggtgggcgcccctggggtgcctggggcccctggagagcggggggagcagggccggcccggccctgctggccccagaggagagaagggggaggccgccctgacagaagatgacatccggggctttgtgcggcaggagatgagccagcactgtgcctgccagggccagttcatcgccagcggcagccggcccctgcccagctatgctgctgacacagctggcagccagctgcatgctgtgcctgtgctgcgggtgtcccatgctgaggaggaggagcgggtgcccccagaagatgatgagtacagcgagtacagcgagtacagcgtggaggagtaccaggaccctgaggccccctgggacagtgatgacccctgcagcctgcccctggatgagggcagctgcacagcctacaccctgcgctggtaccacagagctgtgacaggcagcacagaggcctgccacccctttgtgtatggaggctgcggcggcaatgccaacagatttggcacccgggaggcctgtgaaagacgctgccccccccgggtggtgcagagccagggcactggaacagcccaggactag

SEQ ID NO: 3062 - DNA, 8739 bp, Artificial Sequence
  Description of Artificial Sequence: Synthetic coding sequence
atgaccctgcggctgctggtggccgccctgtgtgccggcatcctggccgaggccccccgggtgcgggcccagcaccgggagcgggtgacctgcacccggctgtatgctgctgacatcgtgttcctgctggatggcagcagcagcatcggccgcagcaacttccgggaggtgcgctccttcctggagggcctggtgctgcccttctctggagctgccagcgcccagggcgtgcgctttgccaccgtgcagtacagtgatgaccccaggacagaatttggcctggatgccctgggcagcggaggagatgtgatccgggccatccgggagctgagctacaagggcggcaacaccaggactggagctgccatcctgcacgtggccgaccacgtgttcctgccccagctggcccggcctggggtgcccaaggtgtgcatcctgatcacagatggcaagagccaggacctggtggacacagctgcccagaggctgaagggccagggcgtgaagctgtttgctgtgggcatcaagaatgctgaccctgaggagctgaagagggtggccagccagcccaccagtgacttcttcttctttgtgaatgacttcagcatcctgcggaccctgctgcccctggtgtccagaagagtgtgcaccacagctggaggagtgcctgtgacccggcccccagatgacagcaccagcgccccccgggacctggtgctgtctgagcccagcagccagagcctgcgggtgcagtggacagctgccagcggccctgtgacaggctacaaggtgcagtacacccccctgaccggcctgggccagcccctgcccagcgagcggcaggaggtgaatgtgcctgctggggagacctctgtgcggctgcggggcctgcggcccctgacagagtaccaggtgaccgtcatcgccctgtatgccaacagcattggagaggccgtgtctggaacagcccggaccacagccctggagggccctgagctgaccatccagaacaccacagcccacagcctgctggtggcctggaggtctgtgcctggggccaccggctacagagtgacctggagggtgctgagcggcggccccacccagcagcaggagctgggccctggccagggctctgtgctgctgcgggacctggagcctggaacagattatgaggtgacagtgtccaccctgtttggccgctctgtgggccctgccaccagcctgatggccaggacagatgcctctgtggagcagaccctgcggcctgtgatcctgggccccaccagcatcctgctgtcctggaacctggtgcctgaggcccggggctaccgcctggagtggaggcgggagaccggcctggagcccccccagaaggtggtgctgcccagtgatgtgacccgctaccagctggatggcctgcagcccggcacagagtaccgcctgaccctgtacaccctgctggagggccacgaggtggccaccccagccaccgtggtgcccaccggccctgagctgcctgtgtcccctgtgacagacctgcaggccacagagctgcccggccagagggtgcgggtgtcctggagccctgtgcctggggccacccagtaccgcatcatcgtgcgcagcacccagggcgtggagaggaccctggtgctgcccggcagccagacagcctttgacctggatgatgtgcaggccggcctgagctacacagtgcgggtgtctgcccgggtgggcccccgggagggcagcgcctctgtgctgactgtgcggcgggagcctgagacccccctggccgtgcccggcctgcgggtggtggtgtctgatgccaccagggtgcgggtggcctggggccctgtgcctggggccagcggcttccgcatctcctggagcactggaagtggccctgagagcagccagaccctgcccccagacagcacagccacagacatcaccggcctgcagcccggcaccacctaccaggtggccgtgtctgtgctgcggggccgggaggagggccctgctgctgtgattgtggccaggacagaccccctgggccctgtgaggacagtgcacgtgacccaggccagcagcagctctgtgaccatcacctggaccagggtgcctggggccaccggctacagagtgtcctggcacagcgcccacggccctgagaagagccagctggtgtctggagaggccaccgtggccgagctggatggcctggagccagacacagagtacacagtgcacgtgcgggcccacgtggccggcgtggatggccccccagcctctgtggtggtgaggacagcccctgagcctgtgggccgggtgtcccggctgcagatcctgaatgccagcagtgatgtgctgcgcatcacctgggtgggcgtgactggagccacagcctaccgcctggcctggggccgctctgagggcggccccatgaggcaccagatcctgcccggcaacacagacagcgctgagatccggggcctggagggcggcgtgtcctacagcgtgcgggtgacagccctggtgggggaccgggagggcacccctgtgtccatcgtggtgaccaccccacctgaggcccccccagccctgggcaccctgcacgtggtgcagagaggagagcacagcctgcggctgcgctgggagcctgtgccccgggcccagggcttcctgctgcactggcagcctgagggcggccaggagcagagccgggtgctgggccctgagctgagcagctaccacctggatggcctggagcccgccacccagtacagagtgcggctgtctgtgctgggccctgctggggagggccccagcgctgaggtgacagccaggacagagagcccccgggtgcccagcattgagctgcgggtggtggacaccagcattgattctgtgaccctggcctggacccctgtgtcccgggccagcagctacatcctgtcctggaggcccctgcggggccctggccaggaggtgcccggcagcccccagaccctgcccggcatcagcagcagccagagggtgacaggcctggagcccggggtgtcctacatcttcagcctgacccctgtgctggatggagtgcggggccctgaggcctctgtgacccagacccctgtgtgcccccggggcctggctgatgtggtgttcctgccccacgccacccaggacaatgcccacagagctgaggccaccaggagagtgctggagcggctggtgctggccctgggccccctgggcccccaggccgtgcaggtgggcctgctgagctacagccaccggcccagccccctcttccccctgaatggcagccatgacctgggcatcatcctgcagaggatccgggacatgccctacatggaccccagcggcaacaacctgggcacagctgtggtgacagcccaccgctacatgctggccccagatgcccctggaagacggcagcacgtgcctggggtgatggtgctgctggtggatgagcccctgcggggggacatcttcagccccatccgggaggcccaggccagcggcctgaatgtggtgatgctgggcatggccggggctgaccctgagcagctgcggcggctggcccctggcatggattctgtgcagaccttctttgctgtggatgatggccccagcctggaccaggccgtgtctggcctggccacagccctgtgccaggccagcttcaccacccagcccaggcctgagccctgccctgtgtactgccccaagggccagaagggggagcctggagagatgggcctgcggggccaggtgggccccccaggggaccccggcctgcccggccgcactggagcccctggcccccagggccccccaggcagcgccacagccaagggggagcggggcttccctggagcagatggccggcccggcagccctggccgggccggcaaccctggcacccctggggcccctggcctgaagggcagccctggcctgcccggccccaggggggaccctggagagcggggcccccggggccccaagggggagcccggggcccctggccaggtgattggaggagagggccctggcctgcccggcaggaaaggagaccccggccccagcggccccccaggcccccggggccccctgggggaccccggcccccggggccccccaggcctgcccggcacagccatgaagggggacaagggggacagaggagagcggggccccccaggccctggagagggcggcatcgcccctggagagcccggcctgcccggcctgcccggcagccctggcccccagggccctgtgggccccccaggcaagaagggggagaagggggacagtgaagatggagcccctggcctgcccggccagcccggcagccctggagagcagggcccccggggccccccaggggccatcggccccaagggggaccggggcttccctggccccctgggggaggccggggagaagggggagcggggccccccaggccctgctggcagccggggcctgcccggggtggccggccggcctggggccaagggccctgagggccccccaggccccaccggccggcagggcgagaagggggagcccggccggcctggggaccctgctgtggtgggccctgctgtggccggccccaagggggagaagggagatgtgggccctgctggccccaggggggccaccggggtgcagggcgagcggggccccccaggcctggtgctgcccggggaccccggccccaagggggaccccggggaccggggccccatcggcctgaccggccgggccggccccccaggggacagcggccccccaggagagaagggggaccccggccggcccggccccccaggccctgtgggcccccggggcagagatggagaggtgggggagaagggagatgagggccccccaggggaccccggcctgcccgggaaggccggggagcggggcctgcggggggcccctggggtgcggggccctgtgggggagaagggggaccagggcgaccccggggaggatggaagaaatggcagccctggcagcagcggccccaagggggacagaggagagcccggccccccaggccccccaggccgcctggtggacaccggccctggggcccgggagaagggggagcccggggaccggggccaggagggcccccggggccccaagggggaccccggcctgcccggggcccctggagagcggggcatcgagggcttccggggccccccaggcccccagggcgaccccggggtgcggggccctgctggggagaagggggaccggggccccccaggcctggatggccgcagcggcctggatggcaagccaggagctgctggccccagcggccccaacggggctgctgggaaggccggggaccccggcagagatggcctgcccggcctgcggggggagcagggcctgcccggccccagcggccccccaggcctgcccgggaagccaggagaagatggcaagccaggcctgaatggcaagaatggagagcccggggaccccggggaggatggcaggaagggggagaagggggacagcggggccagcggccgggagggcttccctggggtgcctgggggcaccggccccaagggggacagaggagagaccggcagcaaaggagagcagggcctgcctggagagcggggcctgcggggggagcccggctctgtgcccaacgtggaccggctgctggagacagctggcatcaaggccagcgccctgcgggagatcgtggagacctgggatgagagcagcggcagcttcctgcctgtgcctgagaggagaagaggccccaagggggacagcggggagcagggccccccaggcaaggagggccccatcggcttccctggagagcggggcctgaagggggacagaggagaccccggcccccagggccccccaggcctggccctgggggagcggggccccccaggccccagcggcctggccggggagcccgggaagccaggcatccctggcctgcccggccgggccggcggcgtgggggaggccggccggcctggagagcggggggagcggggggagaagggggagcggggggagcagggcagagatggccccccaggcctgcccggcaccccaggccccccaggccccccaggccccaaggtgtctgtggatgagcccggccctggcctgagcggggagcagggccccccaggcctgaagggggccaagggggagcccggcagcaatggagaccagggccccaagggggaccggggcgtgcccggcatcaagggggacagaggagagcccggcccccggggccaggacggcaaccctggcctgcctggagagcggggcatggccggccctgagggcaagccaggcctgcagggcccccggggccccccaggccctgtgggcggccacggggaccccggccccccaggggcccctggcctggccggccctgctggcccccagggccccagcggcctgaagggggagcctggagagaccggccccccaggccggggcctgaccggccccactggagctgtgggcctgcccggccccccaggccccagcggcctggtgggcccccagggcagccctggcctgcccggccaggtgggggagaccgggaagccaggggcccctggaagagatggagccagcggcaaggatggagaccggggcagccctggggtgcccggcagccctggcctgcccggccctgtgggccccaagggggagcccggccccactggagcccctggccaggccgtggtgggcctgcccggggccaagggggagaagggggcccctgggggcctggccggggacctggtgggggagcccggggccaagggggaccggggcctgcccggccccagaggagagaagggggaggccggccgggccggggagcccggggaccctggagaagatggccagaagggggcccctggccccaagggcttcaagggggaccccggggtgggcgtgcccggcagccctggccccccaggccccccaggagtgaagggggacctgggcctgcccggcctgcccggggcccctggggtggtgggcttccctggccagacaggccccagaggagagatgggccagcccggccccagcggggagcggggcctggccggccccccaggccgggagggcatccctggccccctgggccccccaggccccccaggctctgtgggccccccaggggccagcggcctgaagggggacaagggggaccccggggtgggcctgcccggccccagaggagagcggggggagcccggcatccggggggaggatggccggcccggccaggagggcccccggggcctgactggacctcctggcagcagaggagagcggggggagaagggagatgtgggcagcgctggcctgaagggggacaagggggacagcgctgtgatcctgggccccccaggccccaggggggccaagggggacatgggagagcggggcccccggggcctggatggagacaagggccccaggggggacaacggggaccccggggacaagggcagcaaaggagagcccggggacaagggcagcgctggcctgcccggcctgcggggcctgctgggcccccagggccagcctggagctgctggcatccctggggaccccggcagccctgggaaggatggagtgcccggcatccggggggagaagggagatgtgggcttcatgggcccccggggcctgaagggggagcggggcgtgaagggggcctgtggcctggatggagagaagggggacaagggggaggccggccccccaggccggcccggcctggccggccacaagggggagatgggagagcccggggtgcccggccagagcggggcccctgggaaggagggcctgattggccccaagggggaccggggctttgatggccagcccggccccaagggggaccagggcgagaagggggagcggggcaccccaggcatcggcggcttccctggccccagcggaaatgatggcagcgctggccccccaggccccccaggctctgtgggcccccggggccctgagggcctgcagggccagaagggggagcggggccccccaggagagcgggtggtgggcgcccctggggtgcctggggcccctggagagcggggggagcagggccggcccggccctgctggccccagaggagagaagggggaggccgccctgacagaagatgacatccggggctttgtgcggcaggagatgagccagcactgtgcctgccagggccagttcatcgccagcggcagccggcccctgcccagctatgctgctgacacagctggcagccagctgcatgctgtgcctgtgctgcgggtgtcccatgctgaggaggaggagcgggtgcccccagaagatgatgagtacagcgagtacagcgagtacagcgtggaggagtaccaggaccctgaggccccctgggacagtgatgacccctgcagcctgcccctggatgagggcagctgcacagcctacaccctgcgctggtaccacagagctgtgacaggcagcacagaggcctgccacccctttgtgtatggaggctgcggcggcaatgccaacagatttggcacccgggaggcctgtgaaagacgctgccccccccgggtggtgcagagccagggcactggaacagcccaggactag

SEQ ID NO: 3063 - DNA, 435 bp, Artificial Sequence
  Description of Artificial Sequence: Synthetic coding sequence
atgtggctgcagagcctgctgctgctgggcaccgtggcctgcagcatcagcgccccagcccggagccccagccccagcacccagccctgggagcacgtgaatgccatccaggaggcccggcggctgctgaacctgagccgggacacagctgctgagatgaatgagaccgtggaggtgatcagcgagatgtttgacctgcaggagcccacctgcctgcagacccggctggagctgtacaagcagggcctgcggggcagcctgaccaagctgaagggccccctgaccatgatggccagccactacaagcagcactgcccccccaccccagagaccagctgtgccacccagatcatcacctttgagagcttcaaggagaacctgaaggacttcctgctggtgatcccctttgactgctgggagcctgtgcaggagtag

SEQ ID NO: 3064 - DNA, 1218 bp, Artificial Sequence
  Description of Artificial Sequence: Synthetic coding sequence
atggaggccagctttgtgcagaccaccatggccctgggcctgagcagcaagaaggccagcagcagaaatgtggccgtggagaggaagaacctgatcaccgtgtgccgcttctctgtgaagaccctgctggagaagtacacagctgagcccattgatgacagcagcgaggagtttgtgaactttgctgccatcctggagcagatcctgagccaccgcttcaaggcctgtgccccagctggccctgtgtcctggttcagcagtgatggccagaggggcttctgggactacatccggctggcctgcagcaaggtgcccaacaactgtgtgagcagcattgagaacatggagaacatcagcacagcccgggccaagggccgggcctggatccgggtggccctgatggagaagaggatgtctgagtacatcaccacagccctgcgggacaccaggaccacccggcgcttctatgacagcggggccatcatgctgagagatgaggccaccatcctgaccggcatgctgattggcctgagcgccatcgacttctccttctgcctgaagggggaggtgctggatggcaagacccctgtggtgattgactacaccccctacctgaagttcacccagagctatgactacctgacagatgaggaggagcggcacagcgctgagagcagcaccagcgaggacaacagccctgagcacccctacctgcccctggtgacagatgaggacagctggtacagcaagtggcacaagatggagcagaagttccgcatcgtgtatgcccagaagggctacctggaggagctggtgcggctgcgggagagccagctgaaggacctggaggctgaaaatagaaggctgcagctgcagctggaggaggccgccgcccagaaccagcgggagaagcgggagctggagggcgtcatcctggagctgcaggagcagctgaccggcctcatccccagcgaccacgcccccctggcccagggcagcaaggagctgaccacccccctggtgaaccagtggcccagcctgggcaccctgaatggagctgagggcgccagcaacagcaagctgtacagaagacacagcttcatgagcacagagcccctgtctgctgaggccagcctgagcagtgacagccagaggctgggggagggcaccagagatgaggagccctggggccccatcggcagcagcgagcccaactag

SEQ ID NO: 3065 - DNA, 603 bp, Artificial Sequence
  Description of Artificial Sequence: Synthetic coding sequence
atgagccctgagcccgccctgagccctgccctgcagctgctgctgtggcacagcgccctgtggacagtgcaggaggccacccccctgggccctgccagcagcctgccccagagcttcctgctgaagtgcctggagcaggtgaggaagatccagggagatggagctgccctgcaggagaagctgtgtgccacctacaagctgtgccaccctgaggagctggtgctgctgggccacagcctgggcatcccctgggcccccctgagcagctgccccagccaggccctgcagctggccggctgcctgagccagctgcacagcggcctcttcctgtaccagggcctgctgcaggccctggagggcatcagccctgagctgggccccaccctggacaccctgcagctggatgtggccgactttgccaccaccatctggcagcagatggaggagctgggcatggccccagccctgcagcccacccagggcgccatgcctgcctttgccagcgccttccagaggcgggccggcggcgtgctggtggccagccacctgcagagcttcctggaggtgtcctacagagtgctgcggcacctggcccagccctag

SEQ ID NO: 3066 - DNA, 516 bp, Artificial Sequence
  Description of Artificial Sequence: Synthetic coding sequence
atggccggccctgccacccagagccccatgaagctgatggccctgcagctgctgctgtggcacagcgccctgtggacagtgcaggaggccacccccctgggccctgccagcagcctgccccagagcttcctgctgaagtgcctggagcaggtgaggaagatccagggagatggagctgccctgcaggagaagctggtgtctgaggccggctgcctgagccagctgcacagcggcctcttcctgtaccagggcctgctgcaggccctggagggcatcagccctgagctgggccccaccctggacaccctgcagctggatgtggccgactttgccaccaccatctggcagcagatggaggagctgggcatggccccagccctgcagcccacccagggcgccatgcctgcctttgccagcgccttccagaggagagctggaggagtgctggtggccagccacctgcagagcttcctggaggtgtcctacagagtgctgcggcacctggcccagccctag

SEQ ID NO: 3067 - DNA, 615 bp, Artificial Sequence
  Description of Artificial Sequence: Synthetic coding sequence
atggccggccctgccacccagagccccatgaagctgatggccctgcagctgctgctgtggcacagcgccctgtggacagtgcaggaggccacccccctgggccctgccagcagcctgccccagagcttcctgctgaagtgcctggagcaggtgaggaagatccagggagatggagctgccctgcaggagaagctgtgtgccacctacaagctgtgccaccctgaggagctggtgctgctgggccacagcctgggcatcccctgggcccccctgagcagctgccccagccaggccctgcagctggccggctgcctgagccagctgcacagcggcctcttcctgtaccagggcctgctgcaggccctggagggcatcagccctgagctgggccccaccctggacaccctgcagctggatgtggccgactttgccaccaccatctggcagcagatggaggagctgggcatggccccagccctgcagcccacccagggcgccatgcctgcctttgccagcgccttccagaggcgggccggcggcgtgctggtggccagccacctgcagagcttcctggaggtgtcctacagagtgctgcggcacctggcccagccctag

SEQ ID NO: 3068 - DNA, 3696 bp, Artificial Sequence
  Description of Artificial Sequence: Synthetic coding sequence
atgaggctgctggccaagatcatctgcctgatgctgtgggccatctgtgtggccgaggactgcaatgagctgcccccaagaagaaacacagagatcctgaccggctcctggagcgaccagacctacccagagggcacccaggccatctacaagtgccggcccggctaccgcagcctgggcaatgtcatcatggtgtgcaggaagggggagtgggtggccctgaaccccctgaggaagtgccagaagaggccctgtggccaccctggggacaccccatttggcaccttcaccctgactggaggaaatgtgtttgaatatggagtgaaggctgtgtacacctgcaatgaaggctaccagctgctgggggagatcaactaccgggagtgtgacacagatggctggaccaatgacatccccatctgtgaggtggtgaagtgcctgcctgtgacagccccagaaaatggcaagatcgtgagcagcgccatggagccagaccgggagtaccacttcggccaggccgtgcgctttgtgtgcaacagcggctacaagattgaaggagatgaggagatgcactgcagtgatgatggcttctggagcaaggagaagcccaagtgtgtggagatcagctgcaagagcccagatgtgatcaatggcagccccatcagccagaagatcatctacaaggaaaatgaacgcttccagtacaagtgcaacatgggctatgagtacagcgagagaggagatgctgtgtgcacagagagcggctggaggcccctgcccagctgtgaggagaagagctgtgacaacccctacatccccaacggggactacagccccctgcgcatcaagcacaggactggagatgagatcacctaccagtgcagaaatggcttctacccagccacccggggcaacacagccaagtgcaccagcacaggctggatcccagccccccgctgcaccctgaagccctgtgactacccagacatcaagcacggcggcctgtaccacgagaacatgagaagaccctacttccctgtggccgtgggcaagtactacagctactactgtgatgagcactttgagaccccatctggcagctactgggaccacatccactgcacccaggacggctggagccctgctgtgccctgcctgaggaagtgctacttcccctacctggagaatggctacaaccagaaccacggcaggaagtttgtgcagggcaagagcattgatgtggcctgccaccctggctacgccctgcccaaggcccagaccaccgtgacctgcatggagaatggctggagccccaccccccgctgcatccgggtgaagacctgcagcaagagcagcattgatattgaaaatggcttcatcagcgagagccagtacacctacgccctgaaggagaaggccaagtaccagtgcaagctgggctacgtgacagcagatggagagaccagcggcagcatcacctgtgggaaggatggctggagcgcccagcccacctgcatcaagagctgtgacatccctgtgttcatgaatgcccggaccaagaatgacttcacctggttcaagctgaatgacaccctggactatgaatgtcatgatggctatgagagcaacacaggcagcaccaccggcagcatcgtgtgtggctacaacggctggagcgacctgcccatctgctatgagcgggagtgtgagctgcccaagattgatgtgcacctggtgcctgacaggaagaaggaccagtacaaggtgggggaggtgctgaagttcagctgcaagccaggcttcaccatcgtgggccccaacagcgtgcagtgctaccacttcggcctgagcccagacctgcccatctgcaaggagcaggtgcagagctgtggccccccacctgagctgctgaatggaaatgtgaaggagaagaccaaggaggagtatggccacagcgaggtggtggagtactactgcaacccccgcttcctgatgaagggccccaacaagatccagtgtgtggatggagagtggaccaccctgcctgtgtgcatcgtggaggagagcacctgtggggacatccctgagctggagcacggctgggcccagctgagcagccccccctactactatggagacagcgtggagttcaactgcagcgagagcttcaccatgattggccacaggagcatcacctgcatccatggagtgtggacccagctgccccagtgtgtggccatcgacaagctgaagaagtgcaagagcagcaacctgatcatcctggaggagcacctgaagaacaagaaggagtttgaccacaacagcaacatccgctaccgctgccggggcaaggagggctggatccacacagtgtgcatcaatggccgctgggaccctgaggtgaactgcagcatggcccagatccagctgtgccccccaccaccccagatccccaacagccacaacatgaccaccaccctgaactacagagatggagagaaggtgtctgtgctgtgccaggagaactacctgatccaggagggggaggagatcacctgcaaggatggccgctggcagagcatccccctgtgtgtggagaagatcccctgcagccagcccccccagatcgagcacggcaccatcaacagcagccgcagcagccaggagagctatgcccacggcaccaagctgagctacacctgtgagggcggcttccgcatcagcgaggagaatgagaccacctgctacatgggcaagtggagcagccccccccagtgtgagggcctgccctgcaagagccccccagagatcagccatggagtggtggcccacatgtctgacagctaccagtatggagaggaggtgacctacaagtgctttgagggctttggaattgatggccctgccatcgccaagtgcctgggggagaagtggagccacccccccagctgcatcaagacagactgcctgagcctgcccagctttgaaaatgccatccccatgggagagaagaaggatgtgtacaaggccggggagcaggtgacctacacctgtgccacctactacaagatggatggagccagcaatgtgacctgcatcaacagccgctggacaggccggcccacctgccgggacaccagctgtgtgaaccccccaacagtgcagaatgcctacatcgtgtcccggcagatgagcaagtaccccagcggggagcgggtgcgctaccagtgccgcagcccctatgagatgtttggagatgaggaggtgatgtgcctgaatggaaactggacagagcccccccagtgcaaggacagcactggaaaatgtggccccccaccacccatcgacaatggagacatcaccagcttccccctgtctgtgtatgccccagccagctctgtggagtaccagtgccagaacctgtaccagctggagggcaacaagaggatcacctgcagaaatggccagtggagcgagccccccaagtgcctgcacccctgtgtgatcagccgggagatcatggagaactacaacatcgccctgcgctggacagccaagcagaagctgtacagcaggactggagagagcgtggagtttgtgtgcaagaggggctaccgcctgagcagccgcagccacaccctgcggaccacctgctgggatggcaagctggagtaccccacctgtgccaagaggtag

SEQ ID NO: 3069 - DNA, 1350 bp, Artificial Sequence
  Description of Artificial Sequence: Synthetic coding sequence
atgaggctgctggccaagatcatctgcctgatgctgtgggccatctgtgtggccgaggactgcaatgagctgcccccaagaagaaacacagagatcctgaccggctcctggagcgaccagacctacccagagggcacccaggccatctacaagtgccggcccggctaccgcagcctgggcaatgtcatcatggtgtgcaggaagggggagtgggtggccctgaaccccctgaggaagtgccagaagaggccctgtggccaccctggggacaccccatttggcaccttcaccctgactggaggaaatgtgtttgaatatggagtgaaggctgtgtacacctgcaatgaaggctaccagctgctgggggagatcaactaccgggagtgtgacacagatggctggaccaatgacatccccatctgtgaggtggtgaagtgcctgcctgtgacagccccagaaaatggcaagatcgtgagcagcgccatggagccagaccgggagtaccacttcggccaggccgtgcgctttgtgtgcaacagcggctacaagattgaaggagatgaggagatgcactgcagtgatgatggcttctggagcaaggagaagcccaagtgtgtggagatcagctgcaagagcccagatgtgatcaatggcagccccatcagccagaagatcatctacaaggaaaatgaacgcttccagtacaagtgcaacatgggctatgagtacagcgagagaggagatgctgtgtgcacagagagcggctggaggcccctgcccagctgtgaggagaagagctgtgacaacccctacatccccaacggggactacagccccctgcgcatcaagcacaggactggagatgagatcacctaccagtgcagaaatggcttctacccagccacccggggcaacacagccaagtgcaccagcacaggctggatcccagccccccgctgcaccctgaagccctgtgactacccagacatcaagcacggcggcctgtaccacgagaacatgagaagaccctacttccctgtggccgtgggcaagtactacagctactactgtgatgagcactttgagaccccatctggcagctactgggaccacatccactgcacccaggacggctggagccctgctgtgccctgcctgaggaagtgctacttcccctacctggagaatggctacaaccagaaccacggcaggaagtttgtgcagggcaagagcattgatgtggcctgccaccctggctacgccctgcccaaggcccagaccaccgtgacctgcatggagaatggctggagccccaccccccgctgcatccgggtcatcttccagctgtag

SEQ ID NO: 3070 - DNA, 1350 bp, Artificial Sequence
  Description of Artificial Sequence: Synthetic coding sequence
atgaggctgctggccaagatcatctgcctgatgctgtgggccatctgtgtggccgaggactgcaatgagctgcccccaagaagaaacacagagatcctgaccggctcctggagcgaccagacctacccagagggcacccaggccatctacaagtgccggcccggctaccgcagcctgggcaatgtcatcatggtgtgcaggaagggggagtgggtggccctgaaccccctgaggaagtgccagaagaggccctgtggccaccctggggacaccccatttggcaccttcaccctgactggaggaaatgtgtttgaatatggagtgaaggctgtgtacacctgcaatgaaggctaccagctgctgggggagatcaactaccgggagtgtgacacagatggctggaccaatgacatccccatctgtgaggtggtgaagtgcctgcctgtgacagccccagaaaatggcaagatcgtgagcagcgccatggagccagaccgggagtaccacttcggccaggccgtgcgctttgtgtgcaacagcggctacaagattgaaggagatgaggagatgcactgcagtgatgatggcttctggagcaaggagaagcccaagtgtgtggagatcagctgcaagagcccagatgtgatcaatggcagccccatcagccagaagatcatctacaaggaaaatgaacgcttccagtacaagtgcaacatgggctatgagtacagcgagagaggagatgctgtgtgcacagagagcggctggaggcccctgcccagctgtgaggagaagagctgtgacaacccctacatccccaacggggactacagccccctgcgcatcaagcacaggactggagatgagatcacctaccagtgcagaaatggcttctacccagccacccggggcaacacagccaagtgcaccagcacaggctggatcccagccccccgctgcaccctgaagccctgtgactacccagacatcaagcacggcggcctgtaccacgagaacatgagaagaccctacttccctgtggccgtgggcaagtactacagctactactgtgatgagcactttgagaccccatctggcagctactgggaccacatccactgcacccaggacggctggagccctgctgtgccctgcctgaggaagtgctacttcccctacctggagaatggctacaaccagaaccacggcaggaagtttgtgcagggcaagagcattgatgtggcctgccaccctggctacgccctgcccaaggcccagaccaccgtgacctgcatggagaatggctggagccccaccccccgctgcatccgggtgtccttcaccctgtag

SEQ ID NO: 3071 - DNA, 573 bp, Artificial Sequence
  Description of Artificial Sequence: Synthetic coding sequence
atggctgctggggagctggagggcggcaagcccctgagcggcctgctgaatgccctggcccaggacaccttccacggctacccaggcatcacagaggagctgctgcggagccagctgtacccagaggtgcccccagaggagttccggcccttcctggccaagatgaggggcatcctgaagagcatcgccagcgctgacatggacttcaaccagctggaggccttcctgacagcccagaccaagaagcagggcggcatcaccagtgaccaggccgccgtcatcagcaagttctggaagagccacaagaccaagatccgggagagcctgatgaaccagagccgctggaacagcggcctgcggggcctgtcctggagggtggatggcaagagccagagccgccacagcgcccagatccacacccctgtggccatcatcgagctggagctgggcaagtatggccaggagagcgagttcctgtgcctggagtttgatgaggtgaaggtgaaccagatcctgaagaccctgtctgaggtggaggagagcatcagcaccctcatcagccagcccaactag

SEQ ID NO: 3072 - DNA, 117 bp, Artificial Sequence
  Description of Artificial Sequence: Synthetic coding sequence
tgacaggagagcgagttcctgtgcctggagtttgatgaggtgaaggtgaaccagatcctgaagaccctgtctgaggtggaggagagcatcagcaccctcatcagccagcccaactag

SEQ ID NO: 3073 - DNA, 99 bp, Artificial Sequence
  Description of Artificial Sequence: Synthetic coding sequence
tgatgcctggagtttgatgaggtgaaggtgaaccagatcctgaagaccctgtctgaggtggaggagagcatcagcaccctcatcagccagcccaactag

SEQ ID NO: 3074 - DNA, 117 bp, Artificial Sequence; identical to SEQ ID NO: 3072
  Description of Artificial Sequence: Synthetic coding sequence

SEQ ID NO: 3075 - DNA, 480 bp, Artificial Sequence
  Description of Artificial Sequence: Synthetic coding sequence
atggctgctggggagctggagggcggcaagcccctgagcggcctgctgaatgccctggcccaggacaccttccacggctacccaggcatcacagaggagctgctgcggagccagctgtacccagaggtgcccccagaggagttccggcccttcctggccaagatgaggggcatcctgaagagcatcgccagcgctgacatggacttcaaccagctggaggccttcctgacagcccagaccaagaagcagggcggcatcaccagtgaccaggccgccgtcatcagcaagttctggaagagccacaagaccaagatccgggagagcctgatgaaccagagccgctggaacagcggcctgcggggcctgtcctggagggtggatggcaagagccagagccgccacagcgcccagatccacacccctgtggccatcatcgagctggagctgggcaagtatggccaggtgcactgcaaccagtag

SEQ ID NO: 3076 - DNA, 591 bp, Artificial Sequence
  Description of Artificial Sequence: Synthetic coding sequence
atgaggctgcccctgctggtgtctgctggggtgctgctggtggccctgctgccctgccccccctgccgggccctgctgagccggggccctgtgcctggggcccggcaggccccccagcacccccagcccctggacttcttccagcccccaccccagagcgagcagccccagcagccccaggcccggcctgtgctgctgaggatgggagaggagtacttcctgcggctgggcaacctgaacaagagccctgctgcccccctgagccctgccagcagcctgctggccggcggcagcggcagccggcccagccctgagcaggccacagccaacttcttccgggtgctgctgcagcagctgctgctgcccaggaggagcctggacagccctgctgccctggccgagcggggggccagaaatgccctgggcggccaccaggaggcccctgagcgggagcggcgctctgaggagccccccatcagcctggacctgaccttccacctgctgcgggaggtgctggagatggcccgggcagagcagctggcccagcaggcccacagcaacaggaagctgatggagatcatcggcaagtag

SEQ ID NO: 3077 - DNA, 4443 bp, Artificial Sequence
  Description of Artificial Sequence: Synthetic coding sequence
atgcagaggagccccctggagaaggcctctgtggtgtccaagctgttcttctcctggacccggcccatcctgaggaagggctaccggcagaggctggagctgagtgacatctaccagatccccagcgtggacagcgctgacaacctgtctgagaagctggagcgggagtgggaccgggagctggccagcaagaagaaccccaagctgatcaatgccctgcggcgctgcttcttctggaggttcatgttctacggcatcttcctgtacctgggggaggtgaccaaggctgtgcagcccctgctgctgggccgcatcatcgccagctatgaccctgacaacaaggaggagaggagcatcgccatctacctgggcatcggcctgtgcctgctcttcatcgtgaggaccctgctgctgcacccagccatcttcggcctgcaccacatcggcatgcagatgagaattgccatgttcagcctcatctacaagaagaccctgaagctgagcagccgggtgctggacaagatcagcatcggccagctggtgtccctgctgagcaacaacctgaacaagtttgatgagggcctggccctggcccactttgtgtggatcgcccccctgcaggtggccctgctgatgggcctcatctgggagctgctgcaggccagcgccttctgtggcctgggcttcctgattgtgctggccctcttccaggccggcctgggccgcatgatgatgaagtacagagaccagagagctgggaagatcagcgagcggctggtgatcaccagcgagatgattgagaacatccagagcgtgaaggcctactgctgggaggaggccatggagaagatgattgagaacctgcggcagacagagctgaagctgaccaggaaggccgcctacgtgcgctacttcaacagcagcgccttcttcttcagcggcttctttgtggtgttcctgtctgtgctgccctatgccctgatcaagggcatcatcctgaggaagatcttcaccaccatctccttctgcatcgtgctgaggatggctgtgacccggcagttcccctgggccgtgcagacctggtatgacagcctgggcgccatcaacaagatccaggacttcctgcagaagcaggagtacaagaccctggagtacaacctgaccaccacagaggtggtgatggagaatgtgacagccttctgggaggagggctttggagagctgtttgagaaggccaagcagaacaacaacaacaggaagaccagcaatggagatgacagcctcttcttcagcaacttcagcctgctgggcacccctgtgctgaaggacatcaacttcaagattgaaagaggccagctgctggccgtggccggcagcactggagctgggaagaccagcctgctgatggtgatcatgggagagctggagcccagcgagggcaagatcaagcacagcggccgcatctccttctgcagccagttctcctggatcatgcctggcaccatcaaggagaacatcatcttcggcgtgtcctatgatgagtaccgctacagaagtgtcatcaaggcctgccagctggaggaggacatcagcaagtttgctgagaaggacaacatcgtgctgggggagggcggcatcaccctgagcggcggccagagggcccgcatcagcctggcccgggctgtgtacaaggatgctgacctgtacctgctggacagccccttcggctacctggatgtgctgacagagaaggagatctttgagagctgtgtgtgcaagctgatggccaacaagacccgcatcctggtgaccagcaagatggagcacctgaagaaggctgacaagatcctgatcctgcacgagggcagcagctacttctacggcaccttcagcgagctgcagaacctgcagcctgacttcagcagcaagctgatgggctgtgacagctttgaccagttctctgctgagaggaggaacagcatcctgacagagaccctgcaccgcttcagcctggagggagatgcccctgtgtcctggacagagaccaagaagcagagcttcaagcagacaggagaatttggagagaagaggaagaacagcatcctgaaccccatcaacagcatcaggaagttcagcatcgtgcagaagacccccctgcagatgaatggcatcgaggaggacagtgatgagcccctggagcggcggctgagcctggtgcctgacagcgagcagggcgaggccatcctgccccgcatcagcgtcatcagcacaggccccaccctgcaggcccggcggcggcagagcgtgctgaacctgatgacccacagcgtgaaccagggccagaacatccacaggaagaccacagccagcaccaggaaggtgtccctggccccccaggccaacctgacagagctggacatctacagccggcggctgagccaggagaccggcctggagatcagcgaggagatcaatgaggaggacctgaaggagtgcttctttgatgacatggagagcatcccagctgtgaccacctggaacacctacctgcgctacatcaccgtgcacaagagcctcatctttgtgctgatctggtgcctggtgatcttcctggccgaggtggccgccagcctggtggtgctgtggctgctgggcaacacccccctgcaggacaagggcaacagcacccacagcaggaacaacagctatgctgtgatcatcaccagcaccagcagctactacgtgttctacatctacgtgggcgtggccgacaccctgctggccatgggcttcttccggggcctgcccctggtgcacaccctcatcaccgtgtccaagatcctgcaccacaagatgctgcacagcgtgctgcaggcccccatgagcaccctgaacaccctgaaggccggcggcatcctgaaccgcttcagcaaggacatcgccatcctggatgacctgctgcccctgaccatctttgacttcatccagctgctgctgattgtcatcggggccatcgctgtggtggccgtgctgcagccctacatctttgtggccaccgtgcctgtgattgtggccttcatcatgctgcgggcctacttcctgcagaccagccagcagctgaagcagctggagagcgagggccgcagccccatcttcacccacctggtgaccagcctgaagggcctgtggaccctgcgggccttcggccggcagccctactttgagaccctcttccacaaggccctgaacctgcacacagccaactggttcctgtacctgagcaccctgcgctggttccagatgagaattgagatgatctttgtgatcttcttcatcgctgtgaccttcatcagcatcctgaccaccggggagggggagggccgggtgggcatcatcctgaccctggccatgaacatcatgagcaccctgcagtgggccgtgaacagcagcattgatgtggacagcctgatgaggtctgtgtccagggtcttcaagttcatcgacatgcccacagagggcaagcccaccaagagcaccaagccctacaagaatggccagctgagcaaggtgatgatcatcgagaacagccacgtgaagaaggatgacatctggcccagcggcggccagatgacagtgaaggacctgacagccaagtacacagagggcggcaatgccatcctggagaacatctccttcagcatcagccctggccagagggtgggcctgctgggccgcacaggcagcggcaagagcaccctgctgagcgccttcctgcggctgctgaacacagaaggagagatccagattgatggagtgtcctgggacagcatcaccctgcagcagtggaggaaggccttcggggtcatcccccagaaggtgttcatcttcagcggcaccttcaggaagaacctggacccctatgagcagtggagcgaccaggagatctggaaggtggctgatgaggtgggcctgcggagcgtcatcgagcagtttcctgggaagctggactttgtgctggtggatggcggctgtgtgctgagccacggccacaagcagctgatgtgcctggcccggtctgtgctgagcaaggccaagatcctgctgctggatgagcccagcgcccacctggaccctgtgacctaccagatcatccggaggaccctgaagcaggcctttgctgactgcaccgtcatcctgtgtgagcaccgcatcgaggccatgctggagtgccagcagttcctggtgattgaggagaacaaggtgcggcagtatgacagcatccagaagctgctgaatgaaagaagcctcttccggcaggccatcagccccagcgacagagtgaagctgttcccccacaggaacagcagcaagtgcaagagcaagccccagattgctgccctgaaggaggagacagaggaggaggtgcaggacacccggctgtag

SEQ ID NO: 3078 - DNA, 4317 bp, Artificial Sequence
  Description of Artificial Sequence: Synthetic coding sequence
atgcagaggagccccctggagaaggcctctgtggtgtccaagctgttcttctcctggacccggcccatcctgaggaagggctaccggcagaggctggagctgagtgacatctaccagatccccagcgtggacagcgctgacaacctgtctgagaagctggagcgggagtgggaccgggagctggccagcaagaagaaccccaagctgatcaatgccctgcggcgctgcttcttctggaggttcatgttctacggcatcttcctgtacctgggggaggtgaccaaggctgtgcagcccctgctgctgggccgcatcatcgccagctatgaccctgacaacaaggaggagaggagcatcgccatctacctgggcatcggcctgtgcctgctcttcatcgtgaggaccctgctgctgcacccagccatcttcggcctgcaccacatcggcatgcagatgagaattgccatgttcagcctcatctacaagaagggcctggccctggcccactttgtgtggatcgcccccctgcaggtggccctgctgatgggcctcatctgggagctgctgcaggccagcgccttctgtggcctgggcttcctgattgtgctggccctcttccaggccggcctgggccgcatgatgatgaagtacagagaccagagagctgggaagatcagcgagcggctggtgatcaccagcgagatgattgagaacatccagagcgtgaaggcctactgctgggaggaggccatggagaagatgattgagaacctgcggcagacagagctgaagctgaccaggaaggccgcctacgtgcgctacttcaacagcagcgccttcttcttcagcggcttctttgtggtgttcctgtctgtgctgccctatgccctgatcaagggcatcatcctgaggaagatcttcaccaccatctccttctgcatcgtgctgaggatggctgtgacccggcagttcccctgggccgtgcagacctggtatgacagcctgggcgccatcaacaagatccaggacttcctgcagaagcaggagtacaagaccctggagtacaacctgaccaccacagaggtggtgatggagaatgtgacagccttctgggaggagggctttggagagctgtttgagaaggccaagcagaacaacaacaacaggaagaccagcaatggagatgacagcctcttcttcagcaacttcagcctgctgggcacccctgtgctgaaggacatcaacttcaagattgaaagaggccagctgctggccgtggccggcagcactggagctgggaagaccagcctgctgatggtgatcatgggagagctggagcccagcgagggcaagatcaagcacagcggccgcatctccttctgcagccagttctcctggatcatgcctggcaccatcaaggagaacatcatcttcggcgtgtcctatgatgagtaccgctacagaagtgtcatcaaggcctgccagctggaggaggacatcagcaagtttgctgagaaggacaacatcgtgctgggggagggcggcatcaccctgagcggcggccagagggcccgcatcagcctggcccgggctgtgtacaaggatgctgacctgtacctgctggacagccccttcggctacctggatgtgctgacagagaaggagatctttgagagctgtgtgtgcaagctgatggccaacaagacccgcatcctggtgaccagcaagatggagcacctgaagaaggctgacaagatcctgatcctgcacgagggcagcagctacttctacggcaccttcagcgagctgcagaacctgcagcctgacttcagcagcaagctgatgggctgtgacagctttgaccagttctctgctgagaggaggaacagcatcctgacagagaccctgcaccgcttcagcctggagggagatgcccctgtgtcctggacagagaccaagaagcagagcttcaagcagacaggagaatttggagagaagaggaagaacagcatcctgaaccccatcaacagcatcaggaagttcagcatcgtgcagaagacccccctgcagatgaatggcatcgaggaggacagtgatgagcccctggagcggcggctgagcctggtgcctgacagcgagcagggcgaggccatcctgccccgcatcagcgtcatcagcacaggccccaccctgcaggcccggcggcggcagagcgtgctgaacctgatgacccacagcgtgaaccagggccagaacatccacaggaagaccacagccagcaccaggaaggtgtccctggccccccaggccaacctgacagagctggacatctacagccggcggctgagccaggagaccggcctggagatcagcgaggagatcaatgaggaggacctgaaggagtgcttctttgatgacatggagagcatcccagctgtgaccacctggaacacctacctgcgctacatcaccgtgcacaagagcctcatctttgtgctgatctggtgcctggtgatcttcctggccgaggtggccgccagcctggtggtgctgtggctgctgggcaacacccccctgcaggacaagggcaacagcacccacagcaggaacaacagctatgctgtgatcatcaccagcaccagcagctactacgtgttctacatctacgtgggcgtggccgacaccctgctggccatgggcttcttccggggcctgcccctggtgcacaccctcatcaccgtgtccaagatcctgcaccacaagatgctgcacagcgtgctgcaggcccccatgagcaccctgaacaccctgaaggccggcggcatcctgaaccgcttcagcaaggacatcgccatcctggatgacctgctgcccctgaccatctttgacttcatccagctgctgctgattgtcatcggggccatcgctgtggtggccgtgctgcagccctacatctttgtggccaccgtgcctgtgattgtggccttcatcatgctgcgggcctacttcctgcagaccagccagcagctgaagcagctggagagcgagggccgcagccccatcttcacccacctggtgaccagcctgaagggcctgtggaccctgcgggccttcggccggcagccctactttgagaccctcttccacaaggccctgaacctgcacacagccaactggttcctgtacctgagcaccctgcgctggttccagatgagaattgagatgatctttgtgatcttcttcatcgctgtgaccttcatcagcatcctgaccaccggggagggggagggccgggtgggcatcatcctgaccctggccatgaacatcatgagcaccctgcagtgggccgtgaacagcagcattgatgtggacagcctgatgaggtctgtgtccagggtcttcaagttcatcgacatgcccacagagggcaagcccaccaagagcaccaagccctacaagaatggccagctgagcaaggtgatgatcatcgagaacagccacgtgaagaaggatgacatctggcccagcggcggccagatgacagtgaaggacctgacagccaagtacacagagggcggcaatgccatcctggagaacatctccttcagcatcagccctggccagagggtgggcctgctgggccgcacaggcagcggcaagagcaccctgctgagcgccttcctgcggctgctgaacacagaaggagagatccagattgatggagtgtcctgggacagcatcaccctgcagcagtggaggaaggccttcggggtcatcccccagaaggtgttcatcttcagcggcaccttcaggaagaacctggacccctatgagcagtggagcgaccaggagatctggaaggtggctgatgaggtgggcctgcggagcgtcatcgagcagtttcctgggaagctggactttgtgctggtggatggcggctgtgtgctgagccacggccacaagcagctgatgtgcctggcccggtctgtgctgagcaaggccaagatcctgctgctggatgagcccagcgcccacctggaccctgtgacctaccagatcatccggaggaccctgaagcaggcctttgctgactgcaccgtcatcctgtgtgagcaccgcatcgaggccatgctggagtgccagcagttcctggtgattgaggagaacaaggtgcggcagtatgacagcatccagaagctgctgaatgaaagaagcctcttccggcaggccatcagccccagcgacagagtgaagctgttcccccacaggaacagcagcaagtgcaagagcaagccccagattgctgccctgaagtag

SEQ ID NO: 3079 - DNA, 4260 bp, Artificial Sequence
  Description of Artificial Sequence: Synthetic coding sequence
atgcagaggagccccctggagaaggcctctgtggtgtccaagctgttcttctcctggacccggcccatcctgaggaagggctaccggcagaggctggagctgagtgacatctaccagatccccagcgtggacagcgctgacaacctgtctgagaagctggagcgggagtgggaccgggagctggccagcaagaagaaccccaagctgatcaatgccctgcggcgctgcttcttctggaggttcatgttctacggcatcttcctgtacctgggggaggtgaccaaggctgtgcagcccctgctgctgggccgcatcatcgccagctatgaccctgacaacaaggaggagaggagcatcgccatctacctgggcatcggcctgtgcctgctcttcatcgtgaggaccctgctgctgcacccagccatcttcggcctgcaccacatcggcatgcagatgagaattgccatgttcagcctcatctacaagaagaccctgaagctgagcagccgggtgctggacaagatcagcatcggccagctggtgtccctgctgagcaacaacctgaacaagtttgatgagggcctggccctggcccactttgtgtggatcgcccccctgcaggtggccctgctgatgggcctcatctgggagctgctgcaggccagcgccttctgtggcctgggcttcctgattgtgctggccctcttccaggccggcctgggccgcatgatgatgaagtacagagaccagagagctgggaagatcagcgagcggctggtgatcaccagcgagatgattgagaacatccagagcgtgaaggcctactgctgggaggaggccatggagaagatgattgagaacctgcggcagacagagctgaagctgaccaggaaggccgcctacgtgcgctacttcaacagcagcgccttcttcttcagcggcttctttgtggtgttcctgtctgtgctgccctatgccctgatcaagggcatcatcctgaggaagatcttcaccaccatctccttctgcatcgtgctgaggatggctgtgacccggcagttcccctgggccgtgcagacctggtatgacagcctgggcgccatcaacaagatccaggacttcctgcagaagcaggagtacaagaccctggagtacaacctgaccaccacagaggtggtgatggagaatgtgacagccttctgggaggagaccagcctgctgatggtgatcatgggagagctggagcccagcgagggcaagatcaagcacagcggccgcatctccttctgcagccagttctcctggatcatgcctggcaccatcaaggagaacatcatctttggagtgtcctatgatgagtaccgctaccgcagcgtcatcaaggcctgccagctggaggaggacatcagcaagtttgctgagaaggacaacatcgtgctgggggagggcggcatcaccctgagcggcggccagagggcccgcatcagcctggcccgggctgtgtacaaggatgctgacctgtacctgctggacagccccttcggctacctggatgtgctgacagagaaggagatctttgagagctgtgtgtgcaagctgatggccaacaagacccgcatcctggtgaccagcaagatggagcacctgaagaaggctgacaagatcctgatcctgcacgagggcagcagctacttctacggcaccttcagcgagctgcagaacctgcagcctgacttcagcagcaagctgatgggctgtgacagctttgaccagttctctgctgagaggagaaattccatcctgacagagaccctgcaccgcttcagcctggagggagatgcccctgtgtcctggacagagaccaagaagcagagcttcaagcagacaggagaatttggagagaagaggaagaacagcatcctgaaccccatcaacagcatcaggaagttcagcatcgtgcagaagacccccctgcagatgaatggaattgaagaagattctgatgagcccctggagcggcggctgagcctggtgcctgattctgagcagggcgaggccatcctgccccgcatcagcgtcatcagcacaggccccaccctgcaggcccggcggcggcagagcgtgctgaacctgatgacccacagcgtgaaccagggccagaacatccacaggaagaccacagccagcaccaggaaggtgtccctggccccccaggccaacctgacagagctggacatctacagccggcggctgagccaggagaccggcctggagatcagcgaggagatcaatgaggaggacctgaaggagtgcttctttgatgacatggagagcatcccagctgtgaccacctggaacacctacctgcgctacatcaccgtgcacaagagcctcatctttgtgctgatctggtgcctggtgatcttcctggccgaggtggccgccagcctggtggtgctgtggctgctgggcaacacccccctgcaggacaagggcaacagcacccacagcaggaacaacagctatgctgtgatcatcaccagcaccagcagctactacgtgttctacatctacgtgggcgtggccgacaccctgctggccatgggcttcttccggggcctgcccctggtgcacaccctcatcaccgtgtccaagatcctgcaccacaagatgctgcacagcgtgctgcaggcccccatgagcaccctgaacaccctgaaggccggcggcatcctgaaccgcttcagcaaggacatcgccatcctggatgacctgctgcccctgaccatctttgacttcatccagctgctgctgattgtgattggagccatcgctgtggtggccgtgctgcagccctacatctttgtggccaccgtgcctgtgattgtggccttcatcatgctgcgggcctacttcctgcagaccagccagcagctgaagcagctggagagcgagggccgcagccccatcttcacccacctggtgaccagcctgaagggcctgtggaccctgcgggccttcggccggcagccctactttgagaccctcttccacaaggccctgaacctgcacacagccaactggttcctgtacctgagcaccctgcgctggttccagatgagaattgagatgatcttcgtcatcttcttcatcgctgtgaccttcatcagcatcctgaccactggagagggggagggccgggtgggcatcatcctgaccctggccatgaacatcatgagcaccctgcagtgggccgtgaacagcagcattgatgtggacagcctgatgaggtctgtgtccagggtcttcaagttcatcgacatgcccacagagggcaagcccaccaagagcaccaagccctacaagaatggccagctgagcaaggtgatgatcatcgagaacagccacgtgaagaaggatgacatctggcccagcggcggccagatgacagtgaaggacctgacagccaagtacacagaaggaggaaatgccatcctggagaacatctccttcagcatcagccctggccagagggtgggcctgctgggccgcactggaagtggcaagagcaccctgctgagcgccttcctgcggctgctgaacacagaaggagagatccagattgatggagtgtcctgggacagcatcaccctgcagcagtggaggaaggcctttggagtcatcccccagaaggtgttcatcttcagcggcaccttcaggaagaacctggacccctatgagcagtggagcgaccaggagatctggaaggtggctgatgaggtgggcctgcggtctgtgattgagcagtttcctgggaagctggactttgtgctggtggatggcggctgtgtgctgagccacggccacaagcagctgatgtgcctggcccggtctgtgctgagcaaggccaagatcctgctgctggatgagcccagcgcccacctggaccctgtgacctaccagatcatccggaggaccctgaagcaggcctttgctgactgcaccgtcatcctgtgtgagcacagaattgaggccatgctggagtgccagcagttcctggtgattgaggagaacaaggtgcggcagtatgacagcatccagaagctgctgaatgaaagaagcctcttccggcaggccatcagccccagcgacagagtgaagctgttcccccacaggaacagcagcaagtgcaagagcaagccccagattgctgccctgaaggaggagacagaggaggaggtgcaggacacccggctgtag

SEQ ID NO: 3080 - DNA, 573 bp, Artificial Sequence
  Description of Artificial Sequence: Synthetic coding sequence
tgaaaaggcctgtggaccctgcgggccttcggccggcagccctactttgagaccctcttccacaaggccctgaacctgcacacagccaactggttcctgtacctgagcaccctgcgctggttccagatgagaattgagatgatctttgtgatcttcttcatcgctgtgaccttcatcagcatcctgaccaccggggagggggagggccgggtgggcatcatcctgaccctggccatgaacatcatgagcaccctgcagtgggccgtgaacagcagcattgatgtggacagcctgatgaggtctgtgtccagggtcttcaagttcatcgacatgcccacagagggcaagcccaccaagagcaccaagccctacaagaatggccagctgagcaaggtgatgatcatcgagaacagccacgtgaagaaggatgacatctggcccagcggcggccagatgacagtgaaggacctgacagccaagtacacagagggcggcaatgccatcctggagaacatctccttcagcatcagccctggccagagggtgcgctttgagcactgcctgctgtgctag

SEQ ID NO: 3081 - DNA, 1203 bp, Artificial Sequence
  Description of Artificial Sequence: Synthetic coding sequence
atgatccggaactggctgaccatcttcatcctcttccccctgaagctggtggagaagtgtgagagctctgtgtccctgactgtgccccctgtggtgaagctggagaatggcagcagcaccaacgtgtccctgaccctgcggccccccctgaatgccaccctggtgatcacctttgagatcaccttccgcagcaagaacatcaccatcctggagctgcctgatgaggtggtggtgcccccaggagtgaccaacagcagcttccaggtgaccagccagaatgtgggccagctgactgtgtacctgcacggcaaccacagcaaccagacaggcccccgcatccgcttcctggtgatccgcagcagcgccatcagcatcatcaaccaggtgattggctggatctactttgtggcctggagcatctccttctacccccaggtgatcatgaactggaggaggaagagcgtcatcggcctgagctttgattttgtggccctgaacctgaccggctttgtggcctacagcgtcttcaacatcggcctgctgtgggtgccctacatcaaggagcagttcctgctgaagtaccccaacggggtgaaccctgtgaacagcaatgatgtgttcttcagcctgcatgctgtggtgctgaccctcatcatcatcgtgcagtgctgcctgtatgaaagaggaggccagagggtgtcctggccagccatcggcttcctggtgctggcctggctgtttgcctttgtgaccatgattgtggccgctgtgggcgtgaccacctggctgcagttcctgttctgcttctcctacatcaagctggccgtgaccctggtgaagtacttcccccaggcctacatgaacttctactacaagagcacagagggctggagcattggaaatgtgctgctggacttcaccggcggcagcttcagcctgctgcagatgttcctgcagagctacaacaatgaccagtggaccctcatctttggagaccccaccaagtttggcctgggcgtcttcagcatcgtgtttgatgtggtgttcttcatccagcacttctgcctgtacaggaagaggcctggcctgcaggccgccaggacaggcagcggcagccggctgcggcaggactgggcccccagcctgcagcccaaggccctgccccagaccacctctgtgtctgccagcagcctgaagggctag

SEQ ID NO: 3082 - DNA, 1104 bp, Artificial Sequence
  Description of Artificial Sequence: Synthetic coding sequence
atgatccggaactggctgaccatcttcatcctcttccccctgaagctggtggagaagtgtgagagctctgtgtccctgactgtgccccctgtggtgaagctggagaatggcagcagcaccaacgtgtccctgaccctgcggccccccctgaatgccaccctggtgatcacctttgagatcaccttccgcagcaagaacatcaccatcctggagctgcctgatgaggtggtggtgcccccaggagtgaccaacagcagcttccaggtgaccagccagaatgtgggccagctgactgtgtacctgcacggcaaccacagcaaccagacaggcccccgcatccgcttcctggtgatccgcagcagcgccatcagcatcatcaaccaggtgattggctggatctactttgtggcctggagcatctccttctacccccaggtgatcatgaactggaggaggaagagcgtcatcggcctgagctttgattttgtggccctgaacctgaccggctttgtggcctacagcgtcttcaacatcggcctgctgtgggtgccctacatcaaggagcagttcctgctgaagtaccccaacggggtgaaccctgtgaacagcaatgatgtgttcttcagcctgcatgctgtggtgctgaccctcatcatcatcgtgcagtgctgcctgtatgaaagaggaggccagagggtgtcctggccagccatcggcttcctggtgctggcctggctgtttgcctttgtgaccatgattgtggccgctgtgggcgtgaccacctggctgcagttcctgttctgcttctcctacatcaagctggccgtgaccctggtgaagtacttcccccaggcctacatgaacttctactacaagagcacagagggctggagcattggaaatgtgctgctggacttcaccggcggcagcttcagcctgctgcagatgttcctgcagagctacaacaatgaccagtggaccctcatctttggagaccccaccaagtttggcctgggcgtcttcagcatcgtgtttgatgtggtgttcttcatccagcacttctgcctgtacaggaagaggcctggctatgaccagctgaactag

SEQ ID NO: 3083 - DNA, 663 bp, Artificial Sequence
  Description of Artificial Sequence: Synthetic coding sequence
atgaactggaggaggaagtctgtgattggcctgagctttgattttgtggccctgaacctgactggatttgtggcctacagcgtcttcaacatcggcctgctgtgggtgccctacatcaaggagcagttcctgctgaagtacccaaatggagtgaaccctgtgaacagcaatgatgtgttcttcagcctgcatgctgtggtgctgaccctcatcatcatcgtgcagtgctgcctgtatgagcggggcggccagagggtgtcctggccagccatcggcttcctggtgctggcctggctgtttgcctttgtgaccatgattgtggccgctgtgggcgtgaccacctggctgcagttcctgttctgcttctcctacatcaagctggccgtgaccctggtgaagtacttcccccaggcctacatgaacttctactacaagagcacagagggctggagcattggaaatgtgctgctggacttcaccggcggcagcttcagcctgctgcagatgttcctgcagagctacaacaatgaccagtggaccctcatctttggagaccccaccaagtttggcctgggcgtcttcagcatcgtgtttgatgtggtgttcttcatccagcacttctgcctgtacaggaagaggcctggctatgaccagctgaactag

SEQ ID NO: 3084 - DNA, 879 bp, Artificial Sequence
  Description of Artificial Sequence: Synthetic coding sequence
atgtgcccccgcatccgcttcctggtgatccgcagcagcgccatcagcatcatcaaccaggtgattggctggatctactttgtggcctggagcatctccttctacccccaggtgatcatgaactggaggaggaagagcgtcatcggcctgagctttgattttgtggccctgaacctgaccggctttgtggcctacagcgtcttcaacatcggcctgctgtgggtgccctacatcaaggagcagttcctgctgaagtaccccaacggggtgaaccctgtgaacagcaatgatgtgttcttcagcctgcatgctgtggtgctgaccctcatcatcatcgtgcagtgctgcctgtatgaaagaggaggccagagggtgtcctggccagccatcggcttcctggtgctggcctggctgtttgcctttgtgaccatgattgtggccgctgtgggcgtgaccacctggctgcagttcctgttctgcttctcctacatcaagctggccgtgaccctggtgaagtacttcccccaggcctacatgaacttctactacaagagcacagagggctggagcattggaaatgtgctgctggacttcaccggcggcagcttcagcctgctgcagatgttcctgcagagctacaacaatgaccagtggaccctcatctttggagaccccaccaagtttggcctgggcgtcttcagcatcgtgtttgatgtggtgttcttcatccagcacttctgcctgtacaggaagaggcctggcctgcaggccgccaggacaggcagcggcagccggctgcggcaggactgggcccccagcctgcagcccaaggccctgccccagaccacctctgtgtctgccagcagcctgaagggctag

SEQ ID NO: 3085 - DNA, 228 bp, Artificial Sequence
  Description of Artificial Sequence: Synthetic coding sequence
atgatccggaactggctgaccatcttcatcctcttccccctgaagctggtggagaagtgtgagagctctgtgtccctgactgtgccccctgtggtgaagctggagaatggcagcagcaccaacgtgtccctgaccctgcggccccccctgaatgccaccctggtgatcacctttgagatcaccttccgcagcaagaacatcaccatcctggagctgcctgatgaatag

SEQ ID NO: 3086 - DNA, 204 bp, Artificial Sequence
  Description of Artificial Sequence: Synthetic coding sequence
atgaggatccactacctgctgtttgccctgctcttcctgttcctggtgcctgtgcccggccatggaggcatcatcaacaccctgcagaagtactactgccgggtgcggggcggccgctgtgctgtgctgagctgcctgcccaaggaggagcagatcggcaagtgcagcacccggggcaggaagtgctgcaggaggaagaagtag

SEQ ID NO: 3087 - DNA, 204 bp, Artificial Sequence; identical to SEQ ID NO: 3086
  Description of Artificial Sequence: Synthetic coding sequence

SEQ ID NO: 3088 - DNA, 195 bp, Artificial Sequence
  Description of Artificial Sequence: Synthetic coding sequence
atgagggtgctgtacctgctcttctccttcctgttcatcttcctgatgcccctgcccggggtgtttggaggcattggagaccctgtgacctgcctgaagagcggggccatctgccaccctgtgttctgcccccggcgctacaagcagatcggcacctgtggcctgcccggcaccaagtgctgcaagaagccctag

SEQ ID NO: 3089 - DNA, 195 bp, Artificial Sequence; identical to SEQ ID NO: 3088
  Description of Artificial Sequence: Synthetic coding sequence

SEQ ID NO: 3090 - DNA, 849 bp, Artificial Sequence
  Description of Artificial Sequence: Synthetic coding sequence
atgaggggcatgaagctgctgggcgccctgctggccctggccgccctgctgcagggcgctgtgtccctgaagattgctgccttcaacatccagacctttggagagaccaagatgagcaatgccaccctggtgtcctacatcgtgcagatcctgagccgctatgacatcgccctggtgcaggaggtgcgggacagccacctgacagctgtgggcaagctgctggacaacctgaaccaggatgccccagacacctaccactacgtggtgtctgagcccctgggcagaaattcctacaaggagcgctacctgtttgtgtacagaccagaccaggtgtctgctgtggacagctactactatgatgatggctgtgagccctgtggaaatgacaccttcaaccgggagcccgccatcgtgcgcttcttcagccgcttcacagaggtgcgggagtttgccatcgtgcccctgcatgctgcccctggagatgctgtggccgagattgatgccctgtatgatgtgtacctggatgtgcaggagaagtggggcctggaggatgtgatgctgatgggagacttcaatgccggctgcagctatgtgcggcccagccagtggagcagcatccggctgtggaccagccccaccttccagtggctgatcccagattctgctgacaccacagccacccccacccactgtgcctatgaccgcatcgtggtggccggcatgctgctgcggggagctgtggtgcctgattctgccctgcccttcaacttccaggccgcctacggcctgagtgaccagctggcccaggccatcagtgaccactaccctgtggaggtgatgctgaagtag

SEQ ID NO: 3091 - DNA, 849 bp, Artificial Sequence; identical to SEQ ID NO: 3090
  Description of Artificial Sequence: Synthetic coding sequence

SEQ ID NO: 3092 - DNA, 564 bp, Artificial Sequence
  Description of Artificial Sequence: Synthetic coding sequence
atgcaccagacccccatcaccacctggagcgtgagccactgggatggaacagccatccgcagcgccacctgcagctgcaccggcctgacccgctgcctgcgctggacagccaccaccaccatgatggccgccagccctgctggcaccacccccagcacagagagccagcccctgagcggcagcagccctggcagccaggatgtgatgctgatgggagacttcaatgccggctgcagctatgtgcggcccagccagtggagcagcatccggctgtggaccagccccaccttccagtggctgatcccagacagcgctgacaccacagccacccccacccactgtgcctatgacagaattgtggtggccggcatgctgctgcggggagctgtggtgcctgacagcgccctgcccttcaacttccaggccgcctacggcctgagtgaccagctgttctctgtgcacacctgcagcggggccggcctgggggagagacatggcctgcctgccagcgctgccctgcccagcaacacctgccgggccggcacccaccgggtgtccacctag

SEQ ID NO: 3093 - DNA, 6243 bp, Artificial Sequence
  Description of Artificial Sequence: Synthetic coding sequence
atgctgcgggtcttcatcctgtatgcagaaaatgtgcacaccccagacacagacatcagtgatgcctactgcagcgctgtgtttgctggggtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccactggagccagcctggtgctgcaggtgtcctacacccccctgcctggagctgtgcccctcttccccccacccacccccctggagcccagccccaccctgcctgacctggatgtggtggccgacaccggcggggaggaggacacagaggaccagggcctgactggagatgaggccgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccaccggggtggccctgcggggggcccacttctgcctgaaggtgttccgggcagaggacctgccccagatggatgatgctgtgatggacaacgtgaagcagatcttcggctttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggaggagcctgctggagctgtgaagcccagcaaggccagtgacctggatgactacctgggcttcctgcccaccttcggcccctgctacatcaacctgtatggcagcccccgggagttcaccggcttcccagacccctacacagagctgaacacaggcaagggggagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccaccgcatcgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagacccccagcgccacccacctggaccagtacctgtaccagctgcggacccaccacctgagccagatcacagaggccgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagccggcggggggccaactactgtgggaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacattgaatgtcccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtcagaagattccatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagcccccatccatcgtggtggagctgtatgaccatgacacctacggggctgatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggaagaagacctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccaggaggaggagttcatcgactggtggagcaagttctttgccagcattggagagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtcatcggggagttcaagggcctcttcaagatctaccccctgcctgaggaccctgccatccccatgccaccccggcagttccaccagctggccgcccagggcccccaggagtgcctggtgcgcatctacatcgtgcgggccttcggcctgcagcccaaggaccccaacgggaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagattggagagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaagctggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccccggcgggcccggcgcttcttcctgcgctgcatcatctggaacaccagagatgtgatcctggatgacctgagcctgactggagagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggaccccaggaggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3094 - DNA, 6246 bp, Artificial Sequence
  Description of Artificial Sequence: Synthetic coding sequence
atgctgtgctgcctgctggtgcgggccagcaacctgcccagcgccaagaaggacagaagaagtgaccctgtggccagcctgaccttccggggcgtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccaccggggccagcctggtgctgcaggtgtcctacacccccctgcccggggctgtgcccctcttccccccacccacccccctggagcccagccccaccctgcctgacctggatgtggtggccgacacaggaggagaggaggacacagaggaccagggcctgactggagatgaagctgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccactggagtggccctgcggggggcccacttctgcctgaaggtgttccgggcagaggacctgccccagatggatgatgctgtgatggacaacgtgaagcagatctttggatttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggaggagcctgctggagctgtgaagcccagcaaggccagtgacctggatgactacctgggcttcctgcccaccttcggcccctgctacatcaacctgtatggcagcccccgggagttcaccggcttcccagacccctacacagagctgaacacaggaaaaggagagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccacagaattgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagaccccatctgccacccacctggaccagtacctgtaccagctgcggacccaccacctgagccagatcacagaagctgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagcagaagaggagccaactactgcggcaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacatcgagtgccccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtctgaggacagcatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagccccccagcatcgtggtggagctgtatgaccatgacacctatggagcagatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggccggcggcctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccaggaggaggagttcatcgactggtggagcaagttctttgccagcatcggggagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtgattggagagttcaagggcctcttcaagatctaccccctgcctgaagatcctgccatccccatgccaccccggcagttccaccagctggccgcccagggcccccaggagtgcctggtgcgcatctacatcgtgcgggccttcggcctgcagcccaaggaccccaatggaaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagatcggggagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaggccggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccaagaagagcccggcgcttcttcctgcgctgcatcatctggaacaccagagatgtgatcctggatgacctgagcctgaccggggagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggacccccggcggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3095 - DNA, 6309 bp, Artificial Sequence
  Description of Artificial Sequence: Synthetic coding sequence
atgctgtgctgcctgctggtgcgggccagcaacctgcccagcgccaagaaggacagaagaagtgaccctgtggccagcctgaccttccggggcgtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccaccggggccagcctggtgctgcaggtgtcctacacccccctgcccggggctgtgcccctcttccccccacccacccccctggagcccagccccaccctgcctgacctggatgtggtggccgacacaggaggagaggaggacacagaggaccagggcctgactggagatgaagctgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccactggagtggccctgcggggggcccacttctgcctgaaggtgttccgggcagaggacctgccccagatggatgatgctgtgatggacaacgtgaagcagatctttggatttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggaggagcctgctggagctgtgaagcccagcaaggccagtgacctggatgactacctgggcttcctgcccaccttcggcccctgctacatcaacctgtatggcagcccccgggagttcaccggcttcccagacccctacacagagctgaacacaggaaaaggagagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccacagaattgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagaccccatctgccacccacctggaccagtacctgtaccagctgcggacccaccacctgagccagatcacagaagctgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagcagaagaggagccaactactgcggcaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacatcgagtgccccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtctgaggacagcatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagccccccagcatcgtggtggagctgtatgaccatgacacctatggagcagatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggccggcggcctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccagctggctgatggcctgagcagcctggcccccaccaacacagccagcccccccagcagcccccatgaggaggagttcatcgactggtggagcaagttctttgccagcattggagagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtcatcggggagttcaagggcctcttcaagatctaccccctgcctgaggaccctgccatccccatgccaccccggcagttccaccagctggccgcccagggcccccaggagtgcctggtgcgcatctacatcgtgcgggccttcggcctgcagcccaaggaccccaacgggaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagattggagagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaagctggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccccggcgggcccggcgcttcttcctgcgctgcatcatctggaacaccagagatgtgatcctggatgacctgagcctgactggagagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggaccccaggaggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3096 - DNA, 6357 bp, Artificial Sequence
  Description of Artificial Sequence: Synthetic coding sequence
atgctgcgggtcttcatcctgtatgcagaaaatgtgcacaccccagacacagacatcagtgatgcctactgcagcgctgtgtttgctggggtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccactggagccagcctggtgctgcaggtgtcctacacccccctgcctggagctgtgcccctcttccccccacccacccccctggagcccagccccaccctgcctgacctggatgtggtggccggcggcggccagagcagagctgagacctggagcctgctgagtgacagcaccatggacacccgctacagcggcaagaagtggccagcccccacagacacaggaggagaggaggacacagaggaccagggcctgactggagatgaagctgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccactggagtggccctgcggggggcccacttctgcctgaaggtgttccgggcagaggacctgccccagatggatgatgctgtgatggacaacgtgaagcagatctttggatttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggtggatgactacctgggcttcctgcccaccttcggcccctgctacatcaacctgtatggcagcccccgggagttcaccggcttcccagacccctacacagagctgaacacaggaaaaggagagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccacagaattgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagaccccatctgccacccacctggaccagtacctgtaccagctgcggacccaccacctgagccagatcacagaagctgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagcagaagaggagccaactactgcggcaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacatcgagtgccccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtctgaggacagcatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagccccccagcatcgtggtggagctgtatgaccatgacacctatggagcagatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggccggcggcctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccagctggctgatggcctgagcagcctggcccccaccaacacagccagcccccccagcagcccccatgaggaggagttcatcgactggtggagcaagttctttgccagcattggagagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtcatcggggagttcaagggcctcttcaagatctaccccctgcctgaggaccctgccatccccatgccaccccggcagttccaccagctggccgcccagggcccccaggagtgcctggtgcgcatctacatcgtgcgggccttcggcctgcagcccaaggaccccaacgggaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagattggagagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaagctggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccccggcgggcccggcgcttcttcctgcgctgcatcatctggaacaccagagatgtgatcctggatgacctgagcctgactggagagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggaccccaggaggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3097 - DNA, 6339 bp, Artificial Sequence
  Description of Artificial Sequence: Synthetic coding sequence
atgctgtgctgcctgctggtgcgggccagcaacctgcccagcgccaagaaggacagaagaagtgaccctgtggccagcctgaccttccggggcgtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccaccggggccagcctggtgctgcaggtgtcctacacccccctgcccggggctgtgcccctcttccccccacccacccccctggagcccagccccaccctgcctgacctggatgtggtggccggcggcggccagagcagagctgagacctggagcctgctgagtgacagcaccatggacacccgctacagcggcaagaagtggccagcccccacagacaccggcggggaggaggacacagaggaccagggcctgactggagatgaggccgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccaccggggtggccctgcggggggcccacttctgcctgaaggtgttccgggcagaggacctgccccagatggatgatgctgtgatggacaacgtgaagcagatcttcggctttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggaggagcctgctggagctgtgaagcccagcaaggccagtgacctggatgactacctgggcttcctgcccaccttcggcccctgctacatcaacctgtatggcagcccccgggagttcaccggcttcccagacccctacacagagctgaacacaggcaagggggagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccaccgcatcgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagacccccagcgccacccacctggaccagtacctgtaccagctgcggacccaccacctgagccagatcacagaggccgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagccggcggggggccaactactgtgggaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacattgaatgtcccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtcagaagattccatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagcccccatccatcgtggtggagctgtatgaccatgacacctacggggctgatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggaagaagacctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccaggaggaggagttcatcgactggtggagcaagttctttgccagcattggagagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtcatcggggagttcaagggcctcttcaagatctaccccctgcctgaggaccctgccatccccatgccaccccggcagttccaccagctggccgcccagggcccccaggagtgcctggtgcgcatctacatcgtgcgggccttcggcctgcagcccaaggaccccaacgggaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagattggagagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaagctggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccccggcgggcccggcgcttcttcctgcgctgcatcatctggaacaccagagatgtgatcctggatgacctgagcctgactggagagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggaccccaggaggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3098 - DNA, 6267 bp, Artificial Sequence
  Description of Artificial Sequence: Synthetic coding sequence
atgctgtgctgcctgctggtgcgggccagcaacctgcccagcgccaagaaggacagaagaagtgaccctgtggccagcctgaccttccggggcgtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccaccggggccagcctggtgctgcaggtgtcctacacccccctgcccggggctgtgcccctcttccccccacccacccccctggagcccagccccaccctgcctgacctggatgtggtggccgacacaggaggagaggaggacacagaggaccagggcctgactggagatgaagctgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccactggagtggccctgcggggggcccacttctgcctgaaggtgttccgggcagaggacctgccccagatggatgatgctgtgatggacaacgtgaagcagatctttggatttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggtggatgactacctgggcttcctgcccaccttcggcccctgctacatcaacctgtatggcagcccccgggagttcaccggcttcccagacccctacacagagctgaacacaggaaaaggagagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccacagaattgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagaccccatctgccacccacctggaccagtacctgtaccagctgcggacccaccacctgagccagatcacagaagctgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagcagaagaggagccaactactgcggcaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacatcgagtgccccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtctgaggacagcatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagccccccagcatcgtggtggagctgtatgaccatgacacctatggagcagatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggccggcggcctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccagctggctgatggcctgagcagcctggcccccaccaacacagccagcccccccagcagcccccatgaggaggagttcatcgactggtggagcaagttctttgccagcattggagagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtcatcggggagttcaagggcctcttcaagatctaccccctgcctgaggaccctgccatccccatgccaccccggcagttccaccagctggccgcccagggcccccaggagtgcctggtgcgcatctacatcgtgcgggccttcggcctgcagcccaaggaccccaacgggaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagattggagagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaagctggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccccggcgggcccggcgcttcttcctgcgctgcatcatctggaacaccagagatgtgatcctggatgacctgagcctgactggagagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggaccccaggaggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3099 - DNA, 6294 bp, Artificial Sequence
  Description of Artificial Sequence: Synthetic coding sequence
atgctgcgggtcttcatcctgtatgcagaaaatgtgcacaccccagacacagacatcagtgatgcctactgcagcgctgtgtttgctggggtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccactggagccagcctggtgctgcaggtgtcctacacccccctgcctggagctgtgcccctcttccccccacccacccccctggagcccagccccaccctgcctgacctggatgtggtggccggcggcggccagagcagagctgagacctggagcctgctgagtgacagcaccatggacacccgctacagcggcaagaagtggccagcccccacagacacaggaggagaggaggacacagaggaccagggcctgactggagatgaagctgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccactggagtggccctgcggggggcccacttctgcctgaaggtgttccgggcagaggacctgccccagatggatgatgctgtgatggacaacgtgaagcagatctttggatttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggtggatgactacctgggcttcctgcccaccttcggcccctgctacatcaacctgtatggcagcccccgggagttcaccggcttcccagacccctacacagagctgaacacaggaaaaggagagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccacagaattgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagaccccatctgccacccacctggaccagtacctgtaccagctgcggacccaccacctgagccagatcacagaagctgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagcagaagaggagccaactactgcggcaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacatcgagtgccccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtctgaggacagcatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagccccccagcatcgtggtggagctgtatgaccatgacacctatggagcagatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggccggcggcctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccaggaggaggagttcatcgactggtggagcaagttctttgccagcatcggggagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtgattggagagttcaagggcctcttcaagatctaccccctgcctgaagatcctgccatccccatgccaccccggcagttccaccagctggccgcccagggcccccaggagtgcctggtgcgcatctacatcgtgcgggccttcggcctgcagcccaaggaccccaatggaaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagatcggggagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaggccggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccaagaagagcccggcgcttcttcctgcgctgcatcatctggaacaccagagatgtgatcctggatgacctgagcctgaccggggagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggacccccggcggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3100 - DNA, 6360 bp, Artificial Sequence
  Description of Artificial Sequence: Synthetic coding sequence
atgctgtgctgcctgctggtgcgggccagcaacctgcccagcgccaagaaggacagaagaagtgaccctgtggccagcctgaccttccggggcgtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccaccggggccagcctggtgctgcaggtgtcctacacccccctgcccggggctgtgcccctcttccccccacccacccccctggagcccagccccaccctgcctgacctggatgtggtggccggcggcggccagagcagagctgagacctggagcctgctgagtgacagcaccatggacacccgctacagcggcaagaagtggccagcccccacagacaccggcggggaggaggacacagaggaccagggcctgactggagatgaggccgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccaccggggtggccctgcggggggcccacttctgcctgaaggtgttccgggcagaggacctgccccagatggatgatgctgtgatggacaacgtgaagcagatcttcggctttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggtggatgactacctgggcttcctgcccaccttcggcccctgctacatcaacctgtatggcagcccccgggagttcaccggcttcccagacccctacacagagctgaacacaggcaagggggagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccaccgcatcgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagacccccagcgccacccacctggaccagtacctgtaccagctgcggacccaccacctgagccagatcacagaggccgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagccggcggggggccaactactgtgggaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacattgaatgtcccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtcagaagattccatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagcccccatccatcgtggtggagctgtatgaccatgacacctacggggctgatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggaagaagacctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccagctggctgatggcctgagcagcctggcccccaccaacacagccagcccccccagcagcccccatgaggaggagttcatcgactggtggagcaagttctttgccagcatcggggagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtgattggagagttcaagggcctcttcaagatctaccccctgcctgaagatcctgccatccccatgccaccccggcagttccaccagctggccgcccagggcccccaggagtgcctggtgcgcatctacatcgtgcgggccttcggcctgcagcccaaggaccccaatggaaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagatcggggagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaggccggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccaagaagagcccggcgcttcttcctgcgctgcatcatctggaacaccagagatgtgatcctggatgacctgagcctgaccggggagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggacccccggcggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3101 - DNA, 6297 bp, Artificial Sequence
  Description of Artificial Sequence: Synthetic coding sequence
atgctgtgctgcctgctggtgcgggccagcaacctgcccagcgccaagaaggacagaagaagtgaccctgtggccagcctgaccttccggggcgtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccaccggggccagcctggtgctgcaggtgtcctacacccccctgcccggggctgtgcccctcttccccccacccacccccctggagcccagccccaccctgcctgacctggatgtggtggccggcggcggccagagcagagctgagacctggagcctgctgagtgacagcaccatggacacccgctacagcggcaagaagtggccagcccccacagacaccggcggggaggaggacacagaggaccagggcctgactggagatgaggccgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccaccggggtggccctgcggggggcccacttctgcctgaaggtgttccgggcagaggacctgccccagatggatgatgctgtgatggacaacgtgaagcagatcttcggctttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggtggatgactacctgggcttcctgcccaccttcggcccctgctacatcaacctgtatggcagcccccgggagttcaccggcttcccagacccctacacagagctgaacacaggcaagggggagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccaccgcatcgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagacccccagcgccacccacctggaccagtacctgtaccagctgcggacccaccacctgagccagatcacagaggccgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagccggcggggggccaactactgtgggaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacattgaatgtcccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtcagaagattccatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagcccccatccatcgtggtggagctgtatgaccatgacacctacggggctgatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggaagaagacctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccaggaggaggagttcatcgactggtggagcaagttctttgccagcattggagagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtcatcggggagttcaagggcctcttcaagatctaccccctgcctgaggaccctgccatccccatgccaccccggcagttccaccagctggccgcccagggcccccaggagtgcctggtgcgcatctacatcgtgcgggccttcggcctgcagcccaaggaccccaacgggaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagattggagagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaagctggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccccggcgggcccggcgcttcttcctgcgctgcatcatctggaacaccagagatgtgatcctggatgacctgagcctgactggagagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggaccccaggaggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3102 - DNA, 6336 bp, Artificial Sequence
  Description of Artificial Sequence: Synthetic coding sequence
atgctgcgggtcttcatcctgtatgcagaaaatgtgcacaccccagacacagacatcagtgatgcctactgcagcgctgtgtttgctggggtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccactggagccagcctggtgctgcaggtgtcctacacccccctgcctggagctgtgcccctcttccccccacccacccccctggagcccagccccaccctgcctgacctggatgtggtggccggcggcggccagagcagagctgagacctggagcctgctgagtgacagcaccatggacacccgctacagcggcaagaagtggccagcccccacagacacaggaggagaggaggacacagaggaccagggcctgactggagatgaagctgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccactggagtggccctgcggggggcccacttctgcctgaaggtgttccgggcagaggacctgccccagatggatgatgctgtgatggacaacgtgaagcagatctttggatttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggaggagcctgctggagctgtgaagcccagcaaggccagtgacctggatgactacctgggcttcctgcccaccttcggcccctgctacatcaacctgtatggcagcccccgggagttcaccggcttcccagacccctacacagagctgaacacaggaaaaggagagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccacagaattgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagaccccatctgccacccacctggaccagtacctgtaccagctgcggacccaccacctgagccagatcacagaagctgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagcagaagaggagccaactactgcggcaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacatcgagtgccccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtctgaggacagcatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagccccccagcatcgtggtggagctgtatgaccatgacacctatggagcagatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggccggcggcctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccaggaggaggagttcatcgactggtggagcaagttctttgccagcatcggggagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtgattggagagttcaagggcctcttcaagatctaccccctgcctgaagatcctgccatccccatgccaccccggcagttccaccagctggccgcccagggcccccaggagtgcctggtgcgcatctacatcgtgcgggccttcggcctgcagcccaaggaccccaatggaaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagatcggggagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaggccggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccaagaagagcccggcgcttcttcctgcgctgcatcatctggaacaccagagatgtgatcctggatgacctgagcctgaccggggagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggacccccggcggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3103 - DNA, 6306 bp, Artificial Sequence
  Description of Artificial Sequence: Synthetic coding sequence
atgctgcgggtcttcatcctgtatgcagaaaatgtgcacaccccagacacagacatcagtgatgcctactgcagcgctgtgtttgctggggtgaagaagaggaccaaggtgatcaagaacagcgtgaaccctgtgtggaatgaaggatttgagtgggacctgaagggcatccccctggaccagggcagcgagctgcacgtggtggtgaaggaccacgagaccatgggcaggaaccgcttcctgggggaggccaaggtgcccctgcgggaggtgctggccacccccagcctgagcgccagcttcaatgcccccctgctggacaccaagaagcagcccactggagccagcctggtgctgcaggtgtcctacacccccctgcctggagctgtgcccctcttccccccacccacccccctggagcccagccccaccctgcctgacctggatgtggtggccgacaccggcggggaggaggacacagaggaccagggcctgactggagatgaggccgagcccttcctggaccagagcggcggccctggggcccccaccacccccaggaagctgcccagccggcccccaccccactacccaggcatcaagaggaagaggtctgcccccaccagcaggaagctgctgagtgacaagccccaggacttccagatccgggtgcaggtgattgagggccggcagctgcccggggtgaacatcaagcctgtggtgaaggtgacagctgctggccagaccaagaggacccgcatccacaagggcaacagccccctcttcaatgagaccctcttcttcaacctgtttgacagccctggagagctgtttgatgagcccatcttcatcaccgtggtggacagccgcagcctgaggacagatgccctgctgggggagttcaggatggatgtgggcaccatctaccgggagcccaggcatgcctacctgaggaagtggctgctgctgagtgaccctgatgacttctctgctggggcccggggctacctgaagaccagcctgtgtgtgctgggccctggagatgaggcccccctggagaggaaggaccccagcgaggacaaggaggacatcgagagcaacctgctgcggcccaccggggtggccctgcggggggcccacttctgcctgaaggtgttccgggcagaggacctgccccagatggatgatgctgtgatggacaacgtgaagcagatcttcggctttgagagcaacaagaagaacctggtggacccctttgtggaggtgtcctttgctgggaagatgctgtgcagcaagatcctggagaagacagccaacccccagtggaaccagaacatcaccctgcctgccatgttccccagcatgtgtgagaagatgaggatccgcatcatcgactgggaccggctgacccacaatgacatcgtggccaccacctacctgtccatgagcaagatcagcgcccctggaggagaaattgaggaggagcctgctggagctgtgaagcccagcaaggccagtgacctggatgactacctgggcttcctgcccaccttcggcccctgctacatcaacctgtatggcagcccccgggagttcaccggcttcccagacccctacacagagctgaacacaggcaagggggagggcgtggcctaccggggccgcctgctgctgagcctggagaccaagctggtggagcacagcgagcagaaggtggaggacctgcctgcagatgacatcctgcgggtggagaagtacctgcggcggaggaagtacagcctgtttgctgccttctacagcgccaccatgctgcaggatgtggatgatgccatccagtttgaggtgtccatcggcaactacggcaacaagtttgacatgacctgcctgcccctggccagcaccacccagtacagcagagctgtgtttgatggctgccactactactacctgccctggggcaatgtgaagcctgtggtggtgctgagcagctactgggaggacatcagccaccgcatcgagacccagaaccagctgctgggcattgctgaccggctggaggccggcctggagcaggtgcacctggccctgaaggcccagtgcagcacagaagatgtggacagcctggtggcccagctgacagatgagctgattgctggctgcagccagcccctgggggacatccacgagacccccagcgccacccacctggaccagtacctgtaccagctgcggacccaccacctgagccagatcacagaggccgccctggccctgaagctgggccacagcgagctgcctgctgccctggagcaggccgaggactggctgctgcggctgcgggccctggccgaggagccccagaacagcctgcctgacatcgtcatctggatgctgcagggcgacaagagggtggcctaccagagggtgcctgcccaccaggtgctcttcagccggcggggggccaactactgtgggaagaactgtgggaagctgcagaccatcttcctgaagtaccccatggagaaggtgcctggggccaggatgcctgtgcagatccgggtgaagctgtggtttggcctgtctgtggatgagaaggagttcaaccagtttgctgagggcaagctgtctgtgtttgctgagacctatgaaaatgagaccaagctggccctggtgggcaactggggcaccaccggcctgacctaccccaagttcagtgatgtgacaggcaagatcaagctgcccaaggacagcttccggcccagcgctggctggacctgggccggggactggtttgtgtgcccagagaagaccctgctgcatgacatggatgctggccacctgagctttgtggaggaggtgtttgagaaccagacccggctgcccggcggccagtggatctacatgtctgacaactacacagatgtgaatggagagaaggtgctgcccaaggatgacattgaatgtcccctgggctggaagtgggaggatgaggagtggagcacagacctgaacagagctgtggatgagcagggctgggagtacagcatcaccatccccccagagaggaagcccaagcactgggtgcctgctgagaagatgtactacacccacagaagaagacgctgggtgcggctgcggcggcgggacctgagccagatggaggccctgaagaggcaccggcaggccgaggccgagggggagggctgggagtatgccagcctgtttggctggaagttccacctggagtacaggaagacagatgccttcagaagaagacgctggaggaggaggatggagcccctggagaagacaggccctgctgctgtgtttgccctggagggcgccctgggcggcgtgatggatgacaagtcagaagattccatgtctgtgtccaccctgagctttggagtgaaccggcccaccatcagctgcatctttgattatggcaaccgctaccacctgcgctgctacatgtaccaggcccgggacctggccgccatggacaaggacagcttcagtgacccctatgccatcgtgtccttcctgcaccagagccagaagacagtggtggtgaagaacaccctgaaccccacctgggaccagaccctcatcttctatgaaattgagatctttggagagcccgccaccgtggccgagcagcccccatccatcgtggtggagctgtatgaccatgacacctacggggctgatgagttcatgggccgctgcatctgccagcccagcctggagaggatgccccggctggcctggttccccctgacccggggcagccagcccagcggggagctgctggccagctttgagctgatccagcgggagaagccagccatccaccacatccctggctttgaggtgcaggagaccagccgcatcctggatgaaagtgaggacacagacctgccctaccccccaccccagcgggaggccaacatctacatggtgccccagaacatcaagccagccctgcagaggacagccatcgagatcctggcctggggcctgaggaacatgaagagctaccagctggccaacatcagcagccccagcctggtggtggagtgtggcggccagacagtgcagagctgtgtgatccggaacctgaggaagaaccccaactttgacatctgcaccctcttcatggaggtgatgctgccccgggaggagctgtactgcccccccatcaccgtgaaggtgattgacaaccggcagtttggaagaagacctgtggtgggccagtgcaccatccgcagcctggagagcttcctgtgtgacccctacagcgctgagagccccagcccccagggcggcccagatgatgtgtccctgctgagccctggagaagatgtgctgattgatattgatgacaaggagcccctcatccccatccagctggctgatggcctgagcagcctggcccccaccaacacagccagcccccccagcagcccccatgaggaggagttcatcgactggtggagcaagttctttgccagcatcggggagcgggagaagtgtggcagctacctggagaaggactttgacaccctgaaggtgtatgacacccagctggagaatgtggaggcctttgagggcctgagtgacttctgcaacaccttcaagctgtaccggggcaagacccaggaggagacagaggaccccagcgtgattggagagttcaagggcctcttcaagatctaccccctgcctgaagatcctgccatccccatgccaccccggcagttccaccagctggccgcccagggcccccaggagtgcctggtgcgcatctacatcgtgcgggccttcggcctgcagcccaaggaccccaatggaaaatgtgacccctacatcaagatcagcatcggcaagaagtctgtgtctgaccaggacaactacatcccctgcaccctggagcctgtgtttgggaagatgtttgagctgacctgcaccctgcccctggagaaggacctgaagatcaccctgtatgactatgacctgctgagcaaggatgagaagatcggggagaccgtggtggacctggagaaccggctgctgagcaagtttggagcccgctgtggcctgccccagacctactgtgtgtctggccccaaccagtggagggaccagctgcggcccagccagctgctgcacctgttctgccagcagcaccgggtgaaggcccctgtgtacagaacagacagagtgatgttccaggacaaggagtacagcattgaggagattgaggccggccgcatccccaacccccacctgggccctgtggaggagcggctggccctgcacgtgctgcagcagcagggcctggtgcctgagcacgtggagagccggcccctgtacagccccctgcagcctgacatcgagcagggcaagctgcagatgtgggtggacctcttccccaaggccctgggccggcccggcccccccttcaacatcaccccaagaagagcccggcgcttcttcctgcgctgcatcatctggaacaccagagatgtgatcctggatgacctgagcctgaccggggagaagatgtctgacatctacgtgaagggctggatgattggatttgaggagcacaagcagaagacagatgtgcactaccgcagcctgggcggggagggcaacttcaactggaggttcatcttcccctttgactacctgcctgctgagcaggtgtgcaccatcgccaagaaggatgccttctggaggctggacaagacagagagcaagatcccagcccgggtggtgttccagatctgggacaatgacaagttctcctttgatgacttcctgggcagcctgcagctggacctgaacaggatgcccaagccagccaagacagccaagaagtgcagcctggaccagctggatgatgccttccaccctgagtggtttgtgtccctgtttgagcagaagacagtgaagggctggtggccctgtgtggccgaggagggggagaagaagatcctggccggcaagctggagatgaccctggagatcgtggccgagagcgagcacgaggagaggcctgctggccagggcagagatgagcccaacatgaaccccaagctggaggacccccggcggccagacaccagcttcctgtggttcaccagcccctacaagaccatgaagttcatcctgtggaggcgcttccgctgggccatcatcctcttcatcatcctcttcatcctgctgctcttcctggccatcttcatctatgccttccccaactatgctgccatgaagctggtgaagcccttctcctag

SEQ ID NO: 3104 - DNA, 447 bp, Artificial Sequence
  Description of Artificial Sequence: Synthetic coding sequence
atgggctacccagaggtggagcggcgggagctgctgcctgctgctgccccccgggagcggggcagccagggctgcggctgcggcggggccccagcccgggccggggagggcaacagctgcctgctcttcctgggcttcttcggcctgagcctggccctgcacctgctgaccctgtgctgctacctggagctgcggtctgagctgcggcgggagagaggagctgagagccggctgggcggcagcggcaccccaggcaccagcggcaccctgagcagcctgggcggcctggaccctgacagccccatcaccagccacctgggccagcccagccccaagcagcagcccctggagcccggggaggccgccctgcacagcgacagccaggacggccaccaggactttgactacatcatctccttctcctatggcctgcagggcttctgctag

SEQ ID NO: 3105 - DNA, 1176 bp, Artificial Sequence
  Description of Artificial Sequence: Synthetic coding sequence
atgggctacccagaggtggagcggcgggagctgctgcctgctgctgccccccgggagcggggcagccagggctgcggctgcggcggggccccagcccgggccggggagggcaacagctgcctgctcttcctgggcttcttcggcctgagcctggccctgcacctgctgaccctgtgctgctacctggagctgcggtctgagctgcggcgggagagaggagctgagagccggctgggcggcagcggcaccccaggcaccagcggcaccctgagcagcctgggcggcctggaccctgacagccccatcaccagccacctgggccagcccagccccaagcagcagcccctggagcccggggaggccgccctgcacagcgacagccaggacggccaccagatggccctgctgaacttcttcttcccagatgagaagccctacagcgaggaggagagccggcgggtgagaagaaacaagaggagcaagagcaatgaaggagcagatggccctgtgaagaacaagaagaagggcaagaaggccggccccccaggccccaatggacctcctggccccccaggccccccaggcccccagggccccccaggcatccctggcatccctggcatccctggcaccaccgtgatgggccccccaggccccccaggccccccaggcccccagggccccccaggcctgcagggccccagcggggctgctgacaaggccggcacccgggagaaccagcctgctgtggtgcacctgcagggccagggcagcgccatccaggtgaagaatgacctgtctggaggagtgctgaatgactggagccgcatcaccatgaaccccaaggtgttcaagctgcaccccaggtctggagagctggaggtgctggtggatggcacctacttcatctacagccaggtggaggtgtactacatcaacttcacagactttgccagctatgaggtggtggtggatgagaagcccttcctgcagtgcaccaggagcattgagaccgggaagaccaactacaacacctgctacacagctggggtgtgcctgctgaaggcccggcagaagattgctgtgaagatggtgcatgctgacatcagcatcaacatgagcaagcacaccaccttcttcggggccatccggctgggggaggccccagccagctag

SEQ ID NO: 3106 - DNA, 1170 bp, Artificial Sequence
  Description of Artificial Sequence: Synthetic coding sequence
atgggctacccagaggtggagcggcgggagctgctgcctgctgctgccccccgggagcggggcagccagggctgcggctgcggcggggccccagcccgggccggggagggcaacagctgcctgctcttcctgggcttcttcggcctgagcctggccctgcacctgctgaccctgtgctgctacctggagctgcggtctgagctgcggcgggagagaggagctgagagccggctgggcggcagcggcaccccaggcaccagcggcaccctgagcagcctgggcggcctggaccctgacagccccatcaccagccacctgggccagcccagccccaagcagcagcccctggagcccggggaggccgccctgcacagcgacagccaggacggccaccagatggccctgctgaacttcttcttcccagatgagaagccctacagcgaggaggagagccggcgggtgagaagaaacaagaggagcaagagcaatgaaggagcagatggccctgtgaagaacaagaagaagggcaagaaggccggccccccaggccccaatggacctcctggccccccaggccccccaggcccccagggccccccaggcatccctggcatccctggcatccctggcaccaccgtgatgggccccccaggccccccaggccccccaggcccccagggccccccaggcctgcagggccccagcggggctgctgacaaggccggcacccgggagaaccagcctgctgtggtgcacctgcagggccagggcagcgccatccaggtgaagaatgacctgtctggaggagtgctgaatgactggagccgcatcaccatgaaccccaaggtgttcaagctgcaccccaggtctggagagctggaggtgctggtggatggcacctacttcatctacagccaggtgtactacatcaacttcacagactttgccagctatgaggtggtggtggatgagaagcccttcctgcagtgcaccaggagcattgagaccgggaagaccaactacaacacctgctacacagctggggtgtgcctgctgaaggcccggcagaagattgctgtgaagatggtgcatgctgacatcagcatcaacatgagcaagcacaccaccttcttcggggccatccggctgggggaggccccagccagctag

SEQ ID NO: 3107 - DNA, 408 bp, Artificial Sequence
  Description of Artificial Sequence: Synthetic coding sequence
atgggctacccagaggtggagcggcgggagctgctgcctgctgctgccccccgggagcggggcagccagggctgcggctgcggcggggccccagcccgggccggggagggcaacagctgcctgctcttcctgggcttcttcggcctgagcctggccctgcacctgctgaccctgtgctgctacctggagctgcggtctgagctgcggcgggagagaggagctgagagccggctgggcggcagcggcaccccaggcaccagcggcaccctgagcagcctgggcggcctggaccctgacagccccatcaccagccacctgggccagcccagccccaagcagcagcccctggagcccggggaggccgccctgcacagcgacagccaggacggccaccagggccaccagtag

SEQ ID NO: 3108 - DNA, 1161 bp, Artificial Sequence
  Description of Artificial Sequence: Synthetic coding sequence
atgggctacccagaggtggagcggcgggagctgctgcctgctgctgccccccgggagcggggcagccagggctgcggctgcggcggggccccagcccgggccggggagggcaacagctgcctgctcttcctgggcttcttcggcctgagcctggccctgcacctgctgaccctgtgctgctacctggagctgcggtctgagctgcggcgggagagaggagctgagagccggctgggcggcagcggcaccccaggcaccagcggcaccctgagcagcctgggcggcctggaccctgacagccccatcaccagccacctgggccagcccagccccaagcagcagcccctggagcccggggaggccgccctgcacagcgacagccaggacggccaccagatggccctgctgaacttcttcttcccagatgagaagccctacagcgaggaggagagccggcgggtgagaagaaacaagaggagcaagagcaatgaaggagcagatggccctgtgaagaacaagaagaagggcaagaaggccggccccccaggccccaatggacctcctggccccccaggccccccaggcccccagggccccccaggcatccctggcatccctggcatccctggcaccaccgtgatgggccccccaggccccccaggccccccaggcccccagggccccccaggcctgcagggccccagcggggctgctgacaaggccggcacccgggagaaccagcctgctgtggtgcacctgcagggccagggcagcgccatccaggtgaagaatggaggagtgctgaatgactggagccgcatcaccatgaaccccaaggtgttcaagctgcaccccaggtctggagagctggaggtgctggtggatggcacctacttcatctacagccaggtgtactacatcaacttcacagactttgccagctatgaggtggtggtggatgagaagcccttcctgcagtgcaccaggagcattgaaacaggcaagaccaactacaacacctgctacacagctggggtgtgcctgctgaaggcccggcagaagattgctgtgaagatggtgcacgccgacatcagcatcaacatgagcaagcacaccaccttctttggagccatccggctgggggaggccccagccagctag

SEQ ID NO: 3109 - DNA, 447 bp, Artificial Sequence; identical to SEQ ID NO: 3104
  Description of Artificial Sequence: Synthetic coding sequence

SEQ ID NO: 3110 - DNA, 3429 bp, Artificial Sequence
  Description of Artificial Sequence: Synthetic coding sequence
atgctggtgctgcgctgccgcctgggcaccagcttccccaagctggacaacctggtgcccaagggcaagatgaagatcctgctggtgttcctgggcctgctgggcaacagcgtggccatgcccatgcacatgcccaggatgcctggcttcagcagcaagtctgaggagatgatgagatacaaccagttcaacttcatgaatggcccccacatggcccacctgggccccttctttggaaatggcctgccccagcagttcccccagtaccagatgcccatgtggccccagcccccacccaacacctggcaccccaggaagagcagcgcccccaagaggcacaacaagacagaccagacccaggagacccagaagcccaaccagacccagagcaagaagccaccccagaagaggcccctgaagcagcccagccacaaccagccccagcctgaggaggaggcccagcccccccaggccttccccccatttggaaatggcctcttcccctaccagcagcccccctggcagatcccccagaggctgcccccacctggctacggccggccccccatcagcaatgaggagggcggcaacccctacttcggctacttcggctaccacggctttggaggccggcccccctactacagcgaggagatgtttgagcaggactttgagaagcccaaggaggaggacccccccaaggccgagagccctggaacagagcccacagccaacagcacagtgacagagaccaacagcacccagcccaaccccaagggcagccagggcggcaatgacaccagccccaccggcaacagcaccccaggcctgaacacaggcaacaaccccccagcccagaatggaattggccccctgcctgctgtgaatgccagcggccagggcggccctggcagccagatcccctggaggcccagccagcccaacatccgggagaaccacccctaccccaacatccggaacttccccagcggccggcagtggtacttcaccggcaccgtgatgggccaccggcagaaccggcccttctacagaaaccagcaggtgcagaggggcccccgctggaacttctttgcctgggagaggaagcaggtggcccggcccggcaaccctgtgtaccacaaggcctacccacccaccagccggggcaactaccccaactatgccggcaacccagccaacctgcggaggaagccccagggccccaacaagcaccctgtgggcaccaccgtggcccccctgggccccaagccaggccctgtggtgagaaatgagaagatccagaaccccaaggagaagcccctgggccccaaggagcagatcatcgtgcccaccaagaaccccaccagcccctggaggaacagccagcagtatgaggtgaacaagagcaactacaagctgccccacagcgagggctacatgcctgtgcccaacttcaacagcgtggaccagcacgagaacagctactaccccaggggggacagcaggaaggtgcccaacagtgatggccagacccagagccagaacctgcccaagggcatcgtgctgggcagcaggaggatgccctatgaaagtgagaccaaccagagcgagctgaagcacagcagctaccagcctgctgtgtacccagaggagatccccagccctgccaaggagcacttccctgctggcaggaacacctgggaccaccaggagatcagcccccccttcaaggaggaccccggccggcaggaggagcacctgccccaccccagccacggcagccggggctctgtgttctacccagagtacaacccctatgacccccgggagaacagcccctacctgcggggcaacacctgggatgaaagagatgacagccccaacaccatgggccagaaggagagccccctgtaccccatcaacaccccagaccagaaggagatcgtgccctacaatgaggaggaccctgtggaccccactggagatgaggtgtttcctggccagaaccgctggggcgaggagctgtccttcaagggcggccccaccgtgcgccactatgaaggagagcagtacaccagcaaccagcccaaggagtacctgccctacagcctggacaaccccagcaagccccgggaggacttctactacagcgagttctacccctggagcccagatgagaacttccccagctacaacacagccagcaccatgcccccacccatcgagagccggggctactacgtgaacaatgctgctggccctgaggagagcaccctcttccccagcagaaattcctgggaccaccgcatccaggcccagggccagcgggagcggcggccctacttcaacagaaacatctgggaccaggccacccacctgcagaaggccccagcccggcccccagaccagaagggcaaccagccctactacagcaacaccccagctggcctgcagaagaaccccatctggcatgaaggagagaacctgaactacggcatgcagatcaccaggatgaacagccctgagcgggagcacagcagcttccccaacttcatccccccatcctaccccagcggccagaaggaggcccacctgttccacctgagccagaggggcagctgctgtgccggcagcagcacaggccccaaggacaaccccctggccctgcaggactacacccccagctatggcctggcccctggagagaaccaggacaccagccccctgtacacagatggcagccacaccaagcagacccgggacatcatcagccccaccagcatcctgcccggccagaggaacagcagcgagaagcgggagagccagaaccccttcagagatgatgtgtccaccctgcggaggaacaccccctgcagcatcaagaaccagctgggccagaaggagatcatgcccttccctgaggccagcagcctgcagagcaagaacaccccctgcctgaagaatgacctgggcggagatggcaacaacatcctggagcaggtgtttgaggacaaccagctgaatgaaagaacagtggacctgaccccagagcagctggtgattggcaccccagatgagggcagcaaccctgagggcatccagagccaggtgcaggagaatgaaagtgagcggcagcagcagaggcccagcaacatcctgcacctgccctgcttcggcagcaagctggccaagcaccacagcagcaccaccggcacccccagcagtgatggccggcagagcccctttgatggagacagcatcacccccacagagaaccccaacaccctggtggagctggccacagaggagcagttcaagagcatcaacgtggaccccctggatgctgatgagcacagcccctttgagttcctgcagaggggcaccaacgtgcaggaccaggtgcaggactgcctgctgctgcaggcctag

SEQ ID NO: 3111 - DNA, 582 bp, Artificial Sequence
  Description of Artificial Sequence: Synthetic coding sequence
atgggcgtgcatgaatgtcctgcctggctgtggctgctgctgagcctgctgagcctgcccctgggcctgcctgtgctgggcgccccacccaggctcatctgtgacagccgggtgctggagcgctacctgctggaggccaaggaggccgagaacatcaccaccggctgtgccgagcactgcagcctgaatgaaaacatcaccgtgcctgacaccaaggtgaacttctacgcctggaagaggatggaggtgggccagcaggccgtggaggtgtggcagggcctggccctgctgtctgaggccgtgctgcggggccaggccctgctggtgaacagcagccagccctgggagcccctgcagctgcacgtggacaaggctgtgtctggcctgcggagcctgaccaccctgctgcgggccctgggcgcccagaaggaggccatcagccccccagatgctgccagcgctgcccccctgcggaccatcacagctgacaccttcaggaagctgttccgggtgtacagcaacttcctgcggggcaagctgaagctgtacaccggggaggcctgcaggactggagacagatag

SEQ ID NO: 3112 - DNA, 192 bp, Artificial Sequence
  Description of Artificial Sequence: Synthetic coding sequence
atgcccagctctgtgtcctggggcatcctgctgctggccggcctgtgctgcctggtgcctgtgtccctggcccatggagagggcaccttcaccagtgacctgagcaagcagatggaggaggaggccgtgcggctcttcatcgagtggctgaagaatggaggccccagcagcggggcccccccacccagctag

SEQ ID NO: 3113 - DNA, 1050 bp, Artificial Sequence
  Description of Artificial Sequence: Synthetic coding sequence
atggaggccgtgaaggccgaggcctgggagggcgctgctgtggcccaggacctgctggccctgggctatggaggagtgcctggagctgccagcagaggagccagctgcccagacttccggggcctgtgtgtgcggctggccgctgagctggccaccctgggcgccctggagcagcagcgggaggccggggctgaggtgctgtctgctggagatggccctggagctgaggaggacttcctgcggcagctgggcagcctgctgcgggagctgcactgcccagaccgggccctgtgtggaggagatggagctgctgccctgcgggagcctggagctggcctgcggctgctgcgcttcctgtgcagcgagctgcaggccacccggctgctgtgcctgcggagcctgctggaccccagccccaggcctcccctgggggagggcgtggtggagggcgccggcatggtgcaggagctggacctgaccctgcaggccctgggcctgcccaggcctgcccctggcaccccagccagccagctgctgcaggagctgcacgccaagatcagcgagctgcagcccagcctgcccccaggcagcctgcagcccctgctgagctgcagcctggatgccccccgctgggaggccctggagagcctgagccagagcctgcgggaccagtaccgctgccgccgctgcctgctgctgaagaggctggacctgaccaccagcgccttccactggagcgacagagctgaggcccagggcgaggccatgagagctgtgctgatccccatccgggaggtgctgaccccagagagtgacatcagcatcgcccacgtgctggccgcccgggctgacctgagctgcctggtgcctgccacctctgtggccgtgagaagaggcacctgctgtgccatcaacaaggtgctgatgggaaatgtgcctgaccggggcggccggcccaatgagctggagccccccatgcccacctggaggagccggcgggaggatggcggcccccagtgctggggcaggaagaagaagaagaagaagtag

SEQ ID NO: 3114 - DNA, 804 bp, Artificial Sequence
  Description of Artificial Sequence: Synthetic coding sequence
atggaggccgtgaaggccgaggcctgggagggcgctgctgtggcccaggacctgctggccctgggctatggaggagtgcctggagctgccagcagaggagccagctgcccagacttccggggcctgtgtgtgcggctggccgctgagctggccaccctgggcgccctggagcagcagcgggaggccggggctgaggtgctgtctgctggagatggccctggagctgaggaggacttcctgcggcagctgggcagcctgctgcgggagctgcactgcccagaccgggccctgtgtggaggagatggagctgctgccctgcgggagcctggagctggcctgcggctgctgcgcttcctgtgcagcgagctgcaggccacccggctgctgtgcctgcggagcctgctggaccccagccccaggcctcccctgggggagggcgtggtggagggcgccggcatggtgcaggagctggacctgaccctgcaggccctgggcctgcccaggcctgcccctggcaccccagccagccagctgctgcaggagctgcacgccaaggaggccctggagagcctgagccagagcctgcgggaccagtaccgctgccgccgctgcctgctgctgaagaggctggacctgaccaccagcgccttccactggagcgacagagctgaggtgctgatgggaaatgtgcctgaccggggcggccggcccaatgagctggagccccccatgcccacctggaggagccggcgggaggatggcggcccccagtgctggggcaggaagaagaagaagaagaagtag

SEQ ID NO: 3115 - DNA, 2601 bp, Artificial Sequence
  Description of Artificial Sequence: Synthetic coding sequence
atgttctccatgagaattgtgtgcctggtgctgtctgtggtgggcacagcctggacagctgacagcggggagggggacttcctggccgagggcggcggcgtgcggggcccccgggtggtggagcggcaccagagcgcctgcaaggacagcgactggcccttctgcagtgatgaggactggaactacaagtgccccagcggctgcaggatgaagggcctgattgatgaggtgaaccaggacttcaccaaccgcatcaacaagctgaagaacagcctgtttgagtaccagaagaacaacaaggacagccacagcctgaccaccaacatcatggagatcctgcggggggacttcagcagcgccaacaacagagacaacacctacaacagagtgtctgaggacctgcggagccgcatcgaggtgctgaagaggaaggtgattgagaaggtgcagcacatccagctgctgcagaagaatgtgcgggcccagctggtggacatgaagaggctggaggtggacatcgacatcaagatccgcagctgccggggcagctgcagccgggccctggcccgggaggtggacctgaaggactatgaggaccagcagaagcagctggagcaggtgattgccaaggacctgctgcccagccgggaccggcagcacctgcccctcatcaagatgaagcctgtgcctgacctggtgcccggcaacttcaagagccagctgcagaaggtgcccccagagtggaaggccctgacagacatgccccagatgaggatggagctggagaggcctggaggaaatgagatcacccggggcggcagcaccagctatggaactggaagtgaaacagagagccccaggaaccccagcagcgctggctcctggaacagcggcagcagcggccctggcagcactggaaacagaaatcctggcagcagcggcactggaggaacagccacctggaagccaggcagcagcggccctggcagcacaggctcctggaacagcggcagcagcggcaccggcagcacaggcaaccagaaccctggcagcccccggcccggcagcacaggcacctggaaccctggcagcagcgagcggggcagcgctggccactggaccagcgagagctctgtgtctggcagcacaggccagtggcacagcgagagcggcagcttccggccagacagccctggcagcggaaatgcccggcccaacaacccagactggggcacctttgaggaggtgtctggaaatgtgtccccaggcacccggcgggagtaccacacagagaagctggtgaccagcaaaggagacaaggagctgaggacaggcaaggagaaggtgaccagcggcagcaccaccaccacccggcgcagctgcagcaagacagtgaccaagacagtcatcggcccagatggccacaaggaggtgaccaaggaggtggtgaccagtgaagatggcagtgactgcccagaggccatggacctgggcaccctgtctggaattggcaccctggatggcttccgccaccgccacccagatgaagctgccttctttgacacagccagcacaggcaagaccttccctggcttcttcagccccatgctgggggagtttgtgtctgaaacagagagccggggcagcgagagcggcatcttcaccaacaccaaggagagcagcagccaccaccctggcattgctgagttccccagccggggcaagagcagcagctacagcaagcagttcaccagcagcaccagctacaacagaggagacagcacctttgagagcaagagctacaagatggctgatgaagctggcagcgaggccgaccacgagggcacccacagcaccaagaggggccacgccaagagcaggcctgtgcgggactgtgatgatgtgctgcagacccaccccagcggcacccagagcggcatcttcaacatcaagctgcccggcagcagcaagatcttctctgtgtactgtgaccaggagaccagcctgggcggctggctgctgatccagcagaggatggatggcagcctgaacttcaacagaacctggcaggactacaagaggggcttcggcagcctgaatgatgaaggagagggggagttctggctgggcaatgactacctgcacctgctgacccagaggggctctgtgctgcgggtggagctggaggactgggccggaaatgaggcctatgcagagtaccacttccgggtgggcagcgaggccgagggctacgccctgcaggtgtcctcctatgagggcacagctggagatgccctgattgagggctctgtggaggagggcgctgagtacaccagccacaacaacatgcagttcagcacctttgacagagatgctgaccagtgggaggagaactgtgccgaggtgtatggaggcggctggtggtacaacaactgccaggccgccaacctgaatggcatctactacccaggcggcagctatgaccccaggaacaacagcccctatgaaattgaaaatggagtggtgtgggtgtccttcagaggagctgactacagcctgcgggctgtgaggatgaagatccggcccctggtgacccagtag

SEQ ID NO: 3116 - DNA, 1935 bp, Artificial Sequence
  Description of Artificial Sequence: Synthetic coding sequence
atgttctccatgagaattgtgtgcctggtgctgtctgtggtgggcacagcctggacagctgacagcggggagggggacttcctggccgagggcggcggcgtgcggggcccccgggtggtggagcggcaccagagcgcctgcaaggacagcgactggcccttctgcagtgatgaggactggaactacaagtgccccagcggctgcaggatgaagggcctgattgatgaggtgaaccaggacttcaccaaccgcatcaacaagctgaagaacagcctgtttgagtaccagaagaacaacaaggacagccacagcctgaccaccaacatcatggagatcctgcggggggacttcagcagcgccaacaacagagacaacacctacaacagagtgtctgaggacctgcggagccgcatcgaggtgctgaagaggaaggtgattgagaaggtgcagcacatccagctgctgcagaagaatgtgcgggcccagctggtggacatgaagaggctggaggtggacatcgacatcaagatccgcagctgccggggcagctgcagccgggccctggcccgggaggtggacctgaaggactatgaggaccagcagaagcagctggagcaggtgattgccaaggacctgctgcccagccgggaccggcagcacctgcccctcatcaagatgaagcctgtgcctgacctggtgcccggcaacttcaagagccagctgcagaaggtgcccccagagtggaaggccctgacagacatgccccagatgaggatggagctggagaggcctggaggaaatgagatcacccggggcggcagcaccagctatggaactggaagtgaaacagagagccccaggaaccccagcagcgctggctcctggaacagcggcagcagcggccctggcagcactggaaacagaaatcctggcagcagcggcactggaggaacagccacctggaagccaggcagcagcggccctggcagcacaggctcctggaacagcggcagcagcggcaccggcagcacaggcaaccagaaccctggcagcccccggcccggcagcacaggcacctggaaccctggcagcagcgagcggggcagcgctggccactggaccagcgagagctctgtgtctggcagcacaggccagtggcacagcgagagcggcagcttccggccagacagccctggcagcggaaatgcccggcccaacaacccagactggggcacctttgaggaggtgtctggaaatgtgtccccaggcacccggcgggagtaccacacagagaagctggtgaccagcaaaggagacaaggagctgaggacaggcaaggagaaggtgaccagcggcagcaccaccaccacccggcgcagctgcagcaagacagtgaccaagacagtcatcggcccagatggccacaaggaggtgaccaaggaggtggtgaccagtgaagatggcagtgactgcccagaggccatggacctgggcaccctgtctggaattggcaccctggatggcttccgccaccgccacccagatgaagctgccttctttgacacagccagcacaggcaagaccttccctggcttcttcagccccatgctgggggagtttgtgtctgaaacagagagccggggcagcgagagcggcatcttcaccaacaccaaggagagcagcagccaccaccctggcattgctgagttccccagccggggcaagagcagcagctacagcaagcagttcaccagcagcaccagctacaacagaggagacagcacctttgagagcaagagctacaagatggctgatgaagctggcagcgaggccgaccacgagggcacccacagcaccaagaggggccacgccaagagcaggcctgtgcggggcatccacaccagccccctgggcaagcccagcctgagcccctag

SEQ ID NO: 3117 - DNA, 870 bp, Artificial Sequence
  Description of Artificial Sequence: Synthetic coding sequence
atgttctccatgagaattgtgtgcctggtgctgtctgtggtgggcacagcctggacagctgacagcggggagggggacttcctggccgagggcggcggcgtgcggggcccccgggtggtggagcggcaccagagcgcctgcaaggacagcgactggcccttctgcagtgatgaggactggaactacaagtgccccagcggctgcaggatgaagggcctgattgatgaggtgaaccaggacttcaccaaccgcatcaacaagctgaagaacagcctgtttgagtaccagaagaacaacaaggacagccacagcctgaccaccaacatcatggagatcctgcggggggacttcagcagcgccaacaacagagacaacacctacaacagagtgtctgaggacctgcggagccgcatcgaggtgctgaagaggaaggtgattgagaaggtgcagcacatccagctgctgcagaagaatgtgcgggcccagctggtggacatgaagaggctggaggtggacatcgacatcaagatccgcagctgccggggcagctgcagccgggccctggcccgggaggtggacctgaaggactatgaggaccagcagaagcagctggagcaggtgattgccaaggacctgctgcctgtggtgaacctgcaggtgacagccaacaacctgctggtggcccgggtgaccacagaggagaccccccacctgaaggcccgggccatcaagtggcagatgaggcctgaggtgaagcccatcatgaaggagcacatcgccccccgggaggccatgctgaacctggccctgtctgaggtgtccaccctgctgctgtggggcagcctgccctgccccccccggctgtcctag

SEQ ID NO: 3118 - DNA, 1476 bp, Artificial Sequence
  Description of Artificial Sequence: Synthetic coding sequence
atgaagaggatggtgtcctggagcttccacaagctgaagaccatgaagcacctgctgctgctgctgctgtgtgtgttcctggtgaagagccagggcgtgaatgacaatgaggagggcttcttcagcgcccggggccaccggcccctggacaagaagcgggaggaggcccccagcctgcggcctgcccccccacccatcagcggcggcggctaccgggcccggcctgccaaggctgctgccacccagaagaaggtggagaggaaggccccagatgctgggggctgcctgcacgccgaccctgacctgggcgtgctgtgccccaccggctgccagctgcaggaggccctgctgcagcaggagcggcccatccggaacagcgtggatgagctgaacaacaacgtggaggccgtgtcccagaccagcagcagcagcttccagtacatgtacctgctgaaggacctgtggcagaagaggcagaagcaggtgaaggacaatgaaaatgtggtgaatgagtacagcagcgagctggagaagcaccagctgtacattgatgagaccgtgaacagcaacatccccaccaacctgcgggtgctgcggagcatcctggagaacctgcggagcaagatccagaagctggagagtgatgtgtctgcccagatggagtactgcaggaccccctgcaccgtgtcctgcaacatccctgtggtgtctgggaaggaatgtgaggagatcatcagaaaaggaggagagaccagcgagatgtacctgatccagcctgacagctctgtgaagccctacagagtgtactgtgacatgaacacagaaaatggaggctggacagtcatccagaaccggcaggacggctctgtggactttggaaggaagtgggacccctacaagcagggctttggaaatgtggccaccaacacagatggcaagaactactgcggcctgcctggagagtactggctgggcaatgacaagatcagccagctgaccaggatgggccccacagagctgctgattgagatggaggactggaagggggacaaggtgaaggcccactacggcggcttcaccgtgcagaatgaggccaacaagtaccagatctctgtgaacaagtaccggggcacagctggaaatgccctgatggatggagccagccagctgatgggagaaaatagaaccatgaccatccacaacggcatgttcttcagcacctatgaccgggacaatgatggctggctgaccagtgaccccaggaagcagtgcagcaaagaagatggcggcggctggtggtacaaccgctgccacgccgccaaccccaacggccgctactactggggcggccagtacacctgggacatggccaagcatggaacagatgatggagtggtgtggatgaactggaagggctcctggtacagcatgaggaagatgtccatgaagatccggcccttcttcccccagcagtag

SEQ ID NO: 3119 - DNA, 1425 bp, Artificial Sequence
  Description of Artificial Sequence: Synthetic coding sequence
atgaagaggatggtgtcctggagcttccacaagctgaagaccatgaagcacctgctgctgctgctgctgtgtgtgttcctggtgaagagccagggcgtgaatgacaatgaggagggcttcttcagcgcccggggccaccggcccctggacaagaagcgggaggaggcccggcctgccaaggccgccgccacccagaagaaggtggagaggaaggccccagatgctgggggctgcctgcatgctgaccctgacctgggcgtgctgtgccccaccggctgccagctgcaggaggccctgctgcagcaggagcggcccatcagaaattctgtggatgagctgaacaacaacgtggaggccgtgtcccagaccagcagcagcagcttccagtacatgtacctgctgaaggacctgtggcagaagaggcagaagcaggtgaaggacaatgaaaatgtggtgaatgagtacagcagcgagctggagaagcaccagctgtacattgatgaaacagtgaacagcaacatccccaccaacctgcgggtgctgcggagcatcctggagaacctgcggagcaagatccagaagctggagagtgatgtgtctgcccagatggagtactgcaggaccccctgcaccgtgtcctgcaacatccctgtggtgtctgggaaggaatgtgaggagatcatcaggaagggcggggagaccagcgagatgtacctgatccagcctgacagctctgtgaagccctacagagtgtactgtgacatgaacacagaaaatggaggctggacagtcatccagaaccggcaggacggctctgtggactttggaaggaagtgggacccctacaagcagggctttggaaatgtggccaccaacacagatggcaagaactactgcggcctgcccggggagtactggctgggcaatgacaagatcagccagctgaccaggatgggccccacagagctgctgattgagatggaggactggaagggggacaaggtgaaggcccactatggaggcttcaccgtgcagaatgaggccaacaagtaccagatctctgtgaacaagtaccggggcacagctggaaatgccctgatggatggagccagccagctgatgggagagaacagaaccatgaccatccacaacggcatgttcttcagcacctatgaccgggacaatgatggctggctgaccagtgaccccaggaagcagtgcagcaaggaggatggcggcggctggtggtacaaccgctgccacgccgccaaccccaacggccgctactactggggcggccagtacacctgggacatggccaagcacggcacagatgatggagtggtgtggatgaactggaagggctcctggtacagcatgaggaagatgtccatgaagatccggcccttcttcccccagcagtag

SEQ ID NO: 3120 - DNA, 1362 bp, Artificial Sequence
  Description of Artificial Sequence: Synthetic coding sequence
atgtcctggagcctgcaccccaggaacctgatcctgtacttctacgccctgctcttcctgagcagcacctgtgtggcctacgtggccacccgggacaactgctgcatcctggatgaaagatttggcagctactgccccaccacctgtggcattgctgacttcctgagcacctaccagaccaaggtggacaaggacctgcagagcctggaggacatcctgcaccaggtggagaacaagaccagcgaggtgaagcagctgatcaaggccatccagctgacctacaacccagatgagagcagcaagcccaacatgattgatgctgccaccctgaagagcaggaagatgctggaggagatcatgaagtatgaggccagcatcctgacccatgacagcagcatccgctacctgcaggagatctacaacagcaacaaccagaagatcgtgaacctgaaggagaaggtggcccagctggaggcccagtgccaggagccctgcaaggacacagtgcagatccatgacatcaccgggaaggactgccaggacatcgccaacaagggggccaagcagagcggcctgtacttcatcaagcccctgaaggccaaccagcagttcctggtgtactgtgaaattgatggcagcggaaatggctggacagtgttccagaagaggctggatggctctgtggacttcaagaagaactggatccagtacaaggagggcttcggccacctgagccccaccggcaccacagagttctggctgggcaatgagaagatccacctgatcagcacccagagcgccatcccctatgccctgcgggtggagctggaggactggaatggccgcaccagcacagctgactatgccatgttcaaggtgggccctgaggccgacaagtaccgcctgacctacgcctactttgctggaggagatgctggagatgcctttgatggctttgattttggagatgaccccagcgacaagttcttcaccagccacaacggcatgcagttcagcacctgggacaatgacaatgacaagtttgagggcaactgtgccgagcaggacggcagcggctggtggatgaacaagtgccacgccggccacctgaatggagtgtactaccagggcggcacctacagcaaggccagcaccccaaatggctatgacaatggcatcatctgggccacctggaagacccgctggtacagcatgaagaagaccaccatgaagatcatccccttcaaccggctgaccatcggggagggccagcagcaccacctgggcggggccaagcaggtgcggcctgagcaccctgctgagacagaatatgacagcctgtacccagaagatgacctgtag

SEQ ID NO: 3121 - DNA, 1314 bp, Artificial Sequence
  Description of Artificial Sequence: Synthetic coding sequence
atgtcctggagcctgcaccccaggaacctgatcctgtacttctacgccctgctcttcctgagcagcacctgtgtggcctacgtggccacccgggacaactgctgcatcctggatgaaagatttggcagctactgccccaccacctgtggcattgctgacttcctgagcacctaccagaccaaggtggacaaggacctgcagagcctggaggacatcctgcaccaggtggagaacaagaccagcgaggtgaagcagctgatcaaggccatccagctgacctacaacccagatgagagcagcaagcccaacatgattgatgctgccaccctgaagagcaggaagatgctggaggagatcatgaagtatgaggccagcatcctgacccatgacagcagcatccgctacctgcaggagatctacaacagcaacaaccagaagatcgtgaacctgaaggagaaggtggcccagctggaggcccagtgccaggagccctgcaaggacacagtgcagatccatgacatcaccgggaaggactgccaggacatcgccaacaagggggccaagcagagcggcctgtacttcatcaagcccctgaaggccaaccagcagttcctggtgtactgtgaaattgatggcagcggaaatggctggacagtgttccagaagaggctggatggctctgtggacttcaagaagaactggatccagtacaaggagggcttcggccacctgagccccaccggcaccacagagttctggctgggcaatgagaagatccacctgatcagcacccagagcgccatcccctatgccctgcgggtggagctggaggactggaatggccgcaccagcacagctgactatgccatgttcaaggtgggccctgaggccgacaagtaccgcctgacctacgcctactttgctggaggagatgctggagatgcctttgatggctttgattttggagatgaccccagcgacaagttcttcaccagccacaacggcatgcagttcagcacctgggacaatgacaatgacaagtttgagggcaactgtgccgagcaggacggcagcggctggtggatgaacaagtgccacgccggccacctgaatggagtgtactaccagggcggcacctacagcaaggccagcaccccaaatggctatgacaatggcatcatctgggccacctggaagacccgctggtacagcatgaagaagaccaccatgaagatcatccccttcaaccggctgaccatcggggagggccagcagcaccacctgggcggggccaagcaggccggagatgtgtag

SEQ ID NO: 3122 - DNA, 2892 bp, Artificial Sequence
  Description of Artificial Sequence: Synthetic coding sequence
atgctgtctggagagaggaaggagggcggcagccccaggtttgggaagctgcacctgcctgtgggcctgtggatcaacagccccaggaagcagctggccaagctgggccgccgctggcccagcgctgcctctgtgaagagcagcagcagtgacaccggcagccgcagcagcgagcccctgcccccacctccaccccacgtggagctgcggcgggtgggcgctgtgaaggccgccggcggggccagcggcagccgggccaagaggatcagccagctgttccggggcagcggcaccggcaccaccggcagcagcggggccggcggccctggcacccctgggggcgcccagcgctgggccagcgagaagaagctgcctgagctggccgccggcgtggcccctgagccccccctggccacccgggccacagcccctcctggggtgctgaagatctttggagctggcctggccagcggggccaactacaagtctgtgctggccacagcccggagcacagcccgggagctggtggccgaggccctggagagatatggcctggccggcagccctgggggcggccctggagagagcagctgtgtggatgcctttgccctgtgtgatgccctgggccggcctgctgctgctggggtgggcagcggggagtggagggctgagcacctgcgggtgctgggggacagcgagcggcccctgctggtgcaggagctgtggagggcccggcccggctgggccaggagatttgagctgcggggccgggaggaggcccggcggctggagcaggaggccttcggggctgctgacagcgagggcaccggggcccccagctggaggccccagaagaacagaagccgggccgccagcggcggggccgccctggccagccctggccctggcaccggcagcggggccccagctggcagcggcggcaaggagaggtctgagaacctgagcctgcggcgctctgtgtctgagctgagcctgcagggcagaagaagacggcagcaggagcggcggcagcaggccctgtccatggcccctggagctgctgatgcccagatcggcacagctgaccccggggactttgaccagctgacccagtgcctgatccaggcccccagcaaccggccctacttcctgctgctgcagggctaccaggatgcccaggactttgtggtgtatgtgatgacccgggagcagcacgtgtttggccggggcggcaacagcagcggccggggcggcagccctgccccctacgtggacaccttcctgaatgccccagacatcctgcccaggcactgcaccgtgcgggccggccctgagcacccagccatggtgcggcccagcagaggagcccctgtgacccacaacggctgcctgctgctgcgggaggccgagctgcaccctggggacctgctgggcctgggggagcacttcctgttcatgtacaaggaccccaggactggaggcagcggccctgcccggcccccctggctgcctgcccggcctggggccaccccacctggccctggctgggccttcagctgccgcctgtgtggccggggcctgcaggagcggggggaggccctggccgcctacctggatggccgggagcctgtgctgcgcttccggccccgggaggaggaggccctgctgggggagatcgtgcgggctgctgctgctggcagcggggacctgccccccctgggccctgccaccctgctggccctgtgtgtgcagcacagcgcccgggagctggagctgggccacctgccccggctgctgggccgcctggcccggctcatcaaggaggccgtgtgggagaagatcaaggagattggagaccggcagcctgagaaccaccctgagggcgtgcctgaggtgcccctgaccccagaggccgtgtctgtggagctgcggcccctgatgctgtggatggccaacaccacagagctgctgagctttgtgcaggagaaggtgctggagatggagaaggaggccgaccaggaggacccccagctgtgcaatgacctggagctgtgtgatgaggccatggccctgctggatgaagtcatcatgtgcaccttccagcagagcgtgtactacctgaccaagaccctgtacagcaccctgcctgccctgctggacagcaaccccttcaccgctggagctgagctgcccggccctggagctgagctgggcgccatgcctcctggcctgcggcccaccctgggcgtcttccaggccgccctggagctgaccagccagtgtgagctgcacccagacctggtgtcccagaccttcggctacctgttcttcttcagcaatgccagcctgctgaacagcctgatggagcggggccagggccggcccttctaccagtggagcagagctgtgcagatccgcaccaacctggacctggtgctggactggctgcagggcgccggcctgggggacatcgccacagagttcttcaggaagctgtccatggctgtgaacctgctgtgtgtgcccaggaccagcctgctgaaggcctcctggagcagcctgaggacagaccaccccaccctgaccccagcccagctgcaccacctgctgagccactaccagctgggccctggccggggccccccagctgcctgggaccccccacctgctgagcgggaggccgtggacacaggagacatctttgagagcttcagcagccaccccccactcatcctgcccctgggcagcagccggctgcggctgaccggccctgtgacagatgatgccctgcaccgggagctgcggcggctgcggcggctgctgtgggacctggagcagcaggagctgcctgccaactacagacatggcccccctgtggccaccagcccctag

SEQ ID NO: 3123 - DNA, 630 bp, Artificial Sequence
  Description of Artificial Sequence: Synthetic coding sequence
atggacagtgatgagaccggctttgagcacagcggcctgtgggtgtctgtgctggccggcctgctgctgggcgcctgccaggcccaccccatcccagacagcagccccctgctgcagtttggaggccaggtgcggcagcgctacctgtacacagatgatgcccagcagacagaggcccacctggagatcagagaagatggcaccgtgggcggcgctgctgaccagagccctgagagcctgctgcagctgaaggccctgaagccaggagtcatccagatcctgggcgtgaagaccagccgcttcctgtgccagaggccagatggagccctgtatggcagcctgcactttgatcctgaggcctgcagcttccgggagctgctgctggaggatggctacaacgtgtaccagagcgaggcccacggcctgcccctgcacctgcccggcaacaagagcccccaccgggaccctgccccccggggccctgcccgcttcctgcccctgcccggcctgcccccagccctgcctgagcccccaggcatcctggccccccagcccccagatgtgggcagcagtgaccccctgtccatggtgggccccagccagggccgcagccccagctatgccagctag

SEQ ID NO: 3124 - DNA, 321 bp, Artificial Sequence
  Description of Artificial Sequence: Synthetic coding sequence
atgctgcgcttcatccaggaggtgaacaccaccaccaggagctgtgccctgtgggacctggaggaggacacagagtacatcgtgcacgtgcaggccatcagcatccagggccagagccctgccagcgagcctgtgctcttcaagaccccccgggaggccgagaagatggccagcaagaacaaggatgaggtgaccatgaaggagatgggcaggaaccagcagctgaggactggagaggtgctgatcatcgtggtggtgctcttcatgtgggccggggtcatcgccctcttctgccggcagtatgacatcatcgaggcctag

SEQ ID NO: 3125 - DNA, 414 bp, Artificial Sequence
  Description of Artificial Sequence: Synthetic coding sequence
atgctgcgcttcatccaggaggtgaacaccaccaccaggagctgtgccctgtgggacctggaggaggacacagagtacatcgtgcacgtgcaggccatcagcatccagggccagagccctgccagcgagcctgtgctcttcaagaccccccgggaggccgagaagatggccagcaagaacaaggatgaggtgaccatgaaggagatgggcaggaaccagcagctgaggactggagaggtgctgatcatcgtggtggtgctcttcatgtgggccggggtcatcgccctcttctgccggcagtatgacatcatcaaggacaatgagcccaacaacaacaaggagaagaccaagagcgccagcgagaccagcaccccagagcaccagggcggcggcctgctgcggagcaagatctag

SEQ ID NO: 3126 - DNA, 390 bp, Artificial Sequence
  Description of Artificial Sequence: Synthetic coding sequence
atgaagaccctgcagttcttcttcctgttctgctgctggaaggccatctgctgcaacagctgtgagctgaccaacatcaccatcgccatcgagaaggaggagtgccgcttctgcatcagcatcaacaccacctggtgtgccggctactgctacacccgggacctggtgtacaaggaccctgcccggcccaagatccagaagacctgcaccttcaaggagctggtgtatgagaccgtgcgggtgcccggctgtgcccaccacgccgacagcctgtacacctaccctgtggccacccagtgccactgtgggaaatgtgacagcgacagcacagactgcaccgtgcggggcctgggccccagctactgcagctttggagagatgaaggagtag

SEQ ID NO: 3127 - DNA, 390 bp, Artificial Sequence; identical to SEQ ID NO: 3126
  Description of Artificial Sequence: Synthetic coding sequence

SEQ ID NO: 3128 - DNA, 390 bp, Artificial Sequence; identical to SEQ ID NO: 3126
  Description of Artificial Sequence: Synthetic coding sequence

SEQ ID NO: 3129 - DNA, 1260 bp, Artificial Sequence
  Description of Artificial Sequence: Synthetic coding sequence
atgtccttcatccctgtggccgaggacagcgacttccccatccacaacctgccctatggagtcttcagcaccaggggggacccccggccccgcatcggcgtggccatcggggaccagatcctggacctgagcatcatcaagcacctgttcaccggccctgtgctgagcaagcaccaggatgtgttcaaccagcccaccctgaacagcttcatgggcctgggccaggccgcctggaaggaggcccgggtcttcctgcagaacctgctgtctgtgtcccaggcccggctgagagatgacacagagctgaggaaatgtgccttcatcagccaggccagcgccaccatgcacctgcctgccaccatcggggactacacagacttctacagcagccggcagcacgccaccaacgtgggcatcatgttccgggacaaggaaaatgccctgatgcccaactggctgcacctgcctgtgggctaccacggccgggccagctctgtggtggtgtctggcacccccatccggcggcccatgggccagatgaagccagatgacagcaagccccctgtgtatggagcctgcaagctgctggacatggagctggagatggccttctttgtgggccctggcaaccggctgggggagcccatccccatcagcaaggcccacgagcacatcttcggcatggtgctgatgaatgactggagcgcccgggacatccagaagtgggagtatgtgcccctgggccccttcctgggcaagagctttggcaccaccgtgagcccctgggtggtgcccatggatgccctgatgccctttgctgtgcccaaccccaagcaggacccccggcccctgccctacctgtgccatgatgagccctacacctttgacatcaacctgtctgtgaacctgaagggggagggcatgagccaggccgccaccatctgcaagagcaacttcaagtacatgtactggaccatgctgcagcagctgacccaccacagcgtgaatggctgcaacctgcggcctggggacctgctggccagcggcaccatcagcggccctgagccagaaaattttggctccatgctggagctgtcctggaagggcaccaagcccatcgacctgggcaatggccagaccaggaagttcctgctggatggagatgaggtgatcatcaccggctactgccagggagatggctacagaattggatttggccagtgtgccggcaaggtgctgcctgccctgctgcccagctag

SEQ ID NO: 3130 - DNA, 1260 bp, Artificial Sequence; identical to SEQ ID NO: 3129
  Description of Artificial Sequence: Synthetic coding sequence

SEQ ID NO: 3131 - DNA, 1260 bp, Artificial Sequence; identical to SEQ ID NO: 3129
  Description of Artificial Sequence: Synthetic coding sequence

SEQ ID NO: 3132 - DNA, 759 bp, Artificial Sequence
  Description of Artificial Sequence: Synthetic coding sequence
atggaggccatgtggctgctgtgtgtggccctggccgtgctggcctggggcttcctgtgggtgtgggacagcagcgagaggatgaagagccgggagcagggcggccgcctgggcgctgagagcaggaccctgctggtgattgcccacccagatgatgaggccatgttctttgcccccaccgtgctgggcctggcccggctgcggcactgggtgtacctgctgtgcttctctgctggcaactactacaaccagggcgagaccaggaagaaggagctgctgcagagctgtgatgtgctgggcatccccctgagctctgtgatgatcatcgacaacagagacttcccagatgaccccggcatgcagtgggacacagagcacgtggcccgggtgctgctgcagcacatcgaggtgaatggcatcaacctggtggtgacctttgatgctgggggcgtgtctggccacagcaaccacatcgccctgtatgctgctgtgcgggccctgcacagcgagggcaagctgcccaagggctgcagcgtgctgaccctgcagagcgtgaatgtgctgaggaagtacatcagcctgctggacctgcccctgagcctgctgcacacccaggatgtgctgtttgtgctgaacagcaaggaggtggcccaggccaagaaggccatgagctgccacaggagccagctgctgtggttccggcggctgtacatcatcttcagccgctacatgaggatcaacagcctgtccttcctgtag

SEQ ID NO: 3133 - DNA, 1203 bp, Artificial Sequence
  Description of Artificial Sequence: Synthetic coding sequence
atggccgccctgcggcagccccaggtggccgagctgctggccgaggcccggcgggccttccgggaggagtttggagctgagcctgagctggccgtgtctgcccctggccgggtgaacctgattggagagcacacagactacaaccagggcctggtgctgcccatgagggacaggctcttccccaccctggagggcaggaagaggggcagcggccgggagcgggtgcggggccgcctgctggcccaggcccggcccctgggcgctggggccccccggctgcagcccggctccatgttccccctgaactgtgaggccctgtgtgccacccagaagggcaccctgcgggccagcggccacagaggagcccccacagctgacctgggggagaggagcctgctggcccagcctgtgcagttcacagaggaggagaccggcggggccttccggcccatctgcagcctgggcagcgcccaggccagcagccccccctgccccacagcccagggccgggtgcaggacggcctggtgtccctgctgaccaccagcgagggcgcagatgagccccagaggctgcagttccccctgcccacagcccagaggagcctggagcccggcaccccccgctgggccaactacgtgaagggcgtcatccagtactacccagctgcccccctgcccggcttctctgctgtggtggtgtcctctgtgcccctgggcggcggcctgagcagcagcgccagcctggaggtggccacctacaccttcctgcagcagctgtgcccagattctggcaccatcgccgcccgggcccaggtgtgccagcaggccgagcacagctttgctggcatgccctgtggcatcatggaccagttcatcagcctgatgggccagaagggccacgccctgctgattgactgccgcagcctggagaccagcctggtgcccctgagtgaccccaagctggccgtgctgatcaccaacagcaatgtgcgccacagcctggccagcagcgagtaccctgtgagaagacggcagtgtgaggaggtggcccgggccctgggcaaggagagcctgcgggaggtgcagctggaggagctggaggccgcccgggacctggtgtccaaggagggcttcagaagagcccggcacgtggtgggggagatcagaagaacagcagatggagccaaggtgctgtgcctgtag

SEQ ID NO: 3134 - DNA, 1269 bp, Artificial Sequence
  Description of Artificial Sequence: Synthetic coding sequence
atgtgtgccccacccaggggggcccctcctgagcacccagcccccaccggcctgtgccgcagcagctgtgccgagctgcaggcccgggtgatggccgccctgcggcagccccaggtggccgagctgctggccgaggcccggcgggccttccgggaggagtttggagctgagcctgagctggccgtgtctgcccctggccgggtgaacctgattggagagcacacagactacaaccagggcctggtgctgcccatggccctggagctgatgacagtgctggtgggcagccccaggaaggatggcctggtgtccctgctgaccaccagcgagggcgcagatgagccccagaggctgcagttccccctgcccacagcccagaggagcctggagcccggcaccccccgctgggccaactacgtgaagggcgtcatccagtactacccagctgcccccctgcccggcttctctgctgtggtggtgtcctctgtgcccctgggcggcggcctgagcagcagcgccagcctggaggtggccacctacaccttcctgcagcagctgtgcccagacagcggcaccatcgccgcccgggcccaggtgtgccagcaggccgagcacagctttgctggcatgccctgtggcatcatggaccagttcatcagcctgatgggccagaagggccacgccctgctgattgactgccgcagcctggagaccagcctggtgcccctgagtgaccccaagctggccgtgctgatcaccaacagcaatgtgcgccacagcctggccagcagcgagtaccctgtgagaagacggcagtgtgaggaggtggcccgggccctgggcaaggagagcctgcgggaggtgcagctggaggagctggaggccgcccgggacctggtgtccaaggagggcttccggcgggcccggcacgtggtgggggagatccggaggacagcccaggccgctgctgccctgcggcggggggactaccgggccttcggccgcctgatggtggagagccacaggagcctgagagatgattatgaggtgtcctgcccagagctggaccagctggtggaggccgccctggccgtgcctggggtgtatggcagcaggatgactggaggcggctttggaggctgcaccgtgaccctgctggaggccagcgctgcccctcatgccatgaggcacatccaggagcactacggcggcacagccaccttctacctgagccaggccgcagatggagccaaggtgctgtgcctgtag

SEQ ID NO: 3135 - DNA, 1179 bp, Artificial Sequence
  Description of Artificial Sequence: Synthetic coding sequence
atggccgccctgcggcagccccaggtggccgagctgctggccgaggcccggcgggccttccgggaggagtttggagctgagcctgagctggccgtgtctgcccctggccgggtgaacctgattggagagcacacagactacaaccagggcctggtgctgcccatggccctggagctgatgacagtgctggtgggcagccccaggaaggatggcctggtgtccctgctgaccaccagcgagggcgcagatgagccccagaggctgcagttccccctgcccacagcccagaggagcctggagcccggcaccccccgctgggccaactacgtgaagggcgtcatccagtactacccagctgcccccctgcccggcttctctgctgtggtggtgtcctctgtgcccctgggcggcggcctgagcagcagcgccagcctggaggtggccacctacaccttcctgcagcagctgtgcccagacagcggcaccatcgccgcccgggcccaggtgtgccagcaggccgagcacagctttgctggcatgccctgtggcatcatggaccagttcatcagcctgatgggccagaagggccacgccctgctgattgactgccgcagcctggagaccagcctggtgcccctgagtgaccccaagctggccgtgctgatcaccaacagcaatgtgcgccacagcctggccagcagcgagtaccctgtgagaagacggcagtgtgaggaggtggcccgggccctgggcaaggagagcctgcgggaggtgcagctggaggagctggaggccgcccgggacctggtgtccaaggagggcttccggcgggcccggcacgtggtgggggagatccggaggacagcccaggccgctgctgccctgcggcggggggactaccgggccttcggccgcctgatggtggagagccacaggagcctgagagatgattatgaggtgtcctgcccagagctggaccagctggtggaggccgccctggccgtgcctggggtgtatggcagcaggatgactggaggcggctttggaggctgcaccgtgaccctgctggaggccagcgctgcccctcatgccatgaggcacatccaggagcactacggcggcacagccaccttctacctgagccaggccgcagatggagccaaggtgctgtgcctgtag

SEQ ID NO: 3136 - DNA, 1569 bp, Artificial Sequence
  Description of Artificial Sequence: Synthetic coding sequence
atggctgctgtggtggccgccacccgctggtggcagctgctgctggtgctgtctgctgctggcatgggcgccagcggggccccccagccccccaacatcctgctgctgctgatggatgacatgggctggggagacctgggcgtgtatggagagcccagccgggagacccccaacctggacaggatggctgctgagggcctgctcttccccaacttctacagcgccaaccccctgtgcagccccagccgggccgccctgctgaccggccgcctgcccatcagaaatggcttctacaccaccaatgcccacgccagaaatgcctacaccccccaggagatcgtgggcggcatcccagacagcgagcagctgctgcctgagctgctgaagaaggccggctacgtgtccaagatcgtgggcaagtggcacctgggccaccggccccagttccaccccctgaagcacggctttgatgagtggtttggcagccccaactgccacttcggcccctatgacaacaaggcccggcccaacatccctgtgtacagagactgggagatggtgggccgctactatgaggagttccccatcaacctgaagacaggagaggccaacctgacccagatctacctgcaggaggccctggacttcatcaagaggcaggcccggcaccaccccttcttcctgtactgggccgtggatgccacccacgcccctgtgtatgccagcaagcccttcctgggcaccagccagaggggccgctatggagatgctgtgcgggagattgatgacagcatcggcaagatcctggagctgctgcaggacctgcacgtggccgacaacacctttgtgttcttcaccagtgacaatggagctgccctgatcagcgcccctgagcagggcggcagcaatggccccttcctgtgtgggaagcagaccacctttgagggcggcatgagggagcccgccctggcctggtggccaggccacgtgacagctggccaggtgagccaccagctgggcagcatcatggacctcttcaccaccagcctggccctggccggcctgaccccacccagcgaccgggccattgatggcctgaacctgctgcccaccctgctgcagggccgcctgatggaccggcccatcttctactacagaggagacaccctgatggccgccaccctgggccagcacaaggcccacttctggacctggaccaacagctgggagaacttccggcagggcatcgacttctgccccggccagaatgtgtctggagtgaccacccacaacctggaggaccacaccaagctgcccctcatcttccacctgggccgggaccccggggagcgcttccccctgagctttgccagcgctgagtaccaggaggccctgagccgcatcacctctgtggtgcagcagcaccaggaggccctggtgcctgcccagccccagctgaatgtgtgcaactgggccgtgatgaactgggcccctcctggctgtgagaagctgggcaagtgcctgaccccacctgagagcatccccaagaagtgcctgtggagccactag

SEQ ID NO: 3137 - DNA, 261 bp, Artificial Sequence
  Description of Artificial Sequence: Synthetic coding sequence
atggctgctgtggtggccgccacccgctggtggcagctgctgctggtgctgtctgctgctggcatgggcgccagcggggccccccagccccccaacatcctgctgctgctgatggatgaccggggccgccactgcagccaggacggctaccccagcgccatggccagcaccccacccacccccatgcctgagacccccacccacagaagaaggctgtgggccgccagccagaccaggagcagcagctgccgctccttctag

SEQ ID NO: 3138 - DNA, 1344 bp, Artificial Sequence
  Description of Artificial Sequence: Synthetic coding sequence
atggctgctgtggtggccgccacccgctggtggcagctgctgctggtgctgtctgctgctggcatgggcgccagcggggcccctggccagagggcctacaccccccaggagatcgtgggcggcatcccagattctgagcagctgctgcctgagctgctgaagaaggccggctacgtgtccaagatcgtgggcaagtggcacctgggccaccggccccagttccaccccctgaagcacggctttgatgagtggtttggcagccccaactgccacttcggcccctatgacaacaaggcccggcccaacatccctgtgtacagagactgggagatggtgggccgctactatgaggagttccccatcaacctgaagacaggagaggccaacctgacccagatctacctgcaggaggccctggacttcatcaagaggcaggcccggcaccaccccttcttcctgtactgggccgtggatgccacccacgcccctgtgtatgccagcaagcccttcctgggcaccagccagaggggccgctatggagatgctgtgcgggagattgatgacagcatcggcaagatcctggagctgctgcaggacctgcacgtggccgacaacacctttgtgttcttcaccagtgacaacggggccgccctgatcagcgcccctgagcagggcggcagcaatggccccttcctgtgtgggaagcagaccacctttgaaggaggcatgagggagcccgccctggcctggtggccaggccacgtgacagctggccaggtgagccaccagctgggcagcatcatggacctcttcaccaccagcctggccctggccggcctgaccccacccagcgaccgggccattgatggcctgaacctgctgcccaccctgctgcagggccgcctgatggaccggcccatcttctactacagaggagacaccctgatggccgccaccctgggccagcacaaggcccacttctggacctggaccaacagctgggagaacttccggcagggcatcgacttctgccccggccagaatgtgtctggagtgaccacccacaacctggaggaccacaccaagctgcccctcatcttccacctgggccgggaccctggagagcgcttccccctgagctttgccagcgctgagtaccaggaggccctgagccgcatcacctctgtggtgcagcagcaccaggaggccctggtgcctgcccagccccagctgaatgtgtgcaactgggccgtgatgaactgggcccctcctggctgtgagaagctgggcaagtgcctgaccccacctgagagcatccccaagaagtgcctgtggagccactag

SEQ ID NO: 3139 - DNA, 1140 bp, Artificial Sequence
  Description of Artificial Sequence: Synthetic coding sequence
atgagccgcagcggcacagacccccagcagaggcagcaggccagcgaggctgatgctgctgctgccaccttccgggccaatgaccaccagcacatccgctacaaccccctgcaggatgagtgggtgctggtgtctgcccacaggatgaagaggccctggcagggccaggtggagccccagctgctgaagacagtgcccaggcatgaccccctgaaccccctgtgccctggggccatccgggccaacggggaggtgaacccccagtatgacagcaccttcctgtttgacaatgacttccctgccctgcagccagatgcccccagccctggccccagcgaccaccccctcttccaggccaagagcgcccggggcgtgtgcaaggtgatgtgcttccacccctggagcgatgtgaccctgcccctgatgtctgtgcctgagatccgggctgtggtggatgcctgggcctctgtgacagaggagctgggcgcccagtacccctgggtgcagatctttgagaacaagggggccatgatgggctgcagcaacccccacccccactgccaggtgtgggccagcagcttcctgcctgacatcgcccagcgggaggagaggagccagcaggcctacaagagccagcacggggagcccctgctgatggagtacagccggcaggagctgctgaggaaggagcggctggtgctgaccagcgagcactggctggtgctggtgcccttctgggccacctggccctaccagaccctgctgctgccccggcggcacgtgcggcggctgcctgagctgaccccagctgagagagatgacctggccagcatcatgaagaagctgctgaccaagtatgacaacctgtttgagaccagcttcccctacagcatgggctggcatggagcccccactggaagtgaagctggggccaactggaaccactggcagctgcacgcccactactacccacccctgctgcggagcgccaccgtgaggaagttcatggtgggctatgagatgctggcccaggcccagagggacctgaccccagagcaggccgctgagcggctgcgggccctgcctgaggtgcactaccacctgggccagaaggaccgggagacagccaccatcgcctag

SEQ ID NO: 3140 - DNA, 813 bp, Artificial Sequence
  Description of Artificial Sequence: Synthetic coding sequence
atgaccctgagcaccctgtgtgtgctgggccccagcgagcccacagagagcaaggtgatgtgcttccacccctggagcgatgtgaccctgcccctgatgtctgtgcctgagatccgggctgtggtggatgcctgggcctctgtgacagaggagctgggcgcccagtacccctgggtgcagatctttgaaaataaaggagccatgatgggctgcagcaacccccacccccactgccaggtgtgggccagcagcttcctgcctgacatcgcccagcgggaggagaggagccagcaggcctacaagagccagcacggggagcccctgctgatggagtacagccggcaggagctgctgaggaaggagcggctggtgctgaccagcgagcactggctggtgctggtgcccttctgggccacctggccctaccagaccctgctgctgcccaggagacatgtgcggcggctgcctgagctgaccccagctgagagagatgacctggccagcatcatgaagaagctgctgaccaagtatgacaacctgtttgagaccagcttcccctacagcatgggctggcacggggcccccaccggcagcgaggccggggccaactggaaccactggcagctgcacgcccactactacccacccctgctgcggagcgccaccgtgaggaagttcatggtgggctatgagatgctggcccaggcccagagggacctgaccccagagcaggccgctgagcggctgcgggccctgcctgaggtgcactaccacctgggccagaaggaccgggagacagccaccatcgcctag

SEQ ID NO: 3141 - DNA, 255 bp, Artificial Sequence
  Description of Artificial Sequence: Synthetic coding sequence
atgagccgcagcggcacagacccccagcagaggcagcaggccagcgaggctgatgctgctgctgccaccttccgggccaatgaccaccagcacatccgctacaaccccctgcaggatgagtgggtgctggtgtctgcccacaggatgaagaggccctggcagggccaggtggagccccagctgctgaagacagtgcccaggcatgaccccctgaaccccctgtgccctggggccatccgggccaacggggagtag

SEQ ID NO: 3142 - DNA, 2229 bp, Artificial Sequence
  Description of Artificial Sequence: Synthetic coding sequence
atgagcccccagaagagggtgaagaatgtgcaggcccagaacagaaccagccagggcagcagcagcttccagaccaccctgagcgcctggaaggtgaagcaggaccccagcaacagcaagaacatcagcaagcacggccagaacaaccctgtgggggactatgagcacgcagatgaccaggccgaggaggatgccctgcagatggctgtgggctactttgagaagggccccatcaaggccagccagaacaaggacaagaccctggagaagcacctgaagacagtggagaatgtggcctggaagaatggcctggccagcgaggagattgacatcctgctgaacatcgccctgagcggcaagtttggaaatgctgtgaacacccgcatcctgaagtgcatgatcccagccaccgtcatcagtgaagattctgtggtgaaggctgtgtcctggctgtgtgtgggcaaatgttctggcagcaccaaggtgctcttctaccgctggctggtggccatgtttgacttcatcgacaggaaggagcagatcaacctgctgtatggcttcttctttgccagcctgcaggatgatgccctgtgcccctacgtgtgccacctgctgtacctgctgaccaagaaggaaaatgtgaagcccttccgggtgaggaagctgctggacctgcaggccaagatgggcatgcagccccacctgcaggccctgctgagcctgtacaagttctttgccccagccctgatctctgtgtccctgcctgtgaggaagaagatctacttcaagaacagcgagaacctgtggaagacagccctgctggccgtgaagcagaggaacagaggccccagccctgagcccctgaagctgatgctgggccctgccaacgtgcggcccctgaagaggaagtggaacagcctgagcgtcatccctgtgctgaacagcagcagctacaccaaggaatgtgggaagaaggagatgagcctgagtgactgcctgaacagaagtggcagcttccccctggagcagctgcagagcttcccccagctgctgcagaacatccactgcctggagctgcccagccagatgggctctgtgctgaacaacagcctgctgctgcactacatcaactgtgtgagagatgagcctgtgctgctgcgcttctactactggctgagccagaccctgcaggaggagtgcatctggtacaaggtgaacaactatgagcacggcaaggagttcaccaacttcctggacaccatcatccgggcagagtgcttcctgcaggagggcttctacagctgtgaggccttcctgtacaagagcctgcccctgtgggatggcctgtgctgccgcagccagttcctgcagctggtgtcctggatccccttcagcagcttcagcgaggtgaagcccctgctgtttgaccacctggcccagctgttcttcaccagcaccatctacttcaagtgcagcgtgctgcagagcctgaaggagctgctgcagaactggctgctgtggctgtccatggacatccacatgaagcctgtgaccaacagccccctggagaccaccctgggcggctccatgaacagcgtgtccaagctgatccactacgtgggctggctgagcaccacagccatgaggctggagagcaacaacaccttcctgctgcacttcatcctggacttctatgagaaggtgtgtgacatctacatcaactacaacctgcccctggtggtgctcttccccccaggcatcttctacagcgccctgctgagcctggacaccagcatcctgaaccagctgtgcttcatcatgcaccgctacaggaagaacctgacagctgccaagaagaatgagctggtgcagaagaccaagtctgagttcaacttcagcagcaagacctaccaggagttcaaccactacctgacctccatggtgggctgcctgtggaccagcaagccctttgggaagggcatctacattgatcctgagatcctggagaagacaggagtggccgagtacaagaacagcctgaatgtggtgcaccaccccagcttcctgtcctatgctgtgtccttcctgctgcagggcaagaagtggagctggtacctggactacctgttcagccagggcctgcagggcctgaagctgttcatccgcagctctgtgcaccacagcagcatccccagggctgagggcatcaactgcaacaaccagtactag

SEQ ID NO: 3143 - DNA, 636 bp, Artificial Sequence
  Description of Artificial Sequence: Synthetic coding sequence
atgaagctgtgggatgtggtggccgtgtgcctggtgctgctgcacacagccagcgccttccccctgcctgctgggaagaggcctcctgaggccccagctgaggacaggagcctgggcagaagaagagccccctttgccctgagcagtgacagcaacatgcctgaggactacccagaccagtttgatgatgtgatggacttcatccaggccaccatcaagaggctgaagaggagcccagacaagcagatggctgtgctgccccggcgggagaggaaccggcaggccgctgctgccaaccctgagaacagccggggcaagggccggcggggccagaggggcaagaacagaggctgtgtgctgacagccatccacctgaatgtgacagacctgggcctgggctatgagaccaaggaggagctgatcttccgctactgcagcggcagctgtgatgctgctgagaccacctatgacaagatcctgaagaacctgagcaggaacagaaggctggtgtctgacaaggtgggccaggcctgctgccggcccatcgcctttgatgatgacctgtccttcctggatgacaacctggtgtaccacatcctgaggaagcacagcgccaagagatgtggctgcatctag

SEQ ID NO: 3144 - DNA, 558 bp, Artificial Sequence
  Description of Artificial Sequence: Synthetic coding sequence
atgaagctgtgggatgtggtggccgtgtgcctggtgctgctgcacacagccagcgccttccccctgcctgctgccaacatgcctgaggactacccagaccagtttgatgatgtgatggacttcatccaggccaccatcaagaggctgaagaggagcccagacaagcagatggctgtgctgccccggcgggagaggaaccggcaggccgctgctgccaaccctgagaacagccggggcaagggccggcggggccagaggggcaagaacagaggctgtgtgctgacagccatccacctgaatgtgacagacctgggcctgggctatgagaccaaggaggagctgatcttccgctactgcagcggcagctgtgatgctgctgagaccacctatgacaagatcctgaagaacctgagcaggaacagaaggctggtgtctgacaaggtgggccaggcctgctgccggcccatcgcctttgatgatgacctgtccttcctggatgacaacctggtgtaccacatcctgaggaagcacagcgccaagagatgtggctgcatctag

SEQ ID NO: 3145 - DNA, 687 bp, Artificial Sequence
  Description of Artificial Sequence: Synthetic coding sequence
atgcagagcctgcccaacagcaatggagctgctgctggccgggacttcaagatgaagctgtgggatgtggtggccgtgtgcctggtgctgctgcacacagccagcgccttccccctgcctgctgggaagaggcctcctgaggccccagcagaagatagaagcctgggcagaagaagagccccctttgccctgagcagtgacagcaacatgcctgaggactacccagaccagtttgatgatgtgatggacttcatccaggccaccatcaagaggctgaagaggagcccagacaagcagatggctgtgctgccccggcgggagaggaaccggcaggccgccgccgccaaccctgagaacagccggggcaaaggaagaagaggccagaggggcaagaacagaggctgtgtgctgacagccatccacctgaatgtgacagacctgggcctgggctatgagaccaaggaggagctgatcttccgctactgcagcggcagctgtgatgctgctgagaccacctatgacaagatcctgaagaacctgagcaggaacagaaggctggtgtctgacaaggtgggccaggcctgctgccggcccatcgcctttgatgatgacctgtccttcctggatgacaacctggtgtaccacatcctgaggaagcacagcgccaagagatgtggctgcatctag

SEQ ID NO: 3146 - DNA, 186 bp, Artificial Sequence
  Description of Artificial Sequence: Synthetic coding sequence
atgaagctgtgggatgtggtggccgtgtgcctggtgctgctgcacacagccagcgccttccccctgcctgctgccaacatgcctgaggactacccagaccagtttgatgatgtgatggacttcatccaggccaccatcaagaggctgaagaggagcccagacaagcagatggctgtgctgccctag

SEQ ID NO: 3147 - DNA, 186 bp, Artificial Sequence; identical to SEQ ID NO: 3146
  Description of Artificial Sequence: Synthetic coding sequence

SEQ ID NO: 3148 - DNA, 558 bp, Artificial Sequence; identical to SEQ ID NO: 3144
  Description of Artificial Sequence: Synthetic coding sequence

SEQ ID NO: 3149 - DNA, 609 bp, Artificial Sequence
  Description of Artificial Sequence: Synthetic coding sequence
atgcagagcctgcccaacagcaatggagctgctgctggccgggacttcaagatgaagctgtgggatgtggtggccgtgtgcctggtgctgctgcacacagccagcgccttccccctgcctgctgccaacatgcctgaggactacccagaccagtttgatgatgtgatggacttcatccaggccaccatcaagaggctgaagaggagcccagacaagcagatggctgtgctgccccggcgggagaggaaccggcaggccgccgccgccaaccctgagaacagccggggcaaaggaagaagaggccagaggggcaagaacagaggctgtgtgctgacagccatccacctgaatgtgacagacctgggcctgggctatgagaccaaggaggagctgatcttccgctactgcagcggcagctgtgatgctgctgagaccacctatgacaagatcctgaagaacctgagcaggaacagaaggctggtgtctgacaaggtgggccaggcctgctgccggcccatcgcctttgatgatgacctgtccttcctggatgacaacctggtgtaccacatcctgaggaagcacagcgccaagagatgtggctgcatctag

SEQ ID NO: 3150 - DNA, 543 bp, Artificial Sequence
  Description of Artificial Sequence: Synthetic coding sequence
atgaagagcatctactttgtggccggcctgtttgtgatgctggtgcagggctcctggcagaggagcctgcaggacacagaggagaagagccgctccttcagcgccagccaggccgaccccctgagtgaccctgaccagatgaatgaagacaagaggcacagccagggcaccttcaccagtgactacagcaagtacctggacagcagaagagcccaggactttgtgcagtggctgatgaacaccaagaggaacagaaacaacatcgccaagagacatgatgaatttgaaagacatgctgagggcaccttcaccagtgatgtgtcctcctacctggagggccaggccgccaaggagttcatcgcctggctggtgaagggccggggcagaagagacttccctgaggaggtggccatcgtggaggagctgggcagaagacatgctgatggcagcttcagtgatgagatgaacaccatcctggacaacctggccgcccgggacttcatcaactggctgatccagaccaagatcacagacaggaagtag

SEQ ID NO: 3151 - DNA, 543 bp, Artificial Sequence; identical to SEQ ID NO: 3150
  Description of Artificial Sequence: Synthetic coding sequence

SEQ ID NO: 3152 - DNA, 2262 bp, Artificial Sequence
  Description of Artificial Sequence: Synthetic coding sequence
cgggccccagacagaagaggcagcccccggctggccagcacccggctgggcgccctgcggctgcggcccagcagaagagtgcctgcccgggccccagccccagcccaggcccccctgcccctgggcccccggctgctgggcctgcggaggaacatggccgcccccatgaccccagctgcccggccagaagattatgaagctgccctgaatgctgccctggctgatgtgcctgagctggcccggctgctggagattgacccctacctgaagccctatgctgtggacttccagaggcgctacaagcagttcagccagatcctgaagaacatcggggagaatgaaggaggcatcgacaagttcagccggggctatgagagctttggagtgcaccgctgtgctgatggcggcctgtactgcaaggagtgggcccctggagctgagggcgtcttcctgaccggggacttcaacggctggaaccccttctcctacccctacaagaagctggactatggcaagtgggagctgtacatcccccccaagcagaacaagtctgtgctggtgccccacggcagcaagctgaaggtggtgatcaccagcaagtctggagagatcctgtaccgcatcagcccctgggccaagtatgtggtgcgggagggggacaacgtgaactatgactggatccactgggaccctgagcacagctatgagttcaagcacagccggcccaagaagcccaggagcctgcgcatctatgagagccacgtgggcatcagcagccatgagggcaaggtggccagctacaagcacttcacctgcaatgtgctgccccgcatcaagggcctgggctacaactgcatccagctgatggccatcatggagcacgcctactatgccagctttggctaccagatcaccagcttctttgctgccagcagccgctatggcaccccagaggagctgcaggagctggtggacacagcccacagcatgggcatcatcgtgctgctggatgtggtgcacagccacgccagcaagaacagcgcagatggcctgaacatgtttgatggaacagacagctgctacttccacagcggcccccggggcacccatgacctgtgggacagccggctgtttgcctacagctcctgggagatcctgcgcttcctgctgagcaacatccgctggtggctggaggagtacagatttgatggcttccgctttgatggagtgacctccatgctgtaccaccaccacggcgtgggccagggcttcagcggggactacagcgagtacttcggcctgcaggtggatgaagatgccctgacctacctgatgctggccaaccacctggtgcacaccctgtgcccagacagcatcaccatcgcagaagatgtgtctggcatgcctgccctgtgcagccccatcagccagggcggcggcggctttgactaccgcctggccatggccatcccagacaagtggatccagctgctgaaggagttcaaggatgaggactggaacatgggagacatcgtgtacaccctgaccaacagacgctacctggagaagtgcatcgcctatgcagagagccatgaccaggccctggtgggggacaagagcctggccttctggctgatggatgctgagatgtacaccaacatgtctgtgctgacccccttcacccctgtgattgaccggggcatccagctgcacaagatgatccgcctcatcacccacggcctgggcggggagggctacctgaacttcatgggaaatgaatttggccaccctgagtggctggacttccccaggaaaggaaataatgaaagctaccactacgcccggcggcagttccacctgacagatgatgacctgctgcgctacaagttcctgaacaactttgaccgggacatgaaccggctggaggagagatatggctggctggccgccccccaggcctacgtgtctgagaagcatgagggcaacaagatcatcgcctttgagcgggccggcctgctcttcatcttcaacttccaccccagcaagagctacacagactacagagtgggcacagccctgcccgggaagttcaagatcgtgctggacagtgatgctgctgaatatggaggccaccagaggctggaccacagcacagacttcttcagcgaggcctttgagcacaacggccggccctacagcctgctggtgtacatccccagccgggtggccctgatcctgcagaatgtggacctgcccaactag

SEQ ID NO: 3153 - DNA, 2109 bp, Artificial Sequence
  Description of Artificial Sequence: Synthetic coding sequence
atggccgcccccatgaccccagctgcccggcctgaggactatgaggccgccctgaatgctgccctggctgatgtgcctgagctggcccggctgctggagattgacccctacctgaagccctatgctgtggacttccagaggcgctacaagcagttcagccagatcctgaagaacattggagaaaatgaaggaggcatcgacaagttcagccggggctatgagagctttggagtgcaccgctgtgctgatggcggcctgtactgcaaggagtgggcccctggagctgagggcgtcttcctgactggagacttcaacggctggaaccccttctcctacccctacaagaagctggactatggcaagtgggagctgtacatcccccccaagcagaacaagtctgtgctggtgccccacggcagcaagctgaaggtggtgatcaccagcaagagcggggagatcctgtaccgcatcagcccctgggccaagtatgtggtgcgggagggggacaacgtgaactatgactggatccactgggaccctgagcacagctatgagttcaagcacagccggcccaagaagcccaggagcctgcgcatctatgagagccacgtgggcatcagcagccatgagggcaaggtggccagctacaagcacttcacctgcaatgtgctgccccgcatcaagggcctgggctacaactgcatccagctgatggccatcatggagcacgcctactatgccagctttggctaccagatcaccagcttctttgctgccagcagccgctatggcaccccagaggagctgcaggagctggtggacacagcccacagcatgggcatcatcgtgctgctggatgtggtgcacagccacgccagcaagaacagcgcagatggcctgaacatgtttgatggaacagacagctgctacttccacagcggcccccggggcacccatgacctgtgggacagccggctgtttgcctacagctcctgggagatcctgcgcttcctgctgagcaacatccgctggtggctggaggagtacagatttgatggcttccgctttgatggagtgacctccatgctgtaccaccaccacggcgtgggccagggcttcagcggggactacagcgagtacttcggcctgcaggtggatgaagatgccctgacctacctgatgctggccaaccacctggtgcacaccctgtgcccagacagcatcaccatcgccgaggatgtgtctggcatgcctgccctgtgcagccccatcagccagggcggcggcggctttgactaccgcctggccatggccatcccagacaagtggatccagctgctgaaggagttcaaggatgaggactggaacatgggagacatcgtgtacaccctgaccaacagacgctacctggagaagtgcatcgcctatgcagagagccatgaccaggccctggtgggggacaagagcctggccttctggctgatggatgctgagatgtacaccaacatgtctgtgctgacccccttcacccctgtgattgaccggggcatccagctgcacaagatgatccgcctcatcacccacggcctgggcggggagggctacctgaacttcatgggaaatgaatttggccaccctgagtggctggacttccccaggaagggcaacaatgaaagctaccactacgcccggcggcagttccacctgacagatgatgacctgctgcgctacaagttcctgaacaactttgaccgggacatgaaccggctggaggagagatatggctggctggccgccccccaggcctacgtgtctgagaagcatgagggcaacaagatcatcgcctttgaaagagctggcctgctcttcatcttcaacttccaccccagcaagagctacacagactacagagtgggcacagccctgcccgggaagttcaagatcgtgctggacagtgatgctgctgaatatggaggccaccagaggctggaccacagcacagacttcttcagcgaggcctttgagcacaacggccggccctacagcctgctggtgtacatccccagccgggtggccctgatcctgcagaatgtggacctgcccaactag

SEQ ID NO: 3154 - DNA, 1398 bp, Artificial Sequence
  Description of Artificial Sequence: Synthetic coding sequence
atggccatcatggagcacgcctactatgccagctttggctaccagatcaccagcttctttgctgccagcagccgctatggcaccccagaggagctgcaggagctggtggacacagcccacagcatgggcatcatcgtgctgctggatgtggtgcacagccacgccagcaagaacagcgcagatggcctgaacatgtttgatggaacagacagctgctacttccacagcggcccccggggcacccatgacctgtgggacagccggctgtttgcctacagctcctgggagatcctgcgcttcctgctgagcaacatccgctggtggctggaggagtacagatttgatggcttccgctttgatggagtgacctccatgctgtaccaccaccacggcgtgggccagggcttcagcggggactacagcgagtacttcggcctgcaggtggatgaagatgccctgacctacctgatgctggccaaccacctggtgcacaccctgtgcccagacagcatcaccatcgcagaagatgtgtctggcatgcctgccctgtgcagccccatcagccagggcggcggcggctttgactaccgcctggccatggccatcccagacaagtggatccagctgctgaaggagttcaaggatgaggactggaacatgggagacatcgtgtacaccctgaccaacagacgctacctggagaagtgcatcgcctatgcagagagccatgaccaggccctggtgggggacaagagcctggccttctggctgatggatgctgagatgtacaccaacatgtctgtgctgacccccttcacccctgtgattgaccggggcatccagctgcacaagatgatccgcctcatcacccacggcctgggcggggagggctacctgaacttcatgggaaatgaatttggccaccctgagtggctggacttccccaggaaaggaaataatgaaagctaccactacgcccggcggcagttccacctgacagatgatgacctgctgcgctacaagttcctgaacaactttgaccgggacatgaaccggctggaggagagatatggctggctggccgccccccaggcctacgtgtctgagaagcatgagggcaacaagatcatcgcctttgagcgggccggcctgctcttcatcttcaacttccaccccagcaagagctacacagactacagagtgggcacagccctgcccgggaagttcaagatcgtgctggacagtgatgctgctgaatatggaggccaccagaggctggaccacagcacagacttcttcagcgaggcctttgagcacaacggccggccctacagcctgctggtgtacatccccagccgggtggccctgatcctgcagaatgtggacctgcccaactag

SEQ ID NO: 3155 - DNA, 1074 bp, Artificial Sequence
  Description of Artificial Sequence: Synthetic coding sequence
atggaggagggcatgaatgtgctgcatgactttggcatccagagcacccactacctgcaggtgaactaccaggacagccaggactggttcatcctggtgtctgtgattgctgacctgagaaatgccttctacgtgctcttccccatctggttccacctgcaggaggccgtgggcatcaagctgctgtgggtggccgtgattggagactggctgaacctggtgttcaagtggatcctgtttggccagaggccctactggtgggtgctggacacagactactacagcaacacctctgtgcccctcatcaagcagtttcctgtgacctgtgaaacaggccctggcagccccagcggccacgccatgggcacagctggggtgtactacgtgatggtgaccagcaccctgagcatcttccagggcaagatcaagcccacctaccgcttccgctgcctgaatgtcatcctgtggctgggcttctgggccgtgcagctgaatgtgtgcctgagccgcatctacctggccgcccacttcccccaccaggtggtggccggcgtgctgtctggaattgctgtggccgagaccttcagccacatccacagcatctacaatgccagcctgaagaagtacttcctgatcaccttcttcctgttctcctttgccatcggcttctacctgctgctgaagggcctgggcgtggacctgctgtggaccctggagaaggcccagcgctggtgtgagcagcctgagtgggtgcacatcgacaccaccccatttgccagcctgctgaagaacctgggcaccctgtttggcctgggcctggccctgaacagctccatgtaccgggagagctgcaagggcaagctgagcaagtggctgcccttccggctgagcagcatcgtggccagcctggtgctgctgcacgtgtttgacagcctgaagccacccagccaggtggagctggtgttctacgtgctgtccttctgcaagtctgctgtggtgcccctggcctctgtgtctgtcatcccctactgcctggcccaggtgctgggccagccccacaagaagagcctgtag

SEQ ID NO: 3156 - DNA, 2859 bp, Artificial Sequence
  Description of Artificial Sequence: Synthetic coding sequence
atgggcgtgcgccaccccccctgcagccaccggctgctggccgtgtgtgccctggtgtccctggccacagctgccctgctgggccacatcctgctgcatgacttcctgctggtgccccgggagctgagcggcagcagccctgtgctggaggagacccacccagcccaccagcagggcgccagcaggcctggccccagagatgcccaggcccaccctggccggcccagggctgtgcccacccagtgtgatgtgccccccaacagcagatttgactgtgccccagacaaggccatcacccaggagcagtgtgaggcccggggctgctgctacatcccagccaagcagggcctgcagggcgcccagatgggccagccctggtgcttcttcccccccagctaccccagctacaagctggagaacctgagcagcagcgagatgggctacacagccaccctgaccaggaccacccccaccttcttccccaaggacatcctgaccctgcggctggatgtgatgatggagacagagaaccggctgcacttcaccatcaaggaccctgccaacagaagatatgaggtgcccctggagacccctcatgtgcacagccgggcccccagccccctgtacagcgtggagttcagcgaggagcccttcggcgtgattgtgcggcggcagctggatggccgggtgctgctgaacaccaccgtggcccccctcttctttgctgaccagttcctgcagctgagcaccagcctgcccagccagtacatcaccggcctggccgagcacctgagccccctgatgctgagcacctcctggacccgcatcaccctgtggaacagagacctggcccccacccctggggccaacctgtatggcagccaccccttctacctggccctggaggatggcggcagcgcccacggcgtcttcctgctgaacagcaatgccatggatgtggtgctgcagcccagccctgccctgtcctggaggagcactggaggcatcctggatgtgtacatcttcctgggccctgagcccaagtctgtggtgcagcagtacctggatgtggtgggctaccccttcatgccaccctactggggcctgggcttccacctgtgccgctggggctacagcagcacagccatcacccggcaggtggtggagaacatgacccgggcccacttccccctggatgtgcagtggaatgacctggactacatggacagcagaagagacttcaccttcaacaaggatggcttccgggacttccctgccatggtgcaggagctgcaccagggcggccgccgctacatgatgattgtggaccctgccatcagcagcagcggccctgctggcagctaccggccctatgatgagggcctgcggcggggcgtcttcatcaccaatgagaccggccagcccctgattggcaaggtgtggccaggcagcacagccttcccagacttcaccaaccccacagccctggcctggtgggaggacatggtggccgagttccatgaccaggtgccctttgatggcatgtggattgacatgaatgagcccagcaacttcatccggggctctgaagatggctgccccaacaatgagctggagaaccccccctacgtgcctggggtggtgggcggcaccctgcaggccgccaccatctgtgccagcagccaccagttcctgagcacccactacaacctgcacaacctgtatggcctgacagaggccatcgccagccaccgggccctggtgaaggcccggggcacccggcccttcgtcatcagccgcagcacctttgctggccacggccgctatgccggccactggacaggagatgtgtggagctcctgggagcagctggccagctctgtgcctgagatcctgcagttcaacctgctgggcgtgcccctggtgggcgcagatgtgtgtggcttcctgggcaacaccagcgaggagctgtgtgtgcgctggacccagctgggcgccttctaccccttcatgaggaaccacaacagcctgctgagcctgccccaggagccctacagcttcagcgagcccgcccagcaggccatgaggaaggccctgaccctgcgctatgccctgctgccccacctgtacaccctcttccaccaggcccacgtggccggggagaccgtggcccggcccctcttcctggagttccccaaggacagcagcacctggacagtggaccaccagctgctgtggggcgaggccctgctgatcacccctgtgctgcaggccggcaaggccgaggtgacaggctacttccccctgggcacctggtatgacctgcagacagtgcctgtggaggccctgggcagcctgcccccacctcctgctgccccccgggagcccgccatccacagcgagggccagtgggtgaccctgcctgcccccctggacaccatcaacgtgcacctgcgggccggctacatcatccccctgcagggccctggcctgaccaccacagagagccggcagcagcccatggccctggccgtggccctgaccaagggcggggaggcccggggggagctgttctgggatgatggagagagcctggaggtgctggagcggggggcctacacccaggtgatcttcctggccaggaacaacaccatcgtgaatgagctggtgcgggtgaccagcgagggcgccggcctgcagctgcagaaggtgacagtgctgggcgtggccacagccccccagcaggtgctgagcaatggagtgcctgtgagcaacttcacctacagcccagacaccaaggtgctggacatctgtgtgtccctgctgatgggagagcagttcctggtgtcctggtgctag

SEQ ID NO: 3157 - DNA, 2859 bp, Artificial Sequence; identical to SEQ ID NO: 3156
  Description of Artificial Sequence: Synthetic coding sequence

SEQ ID NO: 3158 - DNA, 1611 bp, Artificial Sequence
  Description of Artificial Sequence: Synthetic coding sequence
atggagttcagcagccccagccgggaggagtgccccaagcccctgagccgggtgtccatcatggccggcagcctgaccggcctgctgctgctgcaggccgtgtcctgggccagcggggcccggccctgcatccccaagagctttggctacagctctgtggtgtgtgtgtgcaatgccacctactgtgacagctttgatcctcccaccttccctgccctgggcaccttcagccgctatgagagcaccaggagcggccgcaggatggagctgtccatgggccccatccaggccaaccacacaggcaccggcctgctgctgaccctgcagcctgagcagaagttccagaaggtgaagggctttggaggagccatgacagatgctgctgccctgaacatcctggccctgagccccccagcccagaacctgctgctgaagagctacttcagcgaggagggcatcggctacaacatcatccgggtgcccatggccagctgtgacttcagcatccgcacctacacctatgctgacaccccagatgacttccagctgcacaacttcagcctgcctgaggaggacaccaagctgaagatccccctcatccaccgggccctgcagctggcccagaggcctgtgtccctgctggccagcccctggaccagccccacctggctgaagaccaatggagctgtgaatggcaagggcagcctgaagggccagcccggggacatctaccaccagacctgggcccgctactttgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacagcacccaccacaacgtgcggctgctgatgctggatgaccagaggctgctgctgccccactgggccaaggtggtgctgacagatcctgaggccgccaagtatgtgcatggaattgctgtgcactggtacctggacttcctggccccagccaaggccaccctgggggagacccacaggctcttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaacctggccctgaaccctgagggcggccccaactgggtgaggaactttgtggacagccccatcatcgtggacatcaccaaggacaccttctacaagcagcccatgttctaccacctgggccacttcagcaagttcatccctgagggcagccagagggtgggcctggtggccagccagaagaatgacctggatgctgtggccctgatgcacccagatggcagcgctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 3159 - DNA, 1611 bp, Artificial Sequence; identical to SEQ ID NO: 3158
  Description of Artificial Sequence: Synthetic coding sequence

SEQ ID NO: 3160 - DNA, 1566 bp, Artificial Sequence
  Description of Artificial Sequence: Synthetic coding sequence
atggagttcagcagccccagccgggaggagtgccccaagcccctgagccgggtgtccatcatggccggcagcctgaccggcctgctgctgctgcaggccgtgtcctgggccagcggggcccggccctgcatccccaagagctttggctacagctctgtggtgtgtgtgtgcaatgccacctactgtgacagctttgatcctcccaccttccctgccctgggcaccttcagccgctatgagagcaccaggagcggccgcaggatggagctgtccatgggccccatccaggccaaccacacaggcaccggcctgctgctgaccctgcagccagatgctgctgccctgaacatcctggccctgagccccccagcccagaacctgctgctgaagagctacttcagcgaggagggcatcggctacaacatcatccgggtgcccatggccagctgtgacttcagcatccgcacctacacctacgccgacaccccagatgacttccagctgcacaacttcagcctgcctgaggaggacaccaagctgaagatccccctcatccaccgggccctgcagctggcccagaggcctgtgtccctgctggccagcccctggaccagccccacctggctgaagaccaacggggctgtgaatggcaagggcagcctgaagggccagcccggggacatctaccaccagacctgggcccgctactttgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacagcacccaccacaacgtgcggctgctgatgctggatgaccagaggctgctgctgccccactgggccaaggtggtgctgacagatcctgaggccgccaagtatgtgcacggcattgctgtgcactggtacctggacttcctggccccagccaaggccaccctgggggagacccacaggctcttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaacctggccctgaaccctgagggcggccccaactgggtgaggaactttgtggacagccccatcatcgtggacatcaccaaggacaccttctacaagcagcccatgttctaccacctgggccacttcagcaagttcatccctgagggcagccagagggtgggcctggtggccagccagaagaatgacctggatgctgtggccctgatgcacccagatggcagcgctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 3161 - DNA, 1464 bp, Artificial Sequence
  Description of Artificial Sequence: Synthetic coding sequence
atggagttcagcagccccagccgggaggagtgccccaagcccctgagccgggtgtccatcatggccggcagcctgaccggcctgctgctgctgcaggccgtgtcctgggccagcggggcccggccctgcatccccaagagctttggctacagctctgtggtgtgtgtgtgcaatgccacctactgtgacagctttgatcctcccaccttccctgccctgggcaccttcagccgctatgagagcaccaggagcggccgcaggatggagctgtccatgggccccatccaggccaaccacacaggcaccggcatcggctacaacatcatccgggtgcccatggccagctgtgacttcagcatccgcacctacacctacgccgacaccccagatgacttccagctgcacaacttcagcctgcctgaggaggacaccaagctgaagatccccctcatccaccgggccctgcagctggcccagaggcctgtgtccctgctggccagcccctggaccagccccacctggctgaagaccaacggggctgtgaatggcaagggcagcctgaagggccagcccggggacatctaccaccagacctgggcccgctactttgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacagcacccaccacaacgtgcggctgctgatgctggatgaccagaggctgctgctgccccactgggccaaggtggtgctgacagatcctgaggccgccaagtatgtgcacggcattgctgtgcactggtacctggacttcctggccccagccaaggccaccctgggggagacccacaggctcttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaacctggccctgaaccctgagggcggccccaactgggtgaggaactttgtggacagccccatcatcgtggacatcaccaaggacaccttctacaagcagcccatgttctaccacctgggccacttcagcaagttcatccctgagggcagccagagggtgggcctggtggccagccagaagaatgacctggatgctgtggccctgatgcacccagatggcagcgctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 3162 - DNA, 1350 bp, Artificial Sequence
  Description of Artificial Sequence: Synthetic coding sequence
atggagctgtccatgggccccatccaggccaaccacactggaacaggcctgctgctgaccctgcagcctgagcagaagttccagaaggtgaagggctttggaggagccatgacagatgctgctgccctgaacatcctggccctgagccccccagcccagaacctgctgctgaagagctacttcagcgaggagggcatcggctacaacatcatccgggtgcccatggccagctgtgacttcagcatccgcacctacacctacgccgacaccccagatgacttccagctgcacaacttcagcctgcctgaggaggacaccaagctgaagatccccctcatccaccgggccctgcagctggcccagaggcctgtgtccctgctggccagcccctggaccagccccacctggctgaagaccaacggggctgtgaatggcaagggcagcctgaagggccagcccggggacatctaccaccagacctgggcccgctactttgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacagcacccaccacaacgtgcggctgctgatgctggatgaccagaggctgctgctgccccactgggccaaggtggtgctgacagatcctgaggccgccaagtatgtgcacggcattgctgtgcactggtacctggacttcctggccccagccaaggccaccctgggggagacccacaggctcttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaacctggccctgaaccctgagggcggccccaactgggtgaggaactttgtggacagccccatcatcgtggacatcaccaaggacaccttctacaagcagcccatgttctaccacctgggccacttcagcaagttcatccctgagggcagccagagggtgggcctggtggccagccagaagaatgacctggatgctgtggccctgatgcacccagatggcagcgctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 3163 - DNA, 1482 bp, Artificial Sequence
  Description of Artificial Sequence: Synthetic coding sequence
atgaccctgcggggctggagcttccaggtgctgcctgagagcaatgccacctactgtgacagctttgacccccccaccttccctgccctgggcaccttcagccgctatgagagcaccaggtctggaagaaggatggagctgtccatgggccccatccaggccaaccacactggaacaggcctgctgctgaccctgcagcctgagcagaagttccagaaggtgaagggctttggaggagccatgacagatgctgctgccctgaacatcctggccctgagccccccagcccagaacctgctgctgaagagctacttcagcgaggagggcatcggctacaacatcatccgggtgcccatggccagctgtgacttcagcatccgcacctacacctacgccgacaccccagatgacttccagctgcacaacttcagcctgcctgaggaggacaccaagctgaagatccccctcatccaccgggccctgcagctggcccagaggcctgtgtccctgctggccagcccctggaccagccccacctggctgaagaccaacggggctgtgaatggcaagggcagcctgaagggccagcccggggacatctaccaccagacctgggcccgctactttgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacagcacccaccacaacgtgcggctgctgatgctggatgaccagaggctgctgctgccccactgggccaaggtggtgctgacagatcctgaggccgccaagtatgtgcacggcattgctgtgcactggtacctggacttcctggccccagccaaggccaccctgggggagacccacaggctcttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaacctggccctgaaccctgagggcggccccaactgggtgaggaactttgtggacagccccatcatcgtggacatcaccaaggacaccttctacaagcagcccatgttctaccacctgggccacttcagcaagttcatccctgagggcagccagagggtgggcctggtggccagccagaagaatgacctggatgctgtggccctgatgcacccagatggcagcgctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 3164 - DNA, 1272 bp, Artificial Sequence
  Description of Artificial Sequence: Synthetic coding sequence
atggagttcagcagccccagccgggaggagtgccccaagcccctgagccgggtgtccatcatggccggcagcctgaccggcctgctgctgctgcaggccgtgtcctgggccagcggcatcggctacaacatcatccgggtgcccatggccagctgtgacttcagcatccgcacctacacctacgccgacaccccagatgacttccagctgcacaacttcagcctgcctgaggaggacaccaagctgaagatccccctcatccaccgggccctgcagctggcccagaggcctgtgtccctgctggccagcccctggaccagccccacctggctgaagaccaacggggctgtgaatggcaagggcagcctgaagggccagcccggggacatctaccaccagacctgggcccgctactttgtgaagttcctggatgcctatgcagagcacaagctgcagttctgggccgtgacagcagaaaatgagcccagcgctggcctgctgagcggctaccccttccagtgcctgggcttcaccccagagcaccagagggacttcatcgcccgggacctgggccccaccctggccaacagcacccaccacaacgtgcggctgctgatgctggatgaccagaggctgctgctgccccactgggccaaggtggtgctgacagatcctgaggccgccaagtatgtgcacggcattgctgtgcactggtacctggacttcctggccccagccaaggccaccctgggggagacccacaggctcttccccaacaccatgctgtttgccagcgaggcctgtgtgggcagcaagttctgggagcagagcgtgcggctgggctcctgggaccggggcatgcagtacagccacagcatcatcaccaacctgctgtaccacgtggtgggctggacagactggaacctggccctgaaccctgagggcggccccaactgggtgaggaactttgtggacagccccatcatcgtggacatcaccaaggacaccttctacaagcagcccatgttctaccacctgggccacttcagcaagttcatccctgagggcagccagagggtgggcctggtggccagccagaagaatgacctggatgctgtggccctgatgcacccagatggcagcgctgtggtggtggtgctgaacagaagcagcaaggatgtgcccctgaccatcaaggaccctgctgtgggcttcctggagaccatcagccctggctacagcatccacacctacctgtggaggcggcagtag

SEQ ID NO: 3165 - DNA, 2112 bp, Artificial Sequence
  Description of Artificial Sequence: Synthetic coding sequence
atgctgcggggccgcagcctgtctgtgaccagcctgggcggcctgccccagtgggaggtggaggagctgcctgtggaggagctgctgctgtttgaggtggcctgggaggtgaccaacaaggtgggcggcatctacaccgtcatccagaccaaggccaagaccacagcagatgagtggggcgagaactacttcctgattggcccctactttgagcacaacatgaagacccaggtggagcagtgtgagcctgtgaatgatgctgtgagaagagctgtggatgccatgaacaagcacggctgccaggtgcacttcggccgctggctgattgagggcagcccctacgtggtgctgtttgacatcggctacagcgcctggaacctggaccgctggaagggggacctgtgggaggcctgcagcgtgggcatcccctaccatgaccgggaggccaatgacatgctgatcttcggcagcctgacagcctggttcctgaaggaggtgacagaccacgcagatggcaagtatgtggtggcccagttccacgagtggcaggccggcatcggcctcatcctgagccgggccaggaagctgcccatcgccaccatcttcaccacccacgccaccctgctgggccgctacctgtgtgccgccaacatcgacttctacaaccacctggacaagttcaacatcgacaaggaggccggggagcggcagatctaccaccgctactgcatggagcgggcctctgtgcactgtgcccacgtgttcaccaccgtgtctgagatcacagccatcgaggccgagcacatgctgaagaggaagccagatgtggtgacccccaacggcctgaatgtgaagaagttctctgctgtgcatgagttccagaacctgcacgccatgtacaaggcccgcatccaggactttgtgcggggccacttctacggccacctggactttgacctggagaagaccctcttcctgttcatcgccggccgctatgagttcagcaacaagggagctgacatcttcctggagagcctgagccggctgaacttcctgctgaggatgcacaagagtgacatcaccgtgatggtgttcttcatcatgcctgccaagaccaacaacttcaacgtggagaccctgaagggccaggccgtgaggaagcagctgtgggatgtggcccacagcgtgaaggagaagtttgggaagaagctgtatgatgccctgctgcggggggagatcccagacctgaatgacatcctggacagagatgacctgaccatcatgaagagggccatcttcagcacccagaggcagagcctgccccctgtgaccacccacaacatgattgatgacagcacagaccccatcctgagcaccatcagaagaattggcctcttcaacaacagaacagacagagtgaaggtgatcctgcaccctgagttcctgagcagcaccagccccctgctgcccatggactatgaggagtttgtgcggggctgccacctgggcgtcttccccagctactatgagccctggggctacaccccagctgagtgcaccgtgatgggcatccccagcgtgaccaccaacctgagcggcttcggctgcttcatgcaggagcacgtggccgaccccacagcctacggcatctacatcgtggaccggcgcttccgcagcccagatgacagctgcaaccagctgaccaagttcctgtatggcttctgcaagcagagccggcggcagaggatcatccagaggaacagaacagagcggctgagtgacctgctggactggagatacctgggccgctactaccagcacgcccggcacctgaccctgagccgggccttcccagacaagttccacgtggagctgaccagcccccccaccacagagggcttcaagtacccccggcccagctctgtgccccccagccccagcggcagccaggccagcagcccccagagcagtgatgtggaggatgaggtggaggatgaaagatatgatgaggaggaggaggccgagcgggaccggctgaacatcaagagccccttcagcctgagccacgtgccccacggcaagaagaagctgcacggggagtacaagaactag

SEQ ID NO: 3166 - DNA, 351 bp, Artificial Sequence
  Description of Artificial Sequence: Synthetic coding sequence
atggactactacagaaaatatgctgccatcttcctggtgaccctgagcgtcttcctgcacgtgctgcacagcgccccagatgtgcaggactgcccagaatgtaccctgcaggagaaccccttcttcagccagcccggggcccccatcctgcagtgcatgggctgctgcttcagccgggcctaccccacccccctgcggagcaagaagaccatgctggtgcagaagaatgtgaccagcgagagcacctgctgcgtggccaagagctacaacagagtgacagtgatgggcggcttcaaggtggagaaccacacagcctgccactgcagcacctgctactaccacaagagctag

SEQ ID NO: 3167 - DNA, 654 bp, Artificial Sequence
  Description of Artificial Sequence: Synthetic coding sequence
atggccaccggcagcaggaccagcctgctgctggccttcggcctgctgtgcctgccctggctgcaggagggcagcgccttccccaccatccccctgagccggctgtttgacaatgccatgctgcgggcccaccggctgcaccagctggcctttgacacctaccaggagtttgaggaggcctacatccccaaggagcagaagtacagcttcctgcagaacccccagaccagcctgtgcttcagcgagagcatccccacccccagcaaccgggaggagacccagcagaagagcaacctggagctgctgcgcatcagcctgctgctgatccagagctggctggagcctgtgcagttcctgcggtctgtgtttgccaacagcctggtgtatggagccagtgacagcaatgtgtatgacctgctgaaggacctggaggagggcatccagaccctgatgggccgcctggaggatggcagccccaggacaggccagatcttcaagcagacctacagcaagtttgacaccaacagccacaatgatgatgccctgctgaagaactacggcctgctgtactgcttcaggaaggacatggacaaggtggagaccttcctgagaattgtgcagtgccgctctgtggagggcagctgtggcttctag

SEQ ID NO: 3168 - DNA, 369 bp, Artificial Sequence
  Description of Artificial Sequence: Synthetic coding sequence
atggccaccggcagcaggaccagcctgctgctggccttcggcctgctgtgcctgccctggctgcaggagggcagcgccttccccaccatccccctgagccggctgtttgacaatgccatgctgcgggcccaccggctgcaccagctggcctttgacacctaccaggagttccggctggaggatggcagccccaggacaggccagatcttcaagcagacctacagcaagtttgacaccaacagccacaatgatgatgccctgctgaagaactacggcctgctgtactgcttcaggaaggacatggacaaggtggagaccttcctgcgcatcgtgcagtgccgctctgtggagggcagctgtggcttctag

SEQ ID NO: 3169 - DNA, 534 bp, Artificial Sequence
  Description of Artificial Sequence: Synthetic coding sequence
atggccaccggcagcaggaccagcctgctgctggccttcggcctgctgtgcctgccctggctgcaggagggcagcgccttccccaccatccccctgagccggctgtttgacaatgccatgctgcgggcccaccggctgcaccagctggcctttgacacctaccaggagttcaacctggagctgctgcgcatcagcctgctgctgatccagagctggctggagcctgtgcagttcctgcggtctgtgtttgccaacagcctggtgtatggagccagtgacagcaatgtgtatgacctgctgaaggacctggaggagggcatccagaccctgatgggccgcctggaggatggcagccccaggacaggccagatcttcaagcagacctacagcaagtttgacaccaacagccacaatgatgatgccctgctgaagaactacggcctgctgtactgcttcaggaaggacatggacaaggtggagaccttcctgagaattgtgcagtgccgctctgtggagggcagctgtggcttctag

SEQ ID NO: 3170 - DNA, 609 bp, Artificial Sequence
  Description of Artificial Sequence: Synthetic coding sequence
atggccaccggcagcaggaccagcctgctgctggccttcggcctgctgtgcctgccctggctgcaggagggcagcgccttccccaccatccccctgagccggctgtttgacaatgccatgctgcgggcccaccggctgcaccagctggcctttgacacctaccaggagttcaacccccagaccagcctgtgcttcagcgagagcatccccacccccagcaaccgggaggagacccagcagaagagcaacctggagctgctgcgcatcagcctgctgctgatccagagctggctggagcctgtgcagttcctgcggtctgtgtttgccaacagcctggtgtatggagccagtgacagcaatgtgtatgacctgctgaaggacctggaggagggcatccagaccctgatgggccgcctggaggatggcagccccaggacaggccagatcttcaagcagacctacagcaagtttgacaccaacagccacaatgatgatgccctgctgaagaactacggcctgctgtactgcttcaggaaggacatggacaaggtggagaccttcctgcgcatcgtgcagtgccgctctgtggagggcagctgtggcttctag

SEQ ID NO: 3171 - DNA, 771 bp, Artificial Sequence
  Description of Artificial Sequence: Synthetic coding sequence
atggctgctggcagcaggaccagcctgctgctggccttcggcctgctgtgcctgtcctggctgcaggagggcagcgccttccccaccatccccctgagccggctgtttgacaatgccatgctgcgggcccggcggctgtaccagctggcctatgacacctaccaggagtttgaggaggcctacatcctgaaggagcagaagtacagcttcctgcagaacccccagaccagcctgtgcttcagcgagagcatccccacccccagcaacagagtgaagacccagcagaagagcaacctggagctgctgcgcatcagcctgctgctgatccagagctggctggagcctgtgcagctgctgcggtctgtgtttgccaacagcctggtgtatggagccagtgacagcaatgtgtaccgccacctgaaggacctggaggagggcatccagaccctgatgtgggtgcgggtggcccctggcatccccaaccctggggcccccctggccagccgggactggggcgagaagcactgctgccccctcttcagcagccaggccctgacccaggagaacagcccctacagcagcttccccctggtgaaccccccaggcctgagcctgcagcctggaggagagggcggcaagtggatgaatgaaagaggccgggagcagtgccccagcgcctggcccctgctgctcttcctgcactttgctgaggccggccgctggcagcccccagactgggccgacctgcagagcgtgctgcagcaggtgtag

SEQ ID NO: 3172 - DNA, 654 bp, Artificial Sequence
  Description of Artificial Sequence: Synthetic coding sequence
atggctgctggcagcaggaccagcctgctgctggccttcggcctgctgtgcctgtcctggctgcaggagggcagcgccttccccaccatccccctgagccggctgtttgacaatgccatgctgcgggcccggcggctgtaccagctggcctatgacacctaccaggagtttgaggaggcctacatcctgaaggagcagaagtacagcttcctgcagaacccccagaccagcctgtgcttcagcgagagcatccccacccccagcaacagagtgaagacccagcagaagagcaacctggagctgctgcgcatcagcctgctgctgatccagagctggctggagcctgtgcagctgctgcggtctgtgtttgccaacagcctggtgtatggagccagtgacagcaatgtgtaccgccacctgaaggacctggaggagggcatccagaccctgatgtggaggctggaggatggcagccccaggacaggccagatcttcaaccagagctacagcaagtttgacaccaagagccacaatgatgatgccctgctgaagaactacggcctgctgtactgcttcaggaaggacatggacaaggtggagaccttcctgagaattgtgcagtgccgctctgtggagggcagctgtggcttctag

SEQ ID NO: 3173 - DNA, 609 bp, Artificial Sequence
  Description of Artificial Sequence: Synthetic coding sequence
atggctgctggcagcaggaccagcctgctgctggccttcggcctgctgtgcctgtcctggctgcaggagggcagcgccttccccaccatccccctgagccggctgtttgacaatgccatgctgcgggcccggcggctgtaccagctggcctatgacacctaccaggagttcaacccccagaccagcctgtgcttcagcgagagcatccccacccccagcaacagagtgaagacccagcagaagagcaacctggagctgctgcgcatcagcctgctgctgatccagagctggctggagcctgtgcagctgctgcggtctgtgtttgccaacagcctggtgtatggagccagtgacagcaatgtgtaccgccacctgaaggacctggaggagggcatccagaccctgatgtggaggctggaggatggcagccccaggacaggccagatcttcaaccagagctacagcaagtttgacaccaagagccacaatgatgatgccctgctgaagaactacggcctgctgtactgcttcaggaaggacatggacaaggtggagaccttcctgcgcatcgtgcagtgccgctctgtggagggcagctgtggcttctag

SEQ ID NO: 3174 - DNA, 738 bp, Artificial Sequence
  Description of Artificial Sequence: Synthetic coding sequence
atggctgctggcagcaggaccagcctgctgctggccttcggcctgctgtgcctgtcctggctgcaggagggcagcgccttccccaccatccccctgagccggctgtttgacaatgccatgctgcgggcccggcggctgtaccagctggcctatgacacctaccaggagtttgaggaggcctacatcctgaaggagcagaagtacagcttcctgcagaacccccagaccagcctgtgcttcagcgagagcatccccacccccagcaacagagtgaagacccagcagaagagcaacctggagctgctgcgcatcagcctgctgctgatccagagctggctggagcctgtgcagctgctgcggtctgtgtttgccaacagcctggtgtatggagccagtgacagcaatgtgtaccgccacctgaaggacctggaggagggcatccagaccctgattggctggaagatggccgcccctggcctgggccgcagcagcatcagccccacagccagcctgacccagaacagaaccaccatgacccactgcagcaggaccaccggctgcagcacagccagcggccgcacctggaccaggagccgccacagctgtgccagctgcagcgctgccctgtggagggctgctgtggccagcagctgccctgggggcatccctgtgaccccaccccagtgcctgtcctggagctggaaggtgctgctgcagtgccccccagccctgtcctag

SEQ ID NO: 3175 - DNA, 753 bp, Artificial Sequence
  Description of Artificial Sequence: Synthetic coding sequence
atggagaagggccctgtgcgggccccagctgagaagcccaggggggcccgctgcagcaatggcttccctgagcgggaccccccccggcccggccccagcaggcctgctgagaagccacccaggcctgaggccaagagcgcccagcctgcagatggctggaagggggagcggcccaggtctgaggaggacaatgagctgaacctgcccaacctggccgccgcctacagcagcatcctgagcagcctgggggagaacccccagaggcagggcctgctgaagaccccctggagggctgccagcgccatgcagttcttcaccaagggctaccaggagaccatcagtgatgtgctgaatgatgccatctttgatgaggaccatgatgagatggtgattgtgaaggacatcgacatgttctccatgtgtgagcaccacctggtgccctttgtgggcaaggtgcacatcggctacctgcccaacaagcaggtgctgggcctgagcaagctggccagaattgtggagatctacagccggcggctgcaggtgcaggagcggctgaccaagcagattgctgtggccatcacagaggccctgcggcctgctggggtgggcgtggtggtggaggccacccacatgtgcatggtgatgagaggagtgcagaagatgaacagcaagacagtgaccagcaccatgctgggcgtcttccgggaggaccccaagacccgggaggagttcctgaccctcatccgctcctag

SEQ ID NO: 3176 - DNA, 693 bp, Artificial Sequence
  Description of Artificial Sequence: Synthetic coding sequence
atggagaagggccctgtgcgggccccagctgagaagcccaggggggcccgctgcagcaatggcttccctgagcgggaccccccccggcccggccccagcaggcctgctgagaagccacccaggcctgaggccaagagcgcccagcctgcagatggctggaagggggagcggcccaggtctgaggaggacaatgagctgaacctgcccaacctggccgccgcctacagcagcatcctgagcagcctgggggagaacccccagaggcagggcctgctgaagaccccctggagggctgccagcgccatgcagttcttcaccaagggctaccaggagaccatcagtgatgtgctgaatgatgccatctttgatgaggaccatgatgagatggtgattgtgaaggacatcgacatgttctccatgtgtgagcaccacctggtgccctttgtgggcaaggtgcacatcggctacctgcccaacaagcaggtgctgggcctgagcaagctggccagaattgtggagatctacagccggcggctgcaggtgcaggagcggctgaccaagcagattgctgtggccatcacagaggccctgcggcctgctggggtgggcgtggtggtggaggccaccaagagcaacaagtacaacaagggcctgagctacttcctgctggccaccttcctgtggcagtactag

SEQ ID NO: 3177 - DNA, 753 bp, Artificial Sequence; identical to SEQ ID NO: 3175
  Description of Artificial Sequence: Synthetic coding sequence

SEQ ID NO: 3178 - DNA, 642 bp, Artificial Sequence
  Description of Artificial Sequence: Synthetic coding sequence
atggagaagggccctgtgcgggccccagctgagaagcccaggggggcccgctgcagcaatggcttccctgagcgggaccccccccggcccggccccagcaggcctgctgagaagccacccaggcctgaggccaagagcgcccagcctgcagatggctggaagggggagcggcccaggtctgaggaggacaatgagctgaacctgcccaacctggccgccgcctacagcagcatcctgagcagcctgggggagaacccccagaggcagggcctgctgaagaccccctggagggctgccagcgccatgcagttcttcaccaagggctaccaggagaccatcagtgatgtgctgaatgatgccatctttgatgaggaccatgatgagatggtgattgtgaaggacatcgacatgttctccatgtgtgagcaccacctggtgccctttgtgggcaaggtgcacatcggctacctgcccaacaagcaggtgctgggcctgagcaagctggccagaattgtggagatctacagccggcggctgcaggtgcaggagcggctgaccaagcagattgctgtggccatcacagaggccctgcggcctgctggggtgggcgtggtggtggaggccaccagcgctgagccctag

SEQ ID NO: 3179 - DNA, 702 bp, Artificial Sequence
  Description of Artificial Sequence: Synthetic coding sequence
atggagaagggccctgtgcgggccccagctgagaagcccaggggggcccgctgcagcaatggcttccctgagcgggaccccccccggcccggccccagcaggcctgctgagaagccacccaggcctgaggccaagagcgcccagcctgcagatggctggaagggggagcggcccaggtctgaggaggacaatgagctgaacctgcccaacctggccgccgcctacagcagcatcctgagcagcctgggggagaacccccagaggcagggcctgctgaagaccccctggagggctgccagcgccatgcagttcttcaccaagggctaccaggagaccatcagtgatgtgctgaatgatgccatctttgatgaggaccatgatgagatggtgattgtgaaggacatcgacatgttctccatgtgtgagcaccacctggtgccctttgtgggcaaggtgcacatcggctacctgcccaacaagcaggtgctgggcctgagcaagctggccagaattgtggagatctacagccggcggctgcaggtgcaggagcggctgaccaagcagattgctgtggccatcacagaggccctgcggcctgctggggtgggcgtggtggtggaggccaccaagagcaacaagtacaacaagggcctgagccccctgctgagcagctgccacctgtttgtggccatcctgaagtag

SEQ ID NO: 3180 - DNA, 1014 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgccccccctggtgaaggtgacccaccacgtgaccagctctgtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagcttctag

SEQ ID NO: 3181 - DNA, 771 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggtgccccccctggtgaaggtgacccaccacgtgaccagctctgtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3182 - DNA, 729 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3183 - DNA, 783 bp, Artificial Sequence
  Description of Artificial Sequence: Synthetic coding sequence
atgggcccccgggcccggcctgccctgctgctgctgatgctgctgcagacagctgtgctgcagggccgcctgctgcagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgccccccctggtgaaggtgacccaccacgtgaccagctctgtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3184 - DNA, 231 bp, Artificial Sequence
  Description of Artificial Sequence: Synthetic coding sequence
atgggcccccgggcccggcctgccctgctgctgctgatgctgctgcagacagctgtgctgcagggccgcctgctgcagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3185 - DNA, 507 bp, Artificial Sequence
  Description of Artificial Sequence: Synthetic coding sequence
atgggcccccgggcccggcctgccctgctgctgctgatgctgctgcagacagctgtgctgcagggccgcctgctgctgccccccctggtgaaggtgacccaccacgtgaccagctctgtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3186 - DNA, 1047 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgccccccctggtgaaggtgacccaccacgtgaccagctctgtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3187 - DNA, 978 bp, Artificial Sequence
  Description of Artificial Sequence: Synthetic coding sequence
atgggcccccgggcccggcctgccctgctgctgctgatgctgctgcagacagctgtgctgcagggccgcctgctgcccctgggctacgtggatgaccagctgtttgtgttctatgaccacgagagcagaagagtggagcccaggaccccctgggtgagcagccgcatcagcagccagatgtggctgcagctgagccagagcctgaagggctgggaccacatgttcaccgtggacttctggaccatcatggagaaccacaaccacagcaaggagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgccccccctggtgaaggtgacccaccacgtgaccagctctgtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctgattgtcatctgggagcccagccccagcggcaccctggtgattggagtcatcagcggcattgctgtgtttgtggtgatcctcttcatcggcatcctcttcatcatcctgaggaagaggcagggcagcagaggagccatgggccactacgtgctggccgagcgggagtag

SEQ ID NO: 3188 - DNA, 1005 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3189 - DNA, 1038 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggagggcagcgagagcagcagcctgcccgggaaggtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctgattgtcatctgggagcccagccccagcggcaccctggtgattggagtcatcagcggcattgctgtgtttgtggtgatcctcttcatcggcatcctcttcatcatcctgaggaagaggcagggcagcagaggagccatgggccactacgtgctggccgagcgggagtag

SEQ ID NO: 3190 - DNA, 741 bp, Artificial Sequence
  Description of Artificial Sequence: Synthetic coding sequence
atgggcccccgggcccggcctgccctgctgctgctgatgctgctgcagacagctgtgctgcagggccgcctgctgcagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgaccaccctgcgctgccgggccctgaactactacccccagaacatcaccatgaagtggctgaaggacaagcagcccatggatgccaaggagtttgagcccaaggatgtgctgcccaatggagatggcacctaccagggctggatcaccctggccgtgcccccaggagaggagcagcgctacacctgccaggtggagcaccctggcctggaccagcccctcatcgtcatctgggagcccagccccagcggcaccctggtgattggagtcatctctggaattgctgtgtttgtggtgatcctcttcatcggcatcctcttcatcatcctgaggaagaggcagggcagcagaggagccatgggccactacgtgctggccgagcgggagtag

SEQ ID NO: 3191 - DNA, 486 bp, Artificial Sequence
  Description of Artificial Sequence: Synthetic coding sequence
atgggcccccgggcccggcctgccctgctgctgctgatgctgctgcagacagctgtgctgcagggccgcctgctgcggagccacagcctgcactacctgttcatgggcgccagcgagcaggacctgggcctgagcctgtttgaggccctgggctacgtggatgaccagctgtttgtgttctatgaccacgagagccggcgggtggagcccaggaccccctgggtgagcagccgcatcagcagccagatgtggctgcagctgagccagagcctgaagggctgggaccacatgttcaccgtggacttctggaccatcatggagaaccacaaccacagcaaggagagccacaccctgcaggtgatcctgggctgtgagatgcaggaggacaacagcacagagggctactggaagtatggctatgatggccaggtgctgcaggacaccatctacagcagcgaggtgagcagcctgggcatcaagttctag

SEQ ID NO: 3192 - DNA, 366 bp, Artificial Sequence
  Description of Artificial Sequence: Synthetic coding sequence
atggagaaccacaaccacagcaaggagagccacaccctgcaggtgatcctgggctgtgagatgcaggaggacaacagcacagagggctactggaagtatggctatgatggccaggaccacctggagttctgcccagacaccctggactggagggctgctgagccccgggcctggcccaccaagctggagtgggagcggcacaagatccgggcccggcagaacagagcctacctggagcgggactgcccagcccagctgcagcagctgctggagctgggccggggcgtgctggaccagcaggtgccccccctggtgaaggtgacccaccacgtgagccacccagcccagcccagcaaggagagctag

SEQ ID NO: 3193 - DNA, 1281 bp, Artificial Sequence
  Description of Artificial Sequence: Synthetic coding sequence
atgggagagcccggccagagccccagccccaggagcagccacggcagcccccccaccctgagcaccctgaccctgctgctgctgctgtgtggccacgcccacagccagtgcaagatcctgcgctgcaatgcagaatatgtgagcagcaccctgagcctgcggggcggcggcagcagcggggccctgcggggcggcggcggcggcggccggggcggcggcgtgggcagcggcggcctgtgccgggccctgcggagctatgccctgtgcaccaggagaacagcccggacctgccgcggggacctggccttccacagcgctgtgcacggcatcgaggacctgatgatccagcacaactgcagccggcagggccccacagcccctcctccaccccggggccctgccctgcccggggccggcagcggcctgcctgccccagacccctgtgactatgagggccgcttcagccggctgcacggccggcccccaggcttcctgcactgtgccagctttggagacccccacgtgcgctccttccaccaccacttccacacctgccgggtgcagggcgcctggcccctgctggacaatgacttcctgtttgtgcaggccaccagcagccccatggccctgggcgccaatgccacagccaccaggaagctgaccatcatcttcaagaacatgcaggagtgcatcgaccagaaggtgtaccaggccgaggtggacaacctgcctgtggcctttgaagatggcagcatcaatggaggagacaggcctgggggcagcagcctgagcatccagacagccaaccctggcaaccacgtggagatccaggccgcctacatcggcaccaccatcatcatccggcagacagctggccagctgtccttcagcatcaaggtggccgaggatgtggccatggccttctctgctgagcaggacctgcagctgtgtgtgggcggctgcccccccagccagaggctgagccgctctgagaggaacagaagaggagccatcaccatcgacacagcccggcggctgtgcaaggagggcctgcctgtggaggatgcctacttccacagctgtgtgtttgatgtgctgatcagcggggaccccaacttcaccgtggccgcccaggccgccctggaggatgcccgggccttcctgcctgacctggagaagctgcacctgttccccagtgatgctggggtgcccctgagcagcgccaccctgctggcccccctgctgagcggcctgtttgtgctgtggctgtgcatccagtag

SEQ ID NO: 3194 - DNA, 942 bp, Artificial Sequence
  Description of Artificial Sequence: Synthetic coding sequence
atgatccagcacaactgcagccggcagggccccacagcccctcctccaccccggggccctgccctgcctggagctggcagcggcctgcctgccccagacccctgtgactatgagggccgcttcagccggctgcacggccggcccccaggcttcctgcactgtgccagctttggagacccccacgtgcgctccttccaccaccacttccacacctgccgggtgcagggcgcctggcccctgctggacaatgacttcctgtttgtgcaggccaccagcagccccatggccctgggcgccaatgccacagccaccaggaagctgaccatcatcttcaagaacatgcaggagtgcatcgaccagaaggtgtaccaggccgaggtggacaacctgcctgtggcctttgaagatggcagcatcaatggaggagacaggcctgggggcagcagcctgagcatccagacagccaaccctggcaaccacgtggagatccaggccgcctacatcggcaccaccatcatcatccggcagacagctggccagctgtccttcagcatcaaggtggctgaagatgtggccatggccttctctgctgagcaggacctgcagctgtgtgtgggcggctgcccccccagccagaggctgagccgctcagaaagaaacagaagaggagccatcaccatcgacacagcccggcggctgtgcaaggagggcctgcctgtggaggatgcctacttccacagctgtgtgtttgatgtgctgatcagcggggaccccaacttcaccgtggccgcccaggccgccctggaggatgcccgggccttcctgcctgacctggagaagctgcacctgttccccagtgatgctggggtgcccctgagcagcgccaccctgctggcccccctgctgagcggcctgtttgtgctgtggctgtgcatccagtag

SEQ ID NO: 3195 - DNA, 282 bp, Artificial Sequence
  Description of Artificial Sequence: Synthetic coding sequence
atgggagagcccggccagagccccagccccaggagcagccacggcagcccccccaccctgagcaccctgaccctgctgctgctgctgtgtggccacgcccacagccagtgcaagatcctgcgctgcaatgcagaatatgtgagcagcaccctgagcctgcggggcggcggcagcagcggggccctgcggggcggcggcggcggcggccggggcggcggcgtgggcagcggcggcctgtgccgggccctgcggagctatgccctgtgcaccaggagaacatag

SEQ ID NO: 3196 - DNA, 603 bp, Artificial Sequence
  Description of Artificial Sequence: Synthetic coding sequence
atgcaggagtgcatcgaccagaaggtgtaccaggccgaggtggacaacctgcctgtggcctttgaagatggcagcatcaatggaggagacaggcctgggggcagcagcctgagcatccagacagccaaccctggcaaccacgtggagatccaggccgcctacatcggcaccaccatcatcatccggcagacagctggccagctgtccttcagcatcaaggtggccgaggatgtggccatggccttctctgctgagcaggacctgcagctgtgtgtgggcggctgcccccccagccagaggctgagccgctctgagaggaacagaagaggagccatcaccatcgacacagcccggcggctgtgcaaggagggcctgcctgtggaggatgcctacttccacagctgtgtgtttgatgtgctgatcagcggggaccccaacttcaccgtggccgcccaggccgccctggaggatgcccgggccttcctgcctgacctggagaagctgcacctgttccccagtgatgctggggtgcccctgagcagcgccaccctgctggcccccctgctgagcggcctgtttgtgctgtggctgtgcatccagtag

SEQ ID NO: 3197 - DNA, 603 bp, Artificial Sequence; identical to SEQ ID NO: 3196
  Description of Artificial Sequence: Synthetic coding sequence

SEQ ID NO: 3198 - DNA, 603 bp, Artificial Sequence; identical to SEQ ID NO: 3196
  Description of Artificial Sequence: Synthetic coding sequence

SEQ ID NO: 3199 - DNA, 603 bp, Artificial Sequence; identical to SEQ ID NO: 3196
  Description of Artificial Sequence: Synthetic coding sequence

SEQ ID NO: 3200 - DNA, 1905 bp, Artificial Sequence
  Description of Artificial Sequence: Synthetic coding sequence
atgcccagcgacctggccaagaagaaggccgccaagaagaaggaggccgccaaggcccggcagaggcccaggaaaggacatgaagaaaatggagatgtggtgacagagccccaggtggccgagaagaatgaggccaacggccgggagaccacagaggtggacctgctgaccaaggagctggaggactttgagatgaagaaggctgctgcccgggctgtgactggagtgctggccagccaccccaacagcacagatgtgcacatcatcaacctgagcctgaccttccacggccaggagctgctgagtgacaccaagctggagctgaacagcggccgccgctatggcctgattggcctgaatggcatcggcaagtccatgctgctgagcgccatcggcaagcgggaggtgcccatccctgagcacatcgacatctaccacctgacccgggagatgccacccagcgacaagacccccctgcactgtgtgatggaggtggacacagagcgggccatgctggagaaggaggccgagcggctggcccatgaagatgctgaatgtgagaagctgatggagctgtatgagcggctggaggagctggatgctgacaaggccgagatgagggccagccgcatcctgcacggcctgggcttcaccccagccatgcagaggaagaagctgaaggacttcagcggcggctggaggatgagggtggccctggcccgggccctcttcatccggcccttcatgctgctgctggatgagcccaccaaccacctggacctggatgcctgtgtgtggctggaggaggagctgaagaccttcaagaggatcctggtgctggtgagccacagccaggacttcctgaatggagtgtgcaccaacatcatccacatgcacaacaagaagctgaagtactacacaggcaactatgaccagtatgtgaagacccggctggagctggaggagaaccagatgaagcgcttccactgggagcaggaccagatcgcccacatgaagaactacatcgccaggtttggacatggcagcgccaagctggcccggcaggcccagagcaaggagaagaccctgcagaagatgatggccagcggcctgacagagcgggtggtgtctgacaagaccctgtccttctacttccccccctgtgggaagatccccccacctgtgatcatggtgcagaatgtgtccttcaagtacaccaaggatggcccctgcatctacaacaacctggagtttggcatcgacctggacaccagggtggccctggtgggccccaacggggccggcaagagcaccctgctgaagctgctgaccggggagctgctgcccacagatggcatgatcaggaagcacagccacgtgaagattggccgctaccaccagcacctgcaggagcagctggacctggacctgagccccctggagtacatgatgaagtgctacccagagatcaaggagaaggaggagatgaggaagatcatcggccgctatggcctgaccgggaagcagcaggtgagccccatccggaacctgagtgatggccagaagtgccgggtgtgcctggcctggctggcctggcagaacccccacatgctgttcctggatgagcccaccaaccacctggacatcgagaccattgatgccctggctgatgccatcaatgaatttgagggcggcatgatgctggtgtcccatgacttccgcctcatccagcaggtggcccaggagatctgggtgtgtgagaagcagaccatcaccaagtggccaggggacatcctggcctacaaggagcacctgaagagcaagctggtggatgaggagccccagctgaccaagaggacccacaacgtgtgcaccctgaccctggccagcctgccccggccctag

SEQ ID NO: 3201 - DNA, 555 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagcggaggagatgactgcctggtggagagcaccttctacagcatccccttctggggccacaacagcgccaggtag

SEQ ID NO: 3202 - DNA, 891 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagcttcctgcccagcagctaccggggcaaggacctgcaggagaactactgcaggaaccccagaggagaggagggcggcccctggtgcttcaccagcaaccctgaggtgcgctatgaggtgtgtgacatcccccagtgcagcgaggtggagtgcatgacctgcaatggagagagctaccggggcctgatggaccacacagagagcggcaagatctgccagcgctgggaccaccagaccccccaccgccacaagttcctgcctgagcgctacccagacaagggctttgatgacaactactgcagaaatccagatggccagccccggccctggtgctacaccctggacccccacacccgctgggagtactgtgccatcaagacctgtggggacatcacctgggccctgaactag

SEQ ID NO: 3203 - DNA, 426 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtcctag

SEQ ID NO: 3204 - DNA, 357 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtag

SEQ ID NO: 3205 - DNA, 633 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagcttcctgcccagcagctaccggggcaaggacctgcaggagaactactgcaggaaccccagaggagaggagggcggcccctggtgcttcaccagcaaccctgaggtgcgctatgaggtgtgtgacatcccccagtgcagcgagggcaagtag

SEQ ID NO: 3206 - DNA, 873 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagcttcctgcccagcagctaccggggcaaggacctgcaggagaactactgcaggaaccccagaggagaggagggcggcccctggtgcttcaccagcaaccctgaggtgcgctatgaggtgtgtgacatcccccagtgcagcgaggtggagtgcatgacctgcaatggagagagctaccggggcctgatggaccacacagagagcggcaagatctgccagcgctgggaccaccagaccccccaccgccacaagttcctgcctgagcgctacccagacaagggctttgatgacaactactgcagaaatccagatggccagccccggccctggtgctacaccctggacccccacacccgctgggagtactgtgccatcaagacctgtgagacctag

SEQ ID NO: 3207 - DNA, 858 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagctaccggggcaaggacctgcaggagaactactgcaggaaccccagaggagaggagggcggcccctggtgcttcaccagcaaccctgaggtgcgctatgaggtgtgtgacatcccccagtgcagcgaggtggagtgcatgacctgcaatggagagagctaccggggcctgatggaccacacagaaagtggcaagatctgccagcgctgggaccaccagaccccccaccgccacaagttcctgcctgagcgctacccagacaagggctttgatgacaactactgcaggaacccagatggccagccccggccctggtgctacaccctggacccccacacccgctgggagtactgtgccatcaagacctgtgagacctag

SEQ ID NO: 3208 - DNA, 2172 bp, Artificial Sequence
  Description of Artificial Sequence: Synthetic coding sequence
atgtgggtgaccaagctgctgcctgccctgctgctgcagcacgtgctgctgcacctgctgctgctgcccatcgccatcccctatgcagagggccagaggaagagaagaaacaccatccacgagttcaagaagagcgccaagaccaccctcatcaagattgatcctgccctgaagatcaagaccaagaaggtgaacacagctgaccagtgtgccaaccgctgcaccaggaacaagggcctgcccttcacctgcaaggcctttgtgtttgacaaggccaggaagcagtgcctgtggttccccttcaacagcatgagcagcggcgtgaagaaggagtttggccacgagtttgacctgtatgagaacaaggactacatccggaactgcatcatcggcaagggccgcagctacaagggcaccgtgtccatcaccaagagcggcatcaagtgccagccctggagctccatgatcccccatgagcacagctaccggggcaaggacctgcaggagaactactgcaggaaccccagaggagaggagggcggcccctggtgcttcaccagcaaccctgaggtgcgctatgaggtgtgtgacatcccccagtgcagcgaggtggagtgcatgacctgcaatggagagagctaccggggcctgatggaccacacagaaagtggcaagatctgccagcgctgggaccaccagaccccccaccgccacaagttcctgcctgagcgctacccagacaagggctttgatgacaactactgcaggaacccagatggccagccccggccctggtgctacaccctggacccccacacccgctgggagtactgtgccatcaagacctgtgccgacaacaccatgaatgacacagatgtgcccctggagaccacagagtgcatccagggccagggcgagggctaccggggcaccgtgaacaccatctggaatggcatcccctgccagcgctgggacagccagtacccccatgaacatgacatgaccccagagaacttcaagtgcaaggacctgcgggagaactactgcaggaacccagatggcagcgagagcccctggtgcttcaccacagaccccaacatccgggtgggctactgcagccagatccccaactgtgacatgagccacggccaggactgctacagaggaaatggcaagaactacatgggcaacctgagccagaccaggagcggcctgacctgcagcatgtgggacaagaacatggaggacctgcaccgccacatcttctgggagccagatgccagcaagctgaatgaaaactactgcaggaacccagatgatgatgcccacggcccctggtgctacacaggcaaccccctcatcccctgggactactgccccatcagccgctgtgagggggacaccacccccaccatcgtgaacctggaccaccctgtgatcagctgtgccaagaccaagcagctgcgggtggtgaatggcatccccaccaggaccaacatcggctggatggtgtccctgcgctacagaaacaagcacatctgtggcggcagcctcatcaaggagagctgggtgctgacagcccggcagtgcttccccagccgggacctgaaggactatgaggcctggctgggcatccatgatgtgcacggcagaggagatgagaagtgcaagcaggtgctgaatgtgtcccagctggtgtatggccctgagggcagtgacctggtgctgatgaagctggcccggcctgctgtgctggatgactttgtgtccaccatcgacctgcccaactacggctgcaccatccctgagaagaccagctgcagcgtgtatggctggggctacacaggcctcatcaactatgatggcctgctgcgggtggcccacctgtacatcatgggaaatgagaagtgcagccagcaccaccggggcaaggtgaccctgaatgaaagtgagatctgtgccggggctgagaagattggcagcggcccctgtgagggggactatggaggccccctggtgtgtgagcagcacaagatgaggatggtgctgggcgtcatcgtgcccggccggggctgtgccatccccaaccggcccggcatctttgtgcgggtggcctactatgccaagtggatccacaagatcatcctgacctacaaggtgccccagagctag

SEQ ID NO: 3209 - DNA, 363 bp, Artificial Sequence
  Description of Artificial Sequence: Synthetic coding sequence
atgaatggagaggagaagagctgcagcggctatggaggcccagatgccatggatggcaagctggtgtccagtgatgatgatgacttcatcgtgaagcgggagcacacccgggccagcggcatcaggaaggctgtgctgagcggccctggccagagcgcagaaaatgaaacagaccaggtgaacttccgggagatccccccacgctgctaccccaagcacgccaaggcctgcatctacttcacctacaaggtgcactacagcaacagcagcacagagatccctgagttcctgacagccctggaggtgctgatggccagtgacttcctggacatctacatcttcctgttcttcctgttcttctag

SEQ ID NO: 3210 - DNA, 255 bp, Artificial Sequence
  Description of Artificial Sequence: Synthetic coding sequence
atggccctgagcagccagatctgggccgcctgcctgctgctgctgctgctgctggccagcctgaccagcggctctgtgttcccccagcagacaggccagctggccgagctgcagccccaggacagagctggggcccgggcctcctggatgcccatgttccagaggagaagaagaagagacacccacttccccatctgcatcttctgctgcggctgctgccacaggagcaaatgtggcatgtgctgcaagacctag

SEQ ID NO: 3211 - DNA, 1422 bp, Artificial Sequence
  Description of Artificial Sequence: Synthetic coding sequence
atggctgtgatggcccccaggaccctggtgctgctgctgagcggggccctggccctgacccagacctgggccgaggtgcagctggtggagagcggcggcggcctggtgcagcccggcggcagcctgcggctgagctgtgccgccagcggcttcaacatcaaggacacctacatccactgggtgcggcaggcccctgggaagggcctggagtgggtggcccgcatctaccccaccaacggctacaccaggtatgctgacagcgtgaagggccgcttcaccatctctgctgacaccagcaagaacacagcctacctgcagatgaacagcctgcgggcagaggacacagctgtgtactactgcagccgctggggcggagatggcttctacgccatggactactggggccagggcaccctggtgacagtgagcagcgccagcaccaagggccccagcgtcttccccctggcccccagcagcaagagcaccagcggcggcacagctgccctgggctgcctggtgaaggactacttccctgagcctgtgacagtgtcctggaacagcggggccctgaccagcggcgtgcacaccttccctgctgtgctgcagagcagcggcctgtacagcctgagctctgtggtgacagtgcccagcagcagcctgggcacccagacctacatctgcaatgtgaaccacaagcccagcaacaccaaggtggacaagaaggtggagcccaagagctgtgacaagacccacacctgccccccctgcccagcccctgagctgctgggcggccccagcgtcttcctgtttcctcccaagcccaaggacaccctgatgatcagcaggaccccagaggtgacctgtgtggtggtggatgtgtcccatgaggaccctgaggtgaagttcaactggtacgtggatggagtggaggtgcacaatgccaagaccaagccccgggaggagcagtacaacagcacctacagagtggtgtctgtgctgactgtgctgcaccaggactggctgaatggcaaggagtacaagtgcaaggtgagcaacaaggccctgcctgcccccatcgagaagaccatcagcaaggccaagggccagccccgggagccccaggtgtacaccctgccccccagcagagatgagctgaccaagaaccaggtgtccctgacctgcctggtgaagggcttctaccccagcgacattgctgtggagtgggagagcaatggccagcctgagaacaactacaagaccaccccacctgtgctggacagtgatggcagcttcttcctgtacagcaagctgactgtggacaagagccgctggcagcagggcaatgtgttcagctgcagcgtgatgcatgaggccctgcacaaccactacacccagaagagcctgagcctgagccctggatag

SEQ ID NO: 3212 - DNA, 717 bp, Artificial Sequence
  Description of Artificial Sequence: Synthetic coding sequence
atggctgtgatggcccccaggaccctggtgctgctgctgagcggggccctggccctgacccagacctgggccgacatccagatgacccagagccccagcagcctgagcgcctctgtgggggacagagtgaccatcacctgccgggccagccaggatgtgaacacagctgtggcctggtaccagcagaagccaggcaaggcccccaagctgctgatctacagcgccagcttcctgtacagcggcgtgcccagccgcttcagcggcagccgctctggaacagacttcaccctgaccatcagcagcctgcagccagaagattttgccacctactactgccagcagcactacaccaccccacccaccttcggccagggcaccaaggtggagatcaagaggacagtggccgcccccagcgtcttcatcttccccccatctgatgagcagctgaagtctggaacagcctctgtggtgtgcctgctgaacaacttctacccccgggaggccaaggtgcagtggaaggtggacaatgccctgcagagcggcaacagccaggagagcgtgacagagcaggacagcaaggacagcacctacagcctgagcagcaccctgaccctgagcaaggctgactatgagaagcacaaggtgtatgcctgtgaggtgacccaccagggcctgagcagccctgtgaccaagagcttcaacagaggagaatgttag

SEQ ID NO: 3213 - DNA, 657 bp, Artificial Sequence
  Description of Artificial Sequence: Synthetic coding sequence
atggccaccaggagccctggggtggtgatcagtgatgatgagcccggctatgacctggacctcttctgcatccccaaccactatgcagaggacctggagagggtcttcatcccccacggcctcatcatggacagaacagagcggctggccagagatgtgatgaaggagatgggcggccaccacatcgtggccctgtgtgtgctgaagggcggctacaagttctttgctgacctgctggactacatcaaggccctgaacagaaacagcgacaggagcatccccatgacagtggacttcatccggctgaagagctactgcaatgaccagagcactggagacatcaaggtgattggaggagatgacctgagcaccctgaccgggaagaatgtgctgattgtggaggacatcatcgacaccgggaagaccatgcagaccctgctgagcctggtgcggcagtacaaccccaagatggtgaaggtggccagcctgctggtgaagaggacccccaggtctgtgggctacaagccagactttgtgggctttgagatcccagacaagtttgtggtgggctacgccctggactacaatgagtacttccgggacctgaaccacgtgtgtgtgatcagcgagaccgggaaggccaagtacaaggcctag

SEQ ID NO: 3214 - DNA, 657 bp, Artificial Sequence
  Description of Artificial Sequence: Synthetic coding sequence
atggccaccaggagccctggggtggtgatcagtgatgatgagcccggctatgacctggacctcttctgcatccccaaccactatgcagaggacctggagagggtcttcatcccccacggcctcatcatggacagaacagagcggctggccagagatgtgatgaaggagatgggcggccaccacatcgtggccctgtgtgtgctgaagggcggctacaagttctttgctgacctgctggactacatcaaggccctgaacagaaacagcgacaggagcatccccatgacagtggacttcatccggctgaagagctactgcaatgaccagagcactggagacatcaaggtgattggaggagatgacctgagcaccctgaccgggaagagccggctgctggccgaggacatcatcgacaccgggaagaccatgcagaccctgctgagcctggtgcggcagtacaaccccaagatggtgaaggtggccagcctgctggtgaagaggacccccaggtctgtgggctacaagccagactttgtgggctttgagatcccagacaagtttgtggtgggctacgccctggactacaatgagtacttccgggacctgaaccacgtgtgtgtgatcagcgagaccgggaaggccaagtacaaggcctag

SEQ ID NO: 3215 - DNA, 1653 bp, Artificial Sequence
  Description of Artificial Sequence: Synthetic coding sequence
atgcccccacccaggacaggccggggcctgctgtggctgggcctggtgctgagctctgtgtgtgtggccctgggcagcgagacccaggccaacagcaccacagatgccctgaatgtgctgctgatcatcgtggatgacctgcggcccagcctgggctgctacggggacaagctggtgcgcagccccaacatcgaccagctggccagccacagcctgctcttccagaatgcctttgcccagcaggccgtgtgtgcccccagccgggtgtccttcctgactggaagaagaccagacaccacccggctgtatgacttcaacagctactggagggtgcatgctggcaacttcagcaccatcccccagtacttcaaggaaaatggctacgtgaccatgtctgtgggcaaggtgttccaccctggcatcagcagcaaccacacagatgacagcccctacagctggagcttccccccctaccaccccagcagcgagaagtatgagaacaccaagacctgccggggcccagatggagagctgcacgccaacctgctgtgccctgtggatgtgctggatgtgcctgagggcaccctgcctgacaagcagagcacagagcaggccatccagctgctggagaagatgaagaccagcgccagccccttcttcctggccgtgggctaccacaagccccacatccccttccgctaccccaaggagttccagaagctgtaccccctggagaacatcaccctggccccagaccctgaggtgcctgatggcctgccccctgtggcctacaacccctggatggacatccggcagcgggaggatgtgcaggccctgaacatctctgtgccctacggccccatccctgtggacttccagaggaagatccggcagagctactttgcctctgtgtcctacctggacacccaggtgggccgcctgctgagcgccctggatgacctgcagctggccaacagcaccatcatcgccttcaccagtgaccacggctgggccctgggggagcacggggagtgggccaagtacagcaactttgatgtggccacccacgtgcccctcatcttctacgtgcccggccgcacagccagcctgcctgaggccggggagaagctgttcccctacctggacccctttgacagcgccagccagctgatggagcccggccggcagagcatggacctggtggagctggtgtccctcttccccaccctggccggcctggccggcctgcaggtgcccccacgctgccctgtgcccagcttccacgtggagctgtgccgggagggcaagaacctgctgaagcacttccgcttccgggacctggaggaggacccctacctgcccggcaacccccgggagctgattgcctacagccagtacccccggcccagcgacatcccccagtggaacagcgacaagcccagcctgaaggacatcaagatcatgggctacagcatccgcaccatcgactaccgctacacagtgtgggtgggcttcaacccagatgagttcctggccaacttcagtgacatccatgctggggagctgtactttgtggacagcgaccccctgcaggaccacaacatgtacaatgacagccagggcggggacctcttccagctgctgatgccctag

SEQ ID NO: 3216 - DNA, 1032 bp, Artificial Sequence
  Description of Artificial Sequence: Synthetic coding sequence
atgcccccacccaggacaggccggggcctgctgtggctgggcctggtgctgagctctgtgtgtgtggccctgggcagcgagacccaggccaacagcaccacagatgccctgaatgtgctgctgatcatcgtggatgacctgcggcccagcctgggctgctacggggacaagctggtgcgcagccccaacatcgaccagctggccagccacagcctgctcttccagaatgcctttgcccagcaggccgtgtgtgcccccagccgggtgtccttcctgactggaagaagaccagacaccacccggctgtatgacttcaacagctactggagggtgcatgctggcaacttcagcaccatcccccagtacttcaaggaaaatggctacgtgaccatgtctgtgggcaaggtgttccaccctggcatcagcagcaaccacacagatgacagcccctacagctggagcttccccccctaccaccccagcagcgagaagtatgagaacaccaagacctgccggggcccagatggagagctgcacgccaacctgctgtgccctgtggatgtgctggatgtgcctgagggcaccctgcctgacaagcagagcacagagcaggccatccagctgctggagaagatgaagaccagcgccagccccttcttcctggccgtgggctaccacaagccccacatccccttccgctaccccaaggagttccagaagctgtaccccctggagaacatcaccctggccccagaccctgaggtgcctgatggcctgccccctgtggcctacaacccctggatggacatccggcagcgggaggatgtgcaggccctgaacatctctgtgccctacggccccatccctgtggacttccagaggaagatccggcagagctactttgcctctgtgtcctacctggacacccaggtgggccgcctgctgagcgccctggatgacctgcagctggccaacagcaccatcatcgccttcaccagtgaccacggcttcctgatgaggaccaacacctag

SEQ ID NO: 3217 - DNA, 939 bp, Artificial Sequence
  Description of Artificial Sequence: Synthetic coding sequence
atgcccccacccaggacaggccggggcctgctgtggctgggcctggtgctgagctctgtgtgtgtggccctgggcagcgagacccaggccaacagcaccacagatgccctgaatgtgctgctgatcatcgtggatgacctgcggcccagcctgggctgctacggggacaagctggtgcgcagccccaacatcgaccagctggccagccacagcctgctcttccagaatgcctttgcccagcaggccgtgtgtgcccccagccgggtgtccttcctgactggaagaagaccagacaccacccggctgtatgacttcaacagctactggagggtgcatgctggcaacttcagcaccatcccccagtacttcaaggaaaatggctacgtgaccatgtctgtgggcaaggtgttccaccctggcatcagcagcaaccacacagatgacagcccctacagctggagcttccccccctaccaccccagcagcgagaagtatgagaacaccaagacctgccggggcccagatggagagctgcacgccaacctgctgtgccctgtggatgtgctggatgtgcctgagggcaccctgcctgacaagcagagcacagagcaggccatccagctgctggagaagatgaagaccagcgccagccccttcttcctggccgtgggctaccacaagccccacatccccttccgctaccccaaggagttccagaagctgtaccccctggagaacatcaccctggccccagaccctgaggtgcctgatggcctgccccctgtggcctacaacccctggatggacatccggcagcgggaggatgtgcaggccctgaacatctctgtgccctacggccccatccctgtggacttccaggaggaccagagcagcacaggcttccggctgaagaccagcagcaccaggaagtacaagtag

SEQ ID NO: 3218 - DNA, 540 bp, Artificial Sequence
  Description of Artificial Sequence: Synthetic coding sequence
atgcccccacccaggacaggccggggcctgctgtggctgggcctggtgctgagctctgtgtgtgtggccctgggcagcgagacccaggccaacagcaccacagatgccctgaatgtgctgctgatcatcgtggatgacctgcggcccagcctgggctgctacggggacaagctggtgcgcagccccaacatcgaccagctggccagccacagcctgctcttccagaatgcctttgcccagcaggccgtgtgtgcccccagccgggtgtccttcctgactggaagaagaccagacaccacccggctgtatgacttcaacagctactggagggtgcatgctggcaacttcagcaccatcccccagtacttcaaggaaaatggctacgtgaccatgtctgtgggcaaggtgttccaccctggaacagccccctgcccagagagcggcttctcctggtttgtggtgtctgagagcagcatccccatcctgggcatgggcctgagcctgcagagccccctgctggccggccgggtgcccaggtag

SEQ ID NO: 3219 - DNA, 261 bp, Artificial Sequence
  Description of Artificial Sequence: Synthetic coding sequence
atgcccccacccaggacaggccggggcctgctgtggctgggcctggtgctgagctctgtgtgtgtggccctgggcagcgagacccaggccaacagcaccacagatgccctgaatgtgctgctgatcatcgtggatgacctgcggcccagcctgggctgctacggggacaagctggtgcgcagccccaacatcgaccagctggccagccacagcctgctcttccagaatgcctttgcccagcaggccgtgtgtgccccctag

SEQ ID NO: 3220 - DNA, 462 bp, Artificial Sequence
  Description of Artificial Sequence: Synthetic coding sequence
atggacctggtggagctggtgtccctcttccccaccctggccggcctggccggcctgcaggtgcccccacgctgccctgtgcccagcttccacgtggagctgtgccgggagggcaagaacctgctgaagcacttccgcttccgggacctggaggaggacccctacctgcccggcaacccccgggagctgattgcctacagccagtacccccggcccagcgacatcccccagtggaacagcgacaagcccagcctgaaggacatcaagatcatgggctacagcatccgcaccatcgactaccgctacacagtgtgggtgggcttcaacccagatgagttcctggccaacttcagtgacatccacgccggggagctgtactttgtggacagcgaccccctgcaggaccacaacatgtacaatgacagccagggcggggacctcttccagctgctgatgccctag

SEQ ID NO: 3221 - DNA, 1020 bp, Artificial Sequence
  Description of Artificial Sequence: Synthetic coding sequence
atgaagaccagcgccagccccttcttcctggccgtgggctaccacaagccccacatccccttccgctaccccaaggagttccagaagctgtaccccctggagaacatcaccctggccccagaccctgaggtgcctgatggcctgccccctgtggcctacaacccctggatggacatccggcagagagaagatgtgcaggccctgaacatctctgtgccctacggccccatccctgtggacttccagaggaagatccggcagagctactttgcctctgtgtcctacctggacacccaggtgggccgcctgctgagcgccctggatgacctgcagctggccaacagcaccatcatcgccttcaccagtgaccacggctgggccctgggggagcacggggagtgggccaagtacagcaactttgatgtggccacccacgtgcccctcatcttctacgtgcccggccgcacagccagcctgcctgaggccggggagaagctgttcccctacctggacccctttgattctgccagccagctgatggagcccggccggcagagcatggacctggtggagctggtgtccctcttccccaccctggccggcctggccggcctgcaggtgcccccacgctgccctgtgcccagcttccacgtggagctgtgccgggagggcaagaacctgctgaagcacttccgcttccgggacctggaggaggacccctacctgcccggcaacccccgggagctgattgcctacagccagtacccccggcccagcgacatcccccagtggaacagcgacaagcccagcctgaaggacatcaagatcatgggctacagcatccgcaccatcgactaccgctacacagtgtgggtgggcttcaacccagatgagttcctggccaacttcagtgacatccacgccggggagctgtactttgtggacagcgaccccctgcaggaccacaacatgtacaatgacagccagggcggggacctcttccagctgctgatgccctag

SEQ ID NO: 3222 - DNA, 1962 bp, Artificial Sequence
  Description of Artificial Sequence: Synthetic coding sequence
atgaggcccctgcggccccgggccgccctgctggccctgctggccagcctgctggccgcccctcctgtggccccagctgaggccccccacctggtgcacgtggatgctgcccgggccctgtggcccctgcggcgcttctggaggagcacaggcttctgcccccccctgccccacagccaggccgaccagtatgtgctgtcctgggaccagcagctgaacctggcctacgtgggcgctgtgccccaccggggcatcaagcaggtgaggacccactggctgctggagctggtgaccacccggggcagcacaggccggggcctgagctacaacttcacccacctggatggctacctggacctgctgcgggagaaccagctgctgcccggctttgagctgatgggcagcgccagcggccacttcacagactttgaggacaagcagcaggtgtttgagtggaaggacctggtgagcagcctggcccggcgctacatcggccgctatggcctggcccacgtgtccaagtggaactttgagacctggaatgaaccagaccaccacgactttgacaacgtgtccatgaccatgcagggcttcctgaactactatgatgcctgcagcgagggcctgcgggccgccagccctgccctgcggctgggcggccctggggacagcttccacaccccacccaggagccccctgtcctggggcctgctgcggcactgccatgatggcaccaacttcttcaccggggaggccggcgtgcggctggactacatcagcctgcacaggaagggggcccggagcagcatcagcatcctggagcaggagaaggtggtggcccagcagatccggcagctgttccccaagtttgctgacacccccatctacaatgatgaggccgaccccctggtgggctggagcctgccccagccctggagggcagatgtgacctatgctgccatggtggtgaaggtgattgcccagcaccagaacctgctgctggccaacaccaccagcgccttcccctatgccctgctgagcaatgacaatgccttcctgagctaccacccccacccctttgcccagaggaccctgacagcccgcttccaggtgaacaacacccggcccccccacgtgcagctgctgaggaagcctgtgctgacagccatgggcctgctggccctgctggatgaggagcagctgtgggccgaggtgtcccaggccggcaccgtgctggacagcaaccacacagtgggcgtgctggccagcgcccaccggccccagggccctgcagatgcctggagggctgctgtgctgatctatgccagtgatgacacccgggcccaccccaacagatctgtggccgtgaccctgcggctgcggggcgtgcccccaggccctggcctggtgtatgtgacccgctacctggacaatggcctgtgcagcccagatggagagtggaggcggctgggccggcctgtgttccccacagctgagcagttccggaggatgagagctgctgaggaccctgtggccgccgccccccggcccctgcctgctgggggccgcctgaccctgcggcctgccctgcggctgcccagcctgctgctggtgcacgtgtgtgcccggcctgagaagcccccaggccaggtgacccggctgcgggccctgcccctgacccagggccagctggtgctggtgtggagcgatgagcacgtgggcagcaagtgcctgtggacctatgagatccagttcagccaggacggcaaggcctacacccctgtgtccaggaagcccagcaccttcaacctgtttgtgttctccccagacacaggagctgtgtctggcagctacagagtgcgggccctggactactgggcccggcccggccccttcagtgaccctgtgccctacctggaggtgcctgtgccccggggcccccccagccctggcaacccctag

SEQ ID NO: 3223 - DNA, 2028 bp, Artificial Sequence
  Description of Artificial Sequence: Synthetic coding sequence
atgaggcccctgcggccccgggccgccctgctggccctgctggccagcctgctggccgcccctcctgtggccccagctgaggccccccacctggtgcacgtggatgctgcccgggccctgtggcccctgcggcgcttctggaggagcacaggcttctggggcagcacaggccggggcctgagctacaacttcacccacctggatggctacctggacctgctgcgggagaaccagctgctgcccggctttgagctgatgggcagcgccagcggccacttcacagactttgaggacaagcagcaggtgtttgagtggaaggacctggtgagcagcctggcccggcgctacatcggccgctatggcctggcccacgtgtccaagtggaactttgagacctggaatgaaccagaccaccacgactttgacaacgtgtccatgaccatgcagggcttcctgaactactatgatgcctgcagcgagggcctgcgggccgccagccctgccctgcggctgggcggccctggggacagcttccacaccccacccaggagccccctgtcctggggcctgctgcggcactgccatgatggcaccaacttcttcaccggggaggccggcgtgcggctggactacatcagcctgcacaggaaggtgcggcctgccccacccagcgcccctgtgttctgtgccctgagccgctgtgcccctggccgggctgaccctggaggagctgaggccgcccccccagctggctgtgcccagctgcacctgcaccctggagctggggagggcagaagagctgctgaccctgctgccctgccccaggtgcggggccacccccacctgcagaggcggggcggccctgctgggggcctggtgcctgccacagctgtggagggcggccgggacctgcggggccatggaggagagggcggccctgcccagaggcctgcccggcccccagccaccttcctgccccggcgggaccggcgggctgtggccgcccctcctggccccagctgccccggccacccccaggtgattgcccagcaccagaacctgctgctggccaacaccaccagcgccttcccctatgccctgctgagcaatgacaatgccttcctgagctaccacccccacccctttgcccagaggaccctgacagcccgcttccaggtgaacaacacccggcccccccacgtgcagctgctgaggaagcctgtgctgacagccatgggcctgctggccctgctggatgaggagcagctgtgggccgaggtgtcccaggccggcaccgtgctggacagcaaccacacagtgggcgtgctggccagcgcccaccggccccagggccctgcagatgcctggagggctgctgtgctgatctatgccagtgatgacacccgggcccaccccaacagatctgtggccgtgaccctgcggctgcggggcgtgcccccaggccctggcctggtgtatgtgacccgctacctggacaatggcctgtgcagcccagatggagagtggaggcggctgggccggcctgtgttccccacagctgagcagttccggaggatgagagctgctgaggaccctgtggccgccgccccccggcccctgcctgctgggggccgcctgaccctgcggcctgccctgcggctgcccagcctgctgctggtgcacgtgtgtgcccggcctgagaagcccccaggccaggtgacccggctgcgggccctgcccctgacccagggccagctggtgctggtgtggagcgatgagcacgtgggcagcaagtgcctgtggacctatgagatccagttcagccaggacggcaaggcctacacccctgtgtccaggaagcccagcaccttcaacctgtttgtgttctccccagacacaggagctgtgtctggcagctacagagtgcgggccctggactactgggcccggcccggccccttcagtgaccctgtgccctacctggaggtgcctgtgccccggggcccccccagccctggcaacccctag

SEQ ID NO: 3224 - DNA, 603 bp, Artificial Sequence
  Description of Artificial Sequence: Synthetic coding sequence
atggccctgtggatgaggctgctgcccctgctggccctgctggccctgtggggccctgaccctgctgctgcctttgtgaaccagcacctgtgtggcagccacctggtggaggccctgtacctggtgtgtggggagcggggcttcttctacacccccaagacccggcgggaggccgaggacctgcaggccagcgccctgagcctgagcagcagcaccagcacctggccagagggcctggatgccacagcccgggcccccccagccctggtggtgacagccaacatcggccaggccggcggcagcagcagccggcagttccggcagagggccctgggcaccagtgacagccctgtgctcttcatccactgccctggagctgctggaacagcccagggcctggagtaccggggccggcgggtgaccacagagctggtgtgggaggaggtggacagcagcccccagccccagggcagcgagagcctgcctgcccagcccccagcccagcctgccccccagcctgagccccagcaggcccgggagcccagccctgaggtgtcctgctgcggcctgtggccccggcggccccagaggagccagaactag

SEQ ID NO: 3225 - DNA, 333 bp, Artificial Sequence
  Description of Artificial Sequence: Synthetic coding sequence
atggccctgtggatgaggctgctgcccctgctggccctgctggccctgtggggccctgaccctgctgctgcctttgtgaaccagcacctgtgtggcagccacctggtggaggccctgtacctggtgtgtggggagcggggcttcttctacacccccaagacccggcgggaggccgaggacctgcaggtgggccaggtggagctgggcggcggccctggggccggcagcctgcagcccctggccctggagggcagcctgcagaagaggggcatcgtggagcagtgctgcaccagcatctgcagcctgtaccagctggagaactactgcaactag

SEQ ID NO: 3226 - DNA, 333 bp, Artificial Sequence; identical to SEQ ID NO: 3225
  Description of Artificial Sequence: Synthetic coding sequence

SEQ ID NO: 3227 - DNA, 333 bp, Artificial Sequence; identical to SEQ ID NO: 3225
  Description of Artificial Sequence: Synthetic coding sequence

SEQ ID NO: 3228 - DNA, 297 bp, Artificial Sequence
  Description of Artificial Sequence: Synthetic coding sequence
atggccctgtggatgaggctgctgcccctgctggccctgctggccctgtggggccctgaccctgctgctgcctttgtgaaccagcacctgtgtggcagccacctggtggaggccctgtacctggtgtgtggggagcggggcttcttctacacccccaagacccggcgggaggccgaggacctgcagggcagcctgcagcccctggccctggagggcagcctgcagaagaggggcatcgtggagcagtgctgcaccagcatctgcagcctgtaccagctggagaactactgcaactag

SEQ ID NO: 3229 - DNA, 333 bp, Artificial Sequence
  Description of Artificial Sequence: Synthetic coding sequence
atggccctgtggatgaggctgctgcccctgctggccctgctggccctgtggggccctgaccctgctgctgcctttgtgaaccagcacctgtgtggcagccacctggtggaggccctgtacctggtgtgtggggagcggggcttcttctacacagacaagacccggcgggaggccgaggacctgcaggtgggccaggtggagctgggcggcggccctggggccggcagcctgcagcccctggccctggagggcagcctgcagaagaggggcatcgtggagcagtgctgcaccagcatctgcagcctgtaccagctggagaactactgcaactag

SEQ ID NO: 3230 - DNA, 333 bp, Artificial Sequence
  Description of Artificial Sequence: Synthetic coding sequence
atggccctgtggatgaggctgctgcccctgctggccctgctggccctgtggggccctgaccctgctgctgcctttgtgaaccagcacctgtgtggcagccacctggtggaggccctgtacctggtgtgtggggagcggggcttcttctacacccccaagacccggcgggaggccgaggacctgcaggtgggccaggtggagctgggcggcggccctggggccggcagcctgcagcccctggccctggagggcagcctgcagaagaggggcatcgtggagcagtgctgcaccagcatctgcagcctgtaccagctggagaactactgcggctag

SEQ ID NO: 3231 - DNA, 333 bp, Artificial Sequence
  Description of Artificial Sequence: Synthetic coding sequence
atggccctgtggatgaggctgctgcccctgctggccctgctggccctgtggggccctgaccctgctgctgcctttgtgaagcagcacctgtgtggcagccacctggtggaggccctgtacctggtgtgtggggagcggggcttcttctacaccccagagacccggcgggaggccgaggacctgcaggtgggccaggtggagctgggcggcggccctggggccggcagcctgcagcccctggccctggagggcagcctgcagaagaggggcatcgtggagcagtgctgcaccagcatctgcagcctgtaccagctggagaactactgcaactag

SEQ ID NO: 3232 - DNA, 333 bp, Artificial Sequence
  Description of Artificial Sequence: Synthetic coding sequence
atggccctgtggatgaggctgctgcccctgctggccctgctggccctgtggggccctgaccctgctgctgcctttgtgaaccagcacctgtgtggcagccacctggtggaggccctgtacctggtgtgtggggagcggggcttcttctacaccaagcccacccggcgggaggccgaggacctgcaggtgggccaggtggagctgggcggcggccctggggccggcagcctgcagcccctggccctggagggcagcctgcagaagaggggcatcgtggagcagtgctgcaccagcatctgcagcctgtaccagctggagaactactgcaactag

SEQ ID NO: 3233 - DNA, 570 bp, Artificial Sequence
  Description of Artificial Sequence: Synthetic coding sequence
atggccctgtccttcagcctgctgatggctgtgctggtgctgagctacaagagcatctgcagcctgggctgtgacctgccccagacccacagcctgggcaacagaagagccctgatcctgctgggccagatgggccgcatcagccccttcagctgcctgaaggacagacatgacttccgcatcccccaggaggagtttgatggcaaccagttccagaaggcccaggccatctctgtgctgcacgagatgatccagcagaccttcaacctcttcagcacagaggacagcagcgctgcctgggagcagagcctgctggagaagttcagcacagagctgtaccagcagctgaatgacctggaggcctgcgtcatccaggaggtgggcgtggaggagacccccctgatgaatgaagattccatcctggccgtgaggaagtacttccagaggatcaccctgtacctgattgaaaggaagtacagcccctgtgcctgggaggtggtgcgggcagagatcatgaggagcctgtccttcagcaccaacctgcagaagaggctgcggaggaaggactag

SEQ ID NO: 3234 - DNA, 573 bp, Artificial Sequence
  Description of Artificial Sequence: Synthetic coding sequence
atgatggccagcccctttgccctgctgatggccctggtggtgctgagctgcaagagcagctgcagcctgggctgtgacctgcctgagacccacagcctggacaacagaaggaccctgatgctgctggcccagatgagccgcatcagccccagcagctgcctgatggacagacatgactttggcttcccccaggaggagtttgatggcaaccagttccagaaggccccagccatctctgtgctgcacgagctgatccagcagatcttcaacctcttcaccaccaaggacagcagcgctgcctgggatgaggacctgctggacaagttctgcacagagctgtaccagcagctgaatgacctggaggcctgtgtgatgcaggaggagcgggtgggggagacccccctgatgaatgctgacagcatcctggccgtgaagaagtacttccgccgcatcaccctgtacctgacagagaagaagtacagcccctgtgcctgggaggtggtgcgggcagagatcatgaggagcctgagcctgagcaccaacctgcaggagcggctgcggaggaaggagtag

SEQ ID NO: 3235 - DNA, 570 bp, Artificial Sequence
  Description of Artificial Sequence: Synthetic coding sequence
atggccctgccctttgccctgatgatggccctggtggtgctgagctgcaagagcagctgcagcctgggctgcaacctgagccagacccacagcctgaacaacagaaggaccctgatgctgatggcccagatgaggcgcatcagccccttcagctgcctgaaggacagacatgactttgagttcccccaggaggagtttgatggcaaccagttccagaaggcccaggccatctctgtgctgcacgagatgatgcagcagaccttcaacctcttcagcaccaagaacagcagcgctgcctgggatgagaccctgctggagaagttctacatcgagctgttccagcagatgaatgacctggaggcctgcgtcatccaggaggtgggcgtggaggagacccccctgatgaatgaagattccatcctggccgtgaagaagtacttccagaggatcaccctgtacctgatggagaagaagtacagcccctgtgcctgggaggtggtgcgggcagagatcatgaggagcctgtccttcagcaccaacctgcagaagaggctgcggaggaaggactag

SEQ ID NO: 3236 - DNA, 570 bp, Artificial Sequence
  Description of Artificial Sequence: Synthetic coding sequence
atggccctgtccttcagcctgctgatggctgtgctggtgctgagctacaagagcatctgcagcctgggctgtgacctgccccagacccacagcctgggcaacagaagagccctgatcctgctggcccagatgggccgcatcagccacttcagctgcctgaaggacagatatgactttggcttcccccaggaggtgtttgatggcaaccagttccagaaggcccaggccatcagcgccttccacgagatgatccagcagaccttcaacctcttcagcaccaaggacagcagcgctgcctgggatgagaccctgctggacaagttctacatcgagctgttccagcagctgaatgacctggaggcctgtgtgacccaggaggtgggcgtggaggagatcgccctgatgaatgaagattccatcctggccgtgaggaagtacttccagaggatcaccctgtacctgatgggcaagaagtacagcccctgtgcctgggaggtggtgcgggcagagatcatgaggagcttctccttcagcaccaacctgcagaagggcctgcggaggaaggactag

SEQ ID NO: 3237 - DNA, 570 bp, Artificial Sequence
  Description of Artificial Sequence: Synthetic coding sequence
atggccctgtccttcagcctgctgatggctgtgctggtgctgagctacaagagcatctgcagcctgggctgtgacctgccccagacccacagcctgggcaacagaagagccctgatcctgctggcccagatgggccgcatcagccccttcagctgcctgaaggacagacatgactttggcctgccccaggaggagtttgatggcaaccagttccagaagacccaggccatctctgtgctgcacgagatgatccagcagaccttcaacctcttcagcacagaggacagcagcgctgcctgggagcagagcctgctggagaagttcagcacagagctgtaccagcagctgaacaacctggaggcctgcgtcatccaggaggtgggcatggaggagacccccctgatgaatgaagattccatcctggccgtgaggaagtacttccagaggatcaccctgtacctgacagagaagaagtacagcccctgtgcctgggaggtggtgcgggcagagatcatgaggagcctgtccttcagcaccaacctgcagaagatcctgcggaggaaggactag

SEQ ID NO: 3238 - DNA, 567 bp, Artificial Sequence
  Description of Artificial Sequence: Synthetic coding sequence
atggccctgacctttgccctgctggtggccctgctggtgctgagctgcaagagcagctgcagcgtgggctgtgacctgccccagacccacagcctgggcagcaggaggaccctgatgctgctggcccagatgaggcgcatcagcctcttcagctgcctgaaggacagacatgactttggcttcccccaggaggagtttggaaaccagttccagaaggccgagaccatccctgtgctgcacgagatgatccagcagatcttcaacctcttcagcaccaaggacagcagcgctgcctgggatgagaccctgctggacaagttctacacagagctgtaccagcagctgaatgacctggaggcctgtgtgatccagggcgtgggcgtgacagagacccccctgatgaaggaggacagcatcctggccgtgaggaagtacttccagaggatcaccctgtacctgaaggagaagaagtacagcccctgtgcctgggaggtggtgcgggcagagatcatgaggagcttcagcctgagcaccaacctgcaggagagcctgcggagcaaggagtag

SEQ ID NO: 3239 - DNA, 570 bp, Artificial Sequence
  Description of Artificial Sequence: Synthetic coding sequence
atggccctgtccttcagcctgctgatggctgtgctggtgctgagctacaagagcatctgcagcctgggctgtgacctgccccagacccacagcctgggcaacagaagagccctgatcctgctggcccagatgggccgcatcagccccttcagctgcctgaaggacagacatgactttggcttcccccaggaggagtttgatggcaaccagttccagaaggcccaggccatctctgtgctgcacgagatgatccagcagaccttcaacctcttcagcaccaaggacagcagcgccacctgggagcagagcctgctggagaagttcagcacagagctgaaccagcagctgaatgacctggaggcctgcgtcatccaggaggtgggcgtggaggagacccccctgatgaatgtggacagcatcctggccgtgaagaagtacttccagaggatcaccctgtacctgacagagaagaagtacagcccctgtgcctgggaggtggtgcgggcagagatcatgaggagcttcagcctgagcaagatcttccaggagcggctgcggaggaaggagtag

SEQ ID NO: 3240 - DNA, 570 bp, Artificial Sequence
  Description of Artificial Sequence: Synthetic coding sequence
atggccctgtccttcagcctgctgatggctgtgctggtgctgagctacaagagcatctgcagcctgggctgtgacctgccccagacccacagcctgggcaacagaagagccctgatcctgctggcccagatgggccgcatcagccacttcagctgcctgaaggacagacatgactttggcttccctgaggaggagtttgatggccaccagttccagaaggcccaggccatctctgtgctgcacgagatgatccagcagaccttcaacctcttcagcacagaggacagcagcgctgcctgggagcagagcctgctggagaagttcagcacagagctgtaccagcagctgaatgacctggaggcctgcgtcatccaggaggtgggcgtggaggagacccccctgatgaatgaagattccatcctggccgtgaggaagtacttccagaggatcaccctgtacctgacagagaagaagtacagcccctgtgcctgggaggtggtgcgggcagagatcatgaggagcctgtccttcagcaccaacctgcagaagaggctgcggaggaaggactag

SEQ ID NO: 3241 - DNA, 570 bp, Artificial Sequence
  Description of Artificial Sequence: Synthetic coding sequence
atggccctgccctttgtgctgctgatggccctggtggtgctgaactgcaagagcatctgcagcctgggctgtgacctgccccagacccacagcctgagcaacagaaggaccctgatgatcatggcccagatgggccgcatcagccccttcagctgcctgaaggacagacatgactttggcttcccccaggaggagtttgatggcaaccagttccagaaggcccaggccatctctgtgctgcacgagatgatccagcagaccttcaacctcttcagcaccaaggacagcagcgccacctgggatgagaccctgctggacaagttctacacagagctgtaccagcagctgaatgacctggaggcctgcatgatgcaggaggtgggcgtggaggacacccccctgatgaatgtggacagcatcctgactgtgaggaagtacttccagaggatcaccctgtacctgacagagaagaagtacagcccctgtgcctgggaggtggtgcgggcagagatcatgaggagcttcagcctgagcgccaacctgcaggagcggctgcggaggaaggagtag

SEQ ID NO: 3242 - DNA, 570 bp, Artificial Sequence
  Description of Artificial Sequence: Synthetic coding sequence
atggccctgccctttgccctgctgatggccctggtggtgctgagctgcaagagcagctgcagcctggactgtgacctgccccagacccacagcctgggccacaggaggaccatgatgctgctggcccagatgaggcgcatcagcctcttcagctgcctgaaggacagacatgacttccgcttcccccaggaggagtttgatggcaaccagttccagaaggccgaggccatctctgtgctgcatgaagtcatccagcagaccttcaacctcttcagcaccaaggacagctctgtggcctgggatgagcggctgctggacaagctgtacacagagctgtaccagcagctgaatgacctggaggcctgtgtgatgcaggaggtgtgggtgggcggcacccccctgatgaatgaagattccatcctggccgtgaggaagtacttccagaggatcaccctgtacctgacagagaagaagtacagcccctgtgcctgggaggtggtgcgggcagagatcatgaggagcttcagcagcagcaggaacctgcaggagcggctgcggaggaaggagtag

SEQ ID NO: 3243 - DNA, 570 bp, Artificial Sequence
  Description of Artificial Sequence: Synthetic coding sequence
atggcccggagcttcagcctgctgatggtggtgctggtgctgagctacaagagcatctgcagcctgggctgtgacctgccccagacccacagcctgaggaacagaagagccctgatcctgctggcccagatgggccgcatcagccccttcagctgcctgaaggacagacatgagttccgcttccctgaggaggagtttgatggccaccagttccagaagacccaggccatctctgtgctgcacgagatgatccagcagaccttcaacctcttcagcacagaggacagcagcgctgcctgggagcagagcctgctggagaagttcagcacagagctgtaccagcagctgaatgacctggaggcctgcgtcatccaggaggtgggcgtggaggagacccccctgatgaatgaagacttcatcctggccgtgaggaagtacttccagaggatcaccctgtacctgatggagaagaagtacagcccctgtgcctgggaggtggtgcgggcagagatcatgaggagcttctccttcagcaccaacctgaagaagggcctgcggaggaaggactag

SEQ ID NO: 3244 - DNA, 570 bp, Artificial Sequence
  Description of Artificial Sequence: Synthetic coding sequence
atggccctgaccttctacctgctggtggccctggtggtgctgagctacaagagcttcagcagcctgggctgtgacctgccccagacccacagcctgggcaacagaagagccctgatcctgctggcccagatgaggcgcatcagccccttcagctgcctgaaggacagacatgactttgagttcccccaggaggagtttgatgacaagcagttccagaaggcccaggccatctctgtgctgcacgagatgatccagcagaccttcaacctcttcagcaccaaggacagcagcgctgccctggatgagaccctgctggatgagttctacatcgagctggaccagcagctgaatgacctggagagctgtgtgatgcaggaggtgggcgtcatcgagagccccctgatgtatgaagattccatcctggccgtgaggaagtacttccagaggatcaccctgtacctgacagagaagaagtacagcagctgtgcctgggaggtggtgcgggcagagatcatgaggagcttcagcctgagcatcaacctgcagaagaggctgaagagcaaggagtag

SEQ ID NO: 3245 - DNA, 564 bp, Artificial Sequence
  Description of Artificial Sequence: Synthetic coding sequence
atgaccaacaagtgcctgctgcagatcgccctgctgctgtgcttcagcaccacagccctgtccatgagctacaacctgctgggcttcctgcagaggagcagcaacttccagtgccagaagctgctgtggcagctgaatggccgcctggagtactgcctgaaggacaggatgaactttgacatccctgaggagatcaagcagctgcagcagttccagaaggaggatgctgccctgaccatctatgagatgctgcagaacatctttgccatcttccggcaggacagcagcagcacaggctggaatgagaccatcgtggagaacctgctggccaacgtgtaccaccagatcaaccacctgaagacagtgctggaggagaagctggagaaggaggacttcacccggggcaagctgatgagcagcctgcacctgaagcgctactacggccgcatcctgcactacctgaaggccaaggagtacagccactgtgcctggaccatcgtgcgggtggagatcctgaggaacttctacttcatcaaccggctgaccggctacctgaggaactag

SEQ ID NO: 3246 - DNA, 537 bp, Artificial Sequence
  Description of Artificial Sequence: Synthetic coding sequence
atgcacagcagcgccctgctgtgctgcctggtgctgctgactggagtgcgggccagccctggccagggcacccagagcgagaacagctgcacccacttccctggcaacctgcccaacatgctgcgggacctgagagatgccttcagccgggtgaagaccttcttccagatgaaggaccagctggacaacctgctgctgaaggagagcctgctggaggacttcaagggctacctgggctgccaggccctgtctgagatgatccagttctacctggaggaggtgatgccccaggccgagaaccaggaccctgacatcaaggcccacgtgaacagcctgggggagaacctgaagaccctgcggctgcggctgcggcgctgccaccgcttcctgccctgtgagaacaagagcaaggctgtggagcaggtgaagaatgccttcaacaagctgcaggagaagggcatctacaaggccatgtctgaatttgacatcttcatcaactacatcgaggcctacatgaccatgaagatcagaaattag

SEQ ID NO: 3247 - DNA, 489 bp, Artificial Sequence
  Description of Artificial Sequence: Synthetic coding sequence
atgaggagcagccctggcaacatggagagaattgtcatctgcctgatggtgatcttcctgggcaccctggtgcacaagagcagcagccagggccaggacagacacatgatccgcatgaggcagctgattgatattgtggaccagctgaagaactacgtgaatgacctggtgcctgagttcctgcctgccccagaagatgtggagaccaactgtgagtggagcgccttcagctgcttccagaaggcccagctgaagagcgccaacacaggcaacaatgaaagaatcatcaacgtgtccatcaagaagctgaagaggaagccacccagcaccaatgccggccggcggcagaagcaccggctgacctgccccagctgtgacagctatgagaagaagccacccaaggagttcctggagcgcttcaagagcctgctgcagaagatgatccaccagcacctgagcagcaggacccacggcagcgaggacagctag

SEQ ID NO: 3248 - DNA, 534 bp, Artificial Sequence
  Description of Artificial Sequence: Synthetic coding sequence
atgtttcatgtgtccttccgctacatcttcggcctgcccccactcatcctggtgctgctgcctgtggccagcagtgactgtgacatcgagggcaaggatggcaagcagtatgaatctgtgctgatggtgtccattgaccagctgctggacagcatgaaggagatcggcagcaactgcctgaacaatgagttcaacttcttcaagaggcacatctgtgatgccaacaaggagggcatgttcctgttccgggccgccaggaagctgcggcagttcctgaagatgaacagcactggagactttgacctgcacctgctgaaggtgtctgagggcaccaccatcctgctgaactgcaccggccaggtgaagggcaggaagccagctgccctgggggaggcccagcccaccaagagcctggaggagaacaagagcctgaaggagcagaagaagctgaatgacctgtgcttcctgaagaggctgctgcaggagatcaagacctgctggaacaagatcctgatgggcaccaaggagcactag

SEQ ID NO: 3249 - DNA, 216 bp, Artificial Sequence
  Description of Artificial Sequence: Synthetic coding sequence
atgtttcatgtgtccttccgctacatcttcggcctgcccccactcatcctggtgctgctgcctgtggccagcagtgactgtgacatcgagggcaaggatggcaagcagtatgaatctgtgctgatggtgtccattgaccagctgctgaaccagccctacaagaagaaggagaagaggacagagaggaagcagcagagcgccatgagcaacaactag

SEQ ID NO: 3250 - DNA, 393 bp, Artificial Sequence
  Description of Artificial Sequence: Synthetic coding sequence
gtgtccttccgctacatcttcggcctgcccccactcatcctggtgctgctgcctgtggccagcagtgactgtgacatcgagggcaaggatggcaagcagtatgagagcgtgctgatggtgtccattgaccagctgctggacagcatgaaggagatcggcagcaactgcctgaacaatgagttcaacttcttcaagaggcacatctgtgatgccaacaaggtgaagggcaggaagccagctgccctgggggaggcccagcccaccaagagcctggaggagaacaagagcctgaaggagcagaagaagctgaatgacctgtgcttcctgaagaggctgctgcaggagatcaagacctgctggaacaagatcctgatgggcaccaaggagcactag

SEQ ID NO: 3251 - DNA, 216 bp, Artificial Sequence; identical to SEQ ID NO: 3249
  Description of Artificial Sequence: Synthetic coding sequence

SEQ ID NO: 3252 - DNA, 114 bp, Artificial Sequence
  Description of Artificial Sequence: Synthetic coding sequence
atgtttcatgtgtccttccgctacatcttcggcctgcccccactcatcctggtgctgctgcctgtggccagcagtgactgtgacatcgagggccagcatgaaagaaactggtag

SEQ ID NO: 3253 - DNA, 402 bp, Artificial Sequence
  Description of Artificial Sequence: Synthetic coding sequence
atgtttcatgtgtccttccgctacatcttcggcctgcccccactcatcctggtgctgctgcctgtggccagcagtgactgtgacatcgagggcaaggatggcaagcagtatgaatctgtgctgatggtgtccattgaccagctgctggacagcatgaaggagatcggcagcaactgcctgaacaatgagttcaacttcttcaagaggcacatctgtgatgccaacaaggtgaagggcaggaagccagctgccctgggggaggcccagcccaccaagagcctggaggagaacaagagcctgaaggagcagaagaagctgaatgacctgtgcttcctgaagaggctgctgcaggagatcaagacctgctggaacaagatcctgatgggcaccaaggagcactag

SEQ ID NO: 3254 - DNA, 114 bp, Artificial Sequence; identical to SEQ ID NO: 3252
  Description of Artificial Sequence: Synthetic coding sequence

SEQ ID NO: 3255 - DNA, 195 bp, Artificial Sequence
  Description of Artificial Sequence: Synthetic coding sequence
atgaaggagatcggcagcaactgcctgaacaatgagttcaacttcttcaagaggcacatctgtgatgccaacaaggaggagaacaagagcctgaaggagcagaagaagctgaatgacctgtgcttcctgaagaggctgctgcaggagatcaagacctgctggaacaagatcctgatgggcaccaaggagcactag

SEQ ID NO: 3256 - DNA, 2643 bp, Artificial Sequence
  Description of Artificial Sequence: Synthetic coding sequence
atggccgagctgtacagagtgctggaggccggcaagattggcatctttgagagccccaccggcaccgggaagagcctgagcctcatctgtggggccctgtcctggctgcgggactttgagcagaagaagcgggaggaggaggcccggctgctggagactggaacaggccccctgcatgatgagaaggatgagagcctgtgcctgagcagcagctgtgagggcgccgccggcacccccaggcctgctggggagcccgcctgggtgacccagtttgtgcagaagaaggaggagcgggacctggtggaccggctgaaggccgagcaggcccggaggaagcagcgggaggagcggctgcagcagctgcagcaccgggtgcagctgaagtatgctgccaagaggctgcggcaggaggaggaggagcgggagaacctgctgcggctgagccgggagatgctggagaccggccctgaggccgagcggctggagcagctggagagcggggaggaggagctggtgctggccgagtatgaaagtgatgaggagaagaaggtggccagccgggtggatgaagatgaagatgacctggaggaggagcacatcaccaagatctactactgcagcaggacccacagccagctggcccagtttgtgcatgaggtgaagaagagcccctttgggaaggatgtgcggctggtgtccctgggcagccggcagaacctgtgtgtgaatgaagatgtgaagagcctgggctctgtgcagctgatcaatgacagatgtgtggacatgcagaggagcagacatgagaagaagaagggagctgaggaggagaagcccaagagaagacggcaggagaagcaggccgcctgccccttctacaaccacgagcagatgggcctgctgagagatgaggccctggccgaggtgaaggacatggagcagctgctggccctgggcaaggaggcccgggcctgcccctactacggcagccggctggccatcccagctgcccagctggtggtgctgccctaccagatgctgctgcatgctgccacccggcaggccgccggcatccggctgcaggaccaggtggtgatcattgatgaggcccacaacctgattgacaccatcaccggcatgcacagcgtggaggtgtctggcagccagctgtgccaggcccacagccagctgctgcagtatgtggagagatatggcaagaggctgaaggccaagaacctgatgtacctgaagcagatcctgtacctgctggagaagtttgtggccgtgctgggcggcaacatcaagcagaaccccaacacccagagcctgagccagacaggaacagagctgaagaccatcaatgacttcctgttccagagccagattgacaacatcaacctcttcaaggtgcagcgctactgtgagaagtccatgatcagcaggaagctgtttggcttcacagaaagatatggagctgtgttcagcagccgggagcagcccaagctggccggcttccagcagttcctgcagagcctgcagcccaggaccacagaggccctggccgccccagcagatgagagccaggccagcaccctgcggcctgccagccccctgatgcacatccagggcttcctggccgccctgaccacagccaaccaggacggccgggtcatcctgagccggcagggcagcctgagccagagcaccctgaagttcctgctgctgaacccagctgtgcactttgcccaggtggtgaaggagtgcagagctgtggtgattgctgggggcaccatgcagcctgtgtctgacttccggcagcagctgctggcctgtgccggcgtggaggccgagcgggtggtggagttcagctgtggccacgtgatccccccagacaacatcctgcccctggtgatctgcagcggcatcagcaaccagcccctggagttcaccttccagaagcgggagctgccccagatgatggatgaggtgggccgcatcctgtgcaacctgtgtggggtggtgcctgggggcgtggtgtgcttcttccccagctatgagtacctgcggcaggtgcacgcccactgggagaagggcggcctgctgggccgcctggccgccaggaagaagatcttccaggagcccaagagcgcccaccaggtggagcaggtgctgctggcctacagccgctgcatccaggcctgtggccaggagcggggccaggtgactggagccctgctgctgtctgtggtgggcggcaagatgtctgagggcatcaacttcagtgacaacctgggccgctgtgtggtgatggtgggcatgcccttccccaacatccgctctgctgagctgcaggagaagatggcctacctggaccagaccctgccccgggcccctggccaggcccctcctgggaaggccctggtggagaacctgtgcatgaaggctgtgaaccagagcatcggccgggccatccgccaccagaaggactttgcctctgtggtgctgctggaccagagatatgcccggccccctgtgctggccaagctgcctgcctggatccgggcccgggtggaggtgaaggccaccttcggccctgccatcgctgctgtgcagaagttccaccgggagaagagcgccagcagctag

SEQ ID NO: 3257 - DNA, 738 bp, Artificial Sequence
  Description of Artificial Sequence: Synthetic coding sequence
atgaagaagacccagacctggatcctgacctgcatctacctgcagctgctgctcttcaaccccctggtgaagacagagggcatctgcaggaacagagtgaccaacaacgtgaaggatgtgaccaagctggtggccaacctgcccaaggactacatgatcaccctgaagtatgtgcccggcatggatgtgctgcccagccactgctggatcagcgagatggtggtgcagctgagtgacagcctgacagacctgctggacaagttcagcaacatcagcgagggcctgagcaactacagcatcatcgacaagctggtgaacatcgtggatgacctggtggagtgtgtgaaggagaacagcagcaaggacctgaagaagagcttcaagagccctgagcccaggctcttcaccccagaggagttcttccgcatcttcaacagaagcattgatgccttcaaggactttgtggtggccagcgagaccagtgactgtgtggtgagcagcaccctgagccctgagaagggcaaggccaagaaccccccaggggacagcagcctgcactgggccgccatggccctgcctgccctcttcagcctcatcatcggctttgccttcggggccctgtactggaagaagaggcagcccagcctgaccagggctgtggagaacatccagatcaatgaggaggacaatgagatctccatgctgcaggagaaggagcgggagttccaggaggtgtag

SEQ ID NO: 3258 - DNA, 93 bp, Artificial Sequence
  Description of Artificial Sequence: Synthetic coding sequence
ggcatggatgtgctgggccggcccaagatccccctggagaccccagcctacacaggccagccctggcactgccagcactgcttcctgctgtag

SEQ ID NO: 3259 - DNA, 3039 bp, Artificial Sequence
  Description of Artificial Sequence: Synthetic coding sequence
atgcctgccagcgccccaccccggcggccccggcccccaccacccagcctgagcctgctgctggtgctgctgggcctgggcggccgccgcctgcgggcagagcctggagatggagcccagacctgggcccgcttcagccggcccccagcccctgaggccgccggcctcttccagggcaccttcccagatggcttcctgtgggccgtgggcagcgctgcctaccagacagagggcggctggcagcagcacggcaaaggagccagcatctgggacaccttcacccaccaccccctggcccctcctggggacagcagaaatgccagcctgcccctgggcgcccccagccccctgcagcctgccactggagatgtggccagtgacagctacaacaacgtgttccgggacacagaggccctgcgggagctgggcgtgacccactaccgcttcagcatctcctgggcccgggtgctgcccaatggatctgctggggtgcccaaccgggagggcctgcgctactaccgccgcctgctggagcggctgcgggagctgggcgtgcagcctgtggtgaccctgtaccactgggacctgccccagaggctgcaggatgcctacggcggctgggccaacagagccctggccgaccacttccgggactatgcagagctgtgcttccgccactttggaggccaggtgaagtactggatcaccatcgacaacccctacgtggtggcctggcacggctacgccaccggccgcctggcccctggcatccggggcagcccccggctgggctacctggtggcccacaacctgctgctggcccacgccaaggtgtggcacctgtacaacaccagcttccggcccacccagggcggccaggtgtccatcgccctgagcagccactggatcaaccccaggaggatgacagaccacagcatcaaggagtgccagaagagcctggactttgtgctgggctggtttgccaagcctgtgttcattgatggagactacccagagagcatgaagaacaacctgagcagcatcctgcctgacttcacagaaagtgagaagaagttcatcaagggcacagctgacttctttgccctgtgcttcggccccaccctgtccttccagctgctggacccccacatgaagttccggcagctggagagccccaacctgcggcagctgctgtcctggattgacctggagttcaaccacccccagatcttcatcgtggagaatggctggtttgtgtctggcaccaccaagagagatgatgccaagtacatgtactacctgaagaagttcatcatggagaccctgaaggccatcaagctggatggagtggatgtgattggctacacagcctggagcctgatggatggctttgagtggcaccggggctacagcatcagaagaggcctcttctacgtggacttcctgagccaggacaagatgctgctgcccaagagcagcgccctcttctaccagaagctgattgagaagaatggcttcccccccctgcctgagaaccagcccctggagggcaccttcccctgtgactttgcctggggcgtggtggacaactacatccaggtggacaccaccctgagccagttcacagacctgaatgtgtacctgtgggatgtgcaccacagcaagaggctcatcaaggtggatggagtggtgaccaagaagaggaagagctactgtgtggactttgctgccatccagccccagatcgccctgctgcaggagatgcacgtgacccacttccgcttcagcctggactgggccctgatcctgcccctgggcaaccagagccaggtgaaccacaccatcctgcagtactaccgctgcatggccagcgagctggtgcgggtgaacatcacccctgtggtggccctgtggcagcccatggcccccaaccagggcctgccccggctgctggcccggcagggcgcctgggagaacccctacacagccctggcctttgctgaatatgcccggctgtgcttccaggagctgggccaccacgtgaagctgtggatcaccatgaatgagccctacaccaggaacatgacctacagcgctggccacaacctgctgaaggcccacgccctggcctggcacgtgtacaatgagaagttcagacatgcccagaatggcaagatcagcatcgccctgcaggccgactggattgaaccagcctgccccttcagccagaaggacaaggaggtggccgagcgggtgctggagtttgatattggctggctggccgagcccatctttggaagtggggactacccctgggtgatgagggactggctgaaccagaggaacaacttcctgctgccctacttcacagaagatgagaagaagctgatccagggcacctttgacttcctggccctgagccactacaccaccatcctggtggacagcgagaaggaggaccccatcaagtacaatgactacctggaggtgcaggagatgacagacatcacctggctgaacagccccagccaggtggccgtggtgccctggggcctgaggaaggtgctgaactggctgaagttcaagtatggagacctgcccatgtacatcatcagcaatggaattgatgatggcctgcatgctgaagatgaccagctgcgggtgtactacatgcagaactacatcaatgaggccctgaaggcccacatcctggatggcatcaacctgtgtggctactttgcctacagcttcaatgacagaacagcccccaggtttggcctgtaccgctatgctgctgaccagtttgagcccaaggcctccatgaagcactacaggaagatcatcgacagcaatggcttccctggccctgagaccctggagcgcttctgcccagaggagttcaccgtgtgcacagagtgcagcttcttccacaccaggaagagcctgctggccttcatcgccttcctgttctttgccagcatcatcagcctgagcctcatcttctactacagcaagaagggccgccgcagctacaagtag

SEQ ID NO: 3260 - DNA, 729 bp, Artificial Sequence
  Description of Artificial Sequence: Synthetic coding sequence
atgacagaccacagcatcaaggagtgccagaagagcctggactttgtgctgggctggtttgccaagcctgtgttcattgatggagactacccagagagcatgaagaacaacctgagcagcatcctgcctgacttcacagagagcgagaagaagttcatcaagggcacagctgacttctttgccctgtgcttcggccccaccctgtccttccagctgctggacccccacatgaagttccggcagctggagagccccaacctgcggcagctgctgtcctggattgacctggagttcaaccacccccagatcttcatcgtggagaatggctggtttgtgtctggcaccaccaagagagatgatgccaagtacatgtactacctgaagaagttcatcatggagaccctgaaggccatcaagctggatggagtggatgtgattggctacacagcctggagcctgatggatggctttgagtggcaccggggctacagcatccggcggggcctcttctacgtggacttcctgagccaggacaagatgctgctgcccaagagcagcgccctcttctaccagaagctgattgagaagaatggcttcccccccctgcctgagaaccagcccctggagggcaccttcccctgtgactttgcctggggcgtggtggacaactacatccaggtgtcccagctgaccaagcccatcagcagcctgaccaagccctaccactag

SEQ ID NO: 3261 - DNA, 1440 bp, Artificial Sequence
  Description of Artificial Sequence: Synthetic coding sequence
atgaggcagcccccaggagagagtgacatggctgtgtctgatgccctgctgcccagcttcagcacctttgccagcggccctgctggccgggagaagaccctgcggcaggccggggcccccaacaaccgctggagggaggagctgagccacatgaagaggctgccccctgtgctgcccggccggccctatgacctggccgccgccaccgtggccacagacctggagagcggcggggccggggccgcctgtggcggcagcaacctggcccccctgccccggcgggagacagaggagttcaatgacctgctggacctggacttcatcctgagcaacagcctgacccaccccccagagagcgtggccgccaccgtgagcagcagcgccagcgccagcagcagcagcagccccagcagcagcggccctgccagcgcccccagcacctgcagcttcacctaccccatccgggctggaaatgaccccggggtggcccctgggggcactggaggcggcctgctgtatggccgggagagcgcccccccacccacagcccccttcaacctggccgacatcaatgatgtgagccccagcggcggctttgtggccgagctgctgcggcctgagctggaccctgtgtacatccccccccagcagccccagcccccaggcggcggcctgatgggcaagtttgtgctgaaggccagcctgagcgcccctggctctgaatatggcagccccagcgtcatctctgtgtccaagggcagcccagatggcagccaccctgtggtggtggccccctacaatggaggcccccccaggacctgccccaagatcaagcaggaggccgtgagcagctgcacccacctgggcgccggcccccccctgagcaatggccacaggcctgctgcccatgacttccccctgggccggcagctgcccagcaggaccacccccaccctgggcctggaggaggtgctgagcagccgggactgccacccagccctgcccctgcccccaggcttccacccccaccctggccccaactaccccagcttcctgcctgaccagatgcagccccaggtgccccccctgcactaccaggagctgatgcctcctggcagctgcatgcctgaggagcccaagcccaagagaggaagaagatcctggcccaggaagaggacagccacccacacctgtgactatgccggctgcggcaagacctacaccaagagcagccacctgaaggcccacctgcggacccacactggagagaagccctaccactgtgactgggatggctgcggctggaagtttgcccggagtgatgagctgaccaggcactacaggaagcacacaggccaccggcccttccagtgccagaagtgtgaccgggccttcagcagaagtgaccacctggccctgcacatgaagaggcacttctag

SEQ ID NO: 3262 - DNA, 699 bp, Artificial Sequence
  Description of Artificial Sequence: Synthetic coding sequence
atggctgtgtctgatgccctgctgcccagcttcagcacctttgccagcggccctgctggccgggagaagaccctgcggcaggccggggcccccaacaaccgctggagggaggagctgagccacatgaagaggctgccccctgtgctgcccggccggccctatgacctggccgccgccaccgtggccacagacctggagagcggcggggccggggccgcctgtggcggcagcaacctggcccccctgccccggcgggagacagaggagttcaatgacctgctggacctggacttcatcctgagcaacagcctgacccaccccccagagagcgtggccgccaccgtgagcagcagcgccagcgccagcagcagcagcagccccagcagcagcggccctgccagcgcccccagcacctgcagcttcacctaccccatccgggctggaaatgaccccggggtggcccctgggggcaccggcggcggcctgctgtatggccgggagagcgcccccccacccacagcccccttcaacctggccgacatcaatgatgtgagccccagcggcggctttgtggccgagctgctgcggcctgagctggaccctgtgtacatccccccccagcagccccagcccccaggcggcggcctgatgggcaagtttgtgctgaaggccagcctgagcgcccctggcagcgagtag

SEQ ID NO: 3263 - DNA, 69 bp, Artificial Sequence
  Description of Artificial Sequence: Synthetic coding sequence
atgaggcagcccccaggagagagtgacatggctgtgtctgatgccctgctgcccagcttcagcacctag

SEQ ID NO: 3264 - DNA, 117 bp, Artificial Sequence
  Description of Artificial Sequence: Synthetic coding sequence
atgaggcagcccccaggagagagtgacatggctgtgtctgatgccctgctgcccagcttcagcacctttgccagcggccctgctggccgggagaagaccctgcggcaggccggctag

SEQ ID NO: 3265 - DNA, 1323 bp, Artificial Sequence
  Description of Artificial Sequence: Synthetic coding sequence
atgggccccccaggcagcccctggcagtgggtgaccctgctgctgggcctgctgctgcccccagctgcccccttctggctgctgaatgtgctcttccccccccacaccacccccaaggccgagctgagcaaccacaccaggcctgtgatcctggtgcccggctgcctgggcaaccagctggaggccaagctggacaagccagatgtggtgaactggatgtgctacaggaagacagaggacttcttcaccatctggctggacctgaacatgttcctgcccctgggcgtggactgctggattgacaacaccagggtggtgtacaacagaagcagcggcctggtgtccaatgcccctggggtgcagatccgggtgcccggctttgggaagacctacagcgtggagtacctggacagcagcaagctggccggctacctgcacaccctggtgcagaacctggtgaacaacggctacgtgagagatgagaccgtgcgggccgccccctatgactggaggctggagcccggccagcaggaggagtactacaggaagctggccggcctggtggaggagatgcatgctgcctacggcaagcctgtgttcctgattggccacagcctgggctgcctgcacctgctgtacttcctgctgcggcagccccaggcctggaaggaccgcttcattgatggcttcatcagcctgggcgccccctggggcggcagcatcaagcccatgctggtgctggccagcggggacaaccagggcatccccatcatgagcagcatcaagctgaaggaggagcagaggatcaccaccaccagcccctggatgttccccagcaggatggcctggccagaagatcatgtgttcatcagcacccccagcttcaactacacaggccgggacttccagcgcttctttgctgacctgcactttgaggagggctggtacatgtggctgcagagccgggacctgctggccggcctgcctgcccctggggtggaggtgtactgcctgtatggagtgggcctgcccacccccaggacctacatctatgaccacggcttcccctacacagatcctgtgggcgtgctgtatgaagatggagatgacacagtggccaccaggagcacagagctgtgtggcctgtggcagggccggcagccccagcctgtgcacctgctgcccctgcacggcatccagcacctgaacatggtgttcagcaacctgaccctggagcacatcaatgccatcctgctgggcgcctaccggcagggccccccagccagccccacagccagccctgagcccccacctcctgagtag

SEQ ID NO: 3266 - DNA, 753 bp, Artificial Sequence
  Description of Artificial Sequence: Synthetic coding sequence
atggctgacaacttcagcctgcatgatgccctgagcggcagcggcaaccccaacccccagggctggccaggggcctggggcaaccagcctgctggagctgggggctacccaggggccagctacccaggggcctacccaggccaggcccctcctggggcctacccaggccaggcccctcctggggcctacccaggggcccctggggcctacccaggggccccagcccctggggtgtacccaggcccccccagcggccctggggcctaccccagcagcggccagcccagcgccaccggggcctacccagccaccggcccctatggagccccagctggccccctgattgtgccctacaacctgcccctgcctggaggagtggtgcccaggatgctgatcaccatcctgggcaccgtgaagcccaatgccaacagaattgccctggacttccagagaggaaatgatgtggccttccacttcaacccccgcttcaatgaaaacaacagaagagtgattgtgtgcaacaccaagctggacaacaactggggccgggaggagcggcagagcgtcttcccctttgagagcggcaagcccttcaagatccaggtgctggtggagccagaccacttcaaggtggccgtgaatgatgcccacctgctgcagtacaaccaccgggtgaagaagctgaatgagatcagcaagctgggcatcagcggggacatcgacctgaccagcgccagctacaccatgatctag

SEQ ID NO: 3267 - DNA, 630 bp, Artificial Sequence
  Description of Artificial Sequence: Synthetic coding sequence
atgggctctgtgagcaaccagcagtttgctgggggctgtgccaaggctgctgaggaggcccctgaggaggccccagaagatgctgcccgggcagcagatgagccccagctgctgcatggagctggcatctgcaagtggttcaacgtgaggatgggcttcggcttcctgtccatgacagcccgggccggcgtggccctggacccccctgtggatgtgtttgtgcaccagagcaagctgcacatggagggcttccgcagcctgaaggagggggaggccgtggagttcaccttcaagaagagcgccaagggcctggagagcatccgggtgacaggccctgggggcgtcttctgcatcggcagcgagcggcggcccaagggcaagtccatgcagaagaggaggagcaaaggagaccgctgctacaactgtggcggcctggaccaccacgccaaggagtgcaagctgcccccccagcccaagaagtgccacttctgccagagcatcagccacatggtggccagctgccccctgaaggcccagcagggccccagcgcccagggcaagcccacctacttccgggaggaggaggaggagatccacagccccaccctgctgcctgaggcccagaactag

SEQ ID NO: 3268 - DNA, 630 bp, Artificial Sequence; identical to SEQ ID NO: 3267
  Description of Artificial Sequence: Synthetic coding sequence

SEQ ID NO: 3269 - DNA, 660 bp, Artificial Sequence
  Description of Artificial Sequence: Synthetic coding sequence
atgaagatgaggttcctgggcctggtggtgtgcctggtgctgtggaccctgcacagcgagggcagcggcggcaagctgacagctgtggaccctgagaccaacatgaatgtgtctgagatcatctcctactggggcttccccagcgaggagtacctggtggagacagaagatggctacatcctgtgcctgaaccgcatcccccacggcaggaagaaccacagcgacaagggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacaagaccctgtctgtgtcccaggatgagttctgggccttctcctatgatgagatggccaagtatgacctgcctgccagcatcaacttcatcctgaacaagacaggccaggagcaggtgtactacgtgggccacagccagggcaccaccatcggcttcatcgccttcagccagatccctgagctggccaagaggatcaagatgttctttgccctgggccctgtggcctctgtggccttctgcaccagccccatggccaagctgggccgcctgtag

SEQ ID NO: 3270 - DNA, 1200 bp, Artificial Sequence
  Description of Artificial Sequence: Synthetic coding sequence
atgaagatgaggttcctgggcctggtggtgtgcctggtgctgtggaccctgcacagcgagggcagcggcggcaagctgacagctgtggaccctgagaccaacatgaatgtgtctgagatcatctcctactggggcttccccagcgaggagtacctggtggagacagaagatggctacatcctgtgcctgaaccgcatcccccacggcaggaagaaccacagcgacaagggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacaagaccctgtctgtgtcccaggatgagttctgggccttctcctatgatgagatggccaagtatgacctgcctgccagcatcaacttcatcctgaacaagacaggccaggagcaggtgtactacgtgggccacagccagggcaccaccatcggcttcatcgccttcagccagatccctgagctggccaagaggatcaagatgttctttgccctgggccctgtggcctctgtggccttctgcaccagccccatggccaagctgggccgcctgcctgaccacctgatcaaggacctgtttggagacaaggagttcctgccccagagcgccttcctgaagtggctgggcacccacgtgtgcacccacgtgatcctgaaggagctgtgtggcaacctgtgcttcctgctgtgtggcttcaatgaaagaaacctgaacatgagccgggtggatgtgtacaccacccacagccctgctggcacctctgtgcagaacatgctgcactggagccaggccgtgaagttccagaagttccaggcctttgactggggcagcagcgccaagaactacttccactacaaccagagctacccacccacctacaacgtgaaggacatgctggtgcccacagctgtgtggagcggcggccatgactggctggctgatgtgtatgatgtgaacatcctgctgacccagatcaccaacctggtgttccacgagagcatccctgagtgggagcacctggacttcatctggggcctggatgccccctggaggctgtacaacaagatcatcaacctgatgaggaagtaccagtag

SEQ ID NO: 3271 - DNA, 1074 bp, Artificial Sequence
  Description of Artificial Sequence: Synthetic coding sequence
atgaagctgcggaccctggccgtgtctgccaccgtggtgaaggatggagtgtctggagtgtgcagcttccgctgcagtgatgtgtctggagtgctgcccagcggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacaagaccctgtctgtgtcccaggatgagttctgggccttctcctatgatgagatggccaagtatgacctgcctgccagcatcaacttcatcctgaacaagacaggccaggagcaggtgtactacgtgggccacagccagggcaccaccatcggcttcatcgccttcagccagatccctgagctggccaagaggatcaagatgttctttgccctgggccctgtggcctctgtggccttctgcaccagccccatggccaagctgggccgcctgcctgaccacctgatcaaggacctgtttggagacaaggagttcctgccccagagcgccttcctgaagtggctgggcacccacgtgtgcacccacgtgatcctgaaggagctgtgtggcaacctgtgcttcctgctgtgtggcttcaatgaaagaaacctgaacatgagccgggtggatgtgtacaccacccacagccctgctggcacctctgtgcagaacatgctgcactggagccaggccgtgaagttccagaagttccaggcctttgactggggcagcagcgccaagaactacttccactacaaccagagctacccacccacctacaacgtgaaggacatgctggtgcccacagctgtgtggagcggcggccatgactggctggctgatgtgtatgatgtgaacatcctgctgacccagatcaccaacctggtgttccacgagagcatccctgagtgggagcacctggacttcatctggggcctggatgccccctggaggctgtacaacaagatcatcaacctgatgaggaagtaccagtag

SEQ ID NO: 3272 - DNA, 1200 bp, Artificial Sequence; identical to SEQ ID NO: 3270
  Description of Artificial Sequence: Synthetic coding sequence

SEQ ID NO: 3273 - DNA, 1032 bp, Artificial Sequence
  Description of Artificial Sequence: Synthetic coding sequence
atggcctgcctggagtttgtgccctttgatgtgcagatgtgcctggagttcctgcccagcggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacaagaccctgtctgtgtcccaggatgagttctgggccttctcctatgatgagatggccaagtatgacctgcctgccagcatcaacttcatcctgaacaagacaggccaggagcaggtgtactacgtgggccacagccagggcaccaccatcggcttcatcgccttcagccagatccctgagctggccaagaggatcaagatgttctttgccctgggccctgtggcctctgtggccttctgcaccagccccatggccaagctgggccgcctgcctgaccacctgatcaaggacctgtttggagacaaggagttcctgccccagagcgccttcctgaagtggctgggcacccacgtgtgcacccacgtgatcctgaaggagctgtgtggcaacctgtgcttcctgctgtgtggcttcaatgaaagaaacctgaacatgagccgggtggatgtgtacaccacccacagccctgctggcacctctgtgcagaacatgctgcactggagccaggccgtgaagttccagaagttccaggcctttgactggggcagcagcgccaagaactacttccactacaaccagagctacccacccacctacaacgtgaaggacatgctggtgcccacagctgtgtggagcggcggccatgactggctggctgatgtgtatgatgtgaacatcctgctgacccagatcaccaacctggtgttccacgagagcatccctgagtgggagcacctggacttcatctggggcctggatgccccctggaggctgtacaacaagatcatcaacctgatgaggaagtaccagtag

SEQ ID NO: 3274 - DNA, 1206 bp, Artificial Sequence
  Description of Artificial Sequence: Synthetic coding sequence
atggcctgcctggagtttgtgccctttgatgtgcagatgtgcctggagttcctgcccagcggggagtttgtggtgctgctgaccagcggcgtgcagctgcagaccttcaccgtgtctgtgacagacctgaagggcggggccagcggcgtggtgcgcagcagccgctgggtgcggggcttcacagacttccgcagcaaggctgtggacctgtgtggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacaagaccctgtctgtgtcccaggatgagttctgggccttccgggtgcccttcctggactacagctatgatgagatggccaagtatgacctgcctgccagcatcaacttcatcctgaacaagacaggccaggagcaggtgtactacgtgggccacagccagggcaccaccatcggcttcatcgccttcagccagatccctgagctggccaagaggatcaagatgttctttgccctgggccctgtggcctctgtggccttctgcaccagccccatggccaagctgggccgcctgcctgaccacctgatcaaggacctgtttggagacaaggagttcctgccccagagcgccttcctgaagtggctgggcacccacgtgtgcacccacgtgatcctgaaggagctgtgtggcaacctgtgcttcctgctgtgtggcttcaatgaaagaaacctgaacatgagccgggtggatgtgtacaccacccacagccctgctggcacctctgtgcagaacatgctgcactggagccaggccgtgaagttccagaagttccaggcctttgactggggcagcagcgccaagaactacttccactacaaccagagctacccacccacctacaacgtgaaggacatgctggtgcccacagctgtgtggagcggcggccatgactggctggctgatgtgtatgatgtgaacatcctgctgacccagatcaccaacctggtgttccacgagagcatccctgagtgggagcacctggacttcatctggggcctggatgccccctggaggctgtacaacaagatcatcaacctgatgaggaagtaccagtag

SEQ ID NO: 3275 - DNA, 873 bp, Artificial Sequence
  Description of Artificial Sequence: Synthetic coding sequence
atgaagatgaggttcctgggcctggtggtgtgcctggtgctgtggaccctgcacagcgagggcagcggcggcaagctgacagctgtggaccctgagaccaacatgaatgtgtctgagatcatctcctactggggcttccccagcgaggagtacctggtggagacagaagatggctacatcctgtgcctgaaccgcatcccccacggcaggaagaaccacagcgacaagggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacaagaccctgtctgtgtcccaggatgagttctgggccttctcctatgatgagatggccaagtatgacctgcctgccagcatcaacttcatcctgaacaagacaggccaggagcaggtgtactacgtgggccacagccagggcaccaccatcggcttcatcgccttcagccagatccctgagctggccaagaggatcaagatgttctttgccctgggccctgtggcctctgtggccttctgcaccagccccatggccaagctgggccgcctgcctgaccacctgatcaaggacctgtttggagacaaggagttcctgccccagagcgccttcctgaagtggctgggcacccacgtgtgcacccacgtgatcctgaaggagctgtgtggcaacctgtgcttcctgctgtgtggcttcaatgaaagaaacctgaacatgagccgggtggatgtgtacaccacccacagccctgctggcacctctgtgtag

SEQ ID NO: 3276 - DNA, 1200 bp, Artificial Sequence; identical to SEQ ID NO: 3270
  Description of Artificial Sequence: Synthetic coding sequence

SEQ ID NO: 3277 - DNA, 87 bp, Artificial Sequence
  Description of Artificial Sequence: Synthetic coding sequence
ctctgcttcctgctgtgtggcttcaatgaaagaaacctgaacatggctgtgaagttccagaagttccaggcctttgactggggctag

SEQ ID NO: 3278 - DNA, 1200 bp, Artificial Sequence; identical to SEQ ID NO: 3270
  Description of Artificial Sequence: Synthetic coding sequence

SEQ ID NO: 3279 - DNA, 411 bp, Artificial Sequence
  Description of Artificial Sequence: Synthetic coding sequence
atgaagatgaggttcctgggcctggtggtgtgcctggtgctgtggaccctgcacagcgagggcagcggcggcaagctgacagctgtggaccctgagaccaacatgaatgtgtctgagatcatctcctactggggcttccccagcgaggagtacctggtggagacagaagatggctacatcctgtgcctgaaccgcatcccccacggcaggaagaaccacagcgacaagggccccaagcctgtggtgttcctgcagcacggcctgctggccgacagcagcaactgggtgaccaacctggccaacagcagcctgggcttcatcctggctgatgctggctttgatgtgtggatgggcaacagccggggcaacacctggagcaggaagcacgtgaccctggagcccggctgctag

SEQ ID NO: 3280 - DNA, 1428 bp, Artificial Sequence
  Description of Artificial Sequence: Synthetic coding sequence
atggagagcaaggccctgctggtgctgaccctggccgtgtggctgcagagcctgacagccagcagaggaggagtggccgctgctgaccagaggcgggacttcattgatattgagagcaagtttgccctgcggaccccagaggacacagctgaggacacctgccacctgatccctggggtggccgagagcgtggccacctgccacttcaaccacagcagcaagaccttcatggtgatccacggctggacagtgacaggcatgtatgagagctgggtgcccaagctggtggccgccctgtacaagcgggagccagacagcaatgtgattgtggtggactggctgagccgggcccaggagcactaccctgtgtctgctggctacaccaagctggtgggccaggatgtggcccgcttcatcaactggatggaggaggagttcaactaccccctggacaacgtgcacctgctgggctacagcctgggcgcccacgccgccggcattgctggcagcctgaccaacaagaaggtgaaccgcatcaccggcctggaccctgctggccccaactttgaatatgcagaggcccccagccggctgagcccagatgatgctgactttgtggatgtgctgcacaccttcacccggggcagccctggccgcagcatcggcatccagaagcctgtgggccacgtggacatctacccaaatggaggcaccttccagcccggctgcaacattggagaggccatccgggtgattgctgagcggggcctgggagatgtggaccagctggtgaagtgcagccatgagaggagcatccacctgttcatcgacagcctgctgaatgaggagaaccccagcaaggcctaccgctgcagcagcaaggaggcctttgagaagggcctgtgcctgagctgcaggaagaaccgctgcaacaacctgggctatgagatcaacaaggtgcgggccaagaggagcagcaagatgtacctgaagaccaggagccagatgccctacaaggtgttccactaccaggtgaagatccacttcagcggcacagagagcgagacccacaccaaccaggcctttgagatcagcctgtatggaacagtggccgagagcgagaacatccccttcaccctgcctgaggtgtccaccaacaagacctacagcttcctgatctacacagaggtggacattggagagctgctgatgctgaagctgaagtggaagagtgacagctacttctcctggagcgactggtggagcagccctggctttgccatccagaagatccgggtgaaggccggggagacccagaagaaggtgatcttctgcagccgggagaaggtgagccacctgcagaagggcaaggccccagctgtgtttgtgaagtgccacgacaagagcctgaacaagaagagcggctag

SEQ ID NO: 3281 - DNA, 348 bp, Artificial Sequence
  Description of Artificial Sequence: Synthetic coding sequence
atggtgatccacggctggacagtgacaggcatgtatgagagctgggtgcccaagctggtggccgccctgtacaagcgggagccagacagcaatgtgattgtggtggactggctgagccgggcccaggagcactaccctgtgtctgctggctacaccaagctggtgggccaggatgtggcccgcttcatcaactggatggaggaggagttcaactaccccctggacaacgtgcacctgctgggctacagcctgggcgcccacgccgccggcattgctggcagcctgaccaacaagaaggtgaaccgcatcaccggcctggaccctgctggccccaactttgagtactag

SEQ ID NO: 3282 - DNA, 321 bp, Artificial Sequence
  Description of Artificial Sequence: Synthetic coding sequence
atggagagcaaggccctgctggtgctgaccctggccgtgtggctgcagagcctgacagccagcagaggaggagtggccgctgctgaccagaggcgggacttcattgatattgagagcaagtttgccctgcggaccccagaggacacagctgaggacacctgccacctgatccctggggtggccgagagcgtggccacctgccacttcaaccacagcagcaagaccttcatggtgatccacggctggacagtgacaggcatgtatgagagctgggtgcccaagctggtggccgccctgtacaagcgggagccagacagctag

SEQ ID NO: 3283 - DNA, 393 bp, Artificial Sequence
  Description of Artificial Sequence: Synthetic coding sequence
atggagagcaaggccctgctggtgctgaccctggccgtgtggctgcagagcctgacagccagcagaggaggagtggccgctgctgaccagaggcgggacttcattgatattgagagcaagtttgccctgcggaccccagaggacacagctgaggacacctgccacctgatccctggggtggccgagagcgtggccacctgccacttcaaccacagcagcaagaccttcatggtgatccacggctggacagtgacaggcatgtatgagagctgggtgcccaagctggtggccgccctgtacaagcgggagccagacagcaatgtgattgtggtggactggctgagccgggcccaggagcactaccctgtgtctgctggctacaccaagctgtag

SEQ ID NO: 3284 - DNA, 1386 bp, Artificial Sequence
  Description of Artificial Sequence: Synthetic coding sequence
atggagagcaaggccctgctggtgctgaccctggccgctgctgaccagaggcgggacttcattgatattgagagcaagtttgccctgcggaccccagaggacacagctgaggacacctgccacctgatccctggggtggccgagagcgtggccacctgccacttcaaccacagcagcaagaccttcatggtgatccacggctggacagtgacaggcatgtatgagagctgggtgcccaagctggtggccgccctgtacaagcgggagccagacagcaatgtgattgtggtggactggctgagccgggcccaggagcactaccctgtgtctgctggctacaccaagctggtgggccaggatgtggcccgcttcatcaactggatggaggaggagttcaactaccccctggacaacgtgcacctgctgggctacagcctgggcgcccacgccgccggcattgctggcagcctgaccaacaagaaggtgaaccgcatcaccggcctggaccctgctggccccaactttgaatatgcagaggcccccagccggctgagcccagatgatgctgactttgtggatgtgctgcacaccttcacccggggcagccctggccgcagcatcggcatccagaagcctgtgggccacgtggacatctacccaaatggaggcaccttccagcccggctgcaacattggagaggccatccgggtgattgctgagcggggcctgggagatgtggaccagctggtgaagtgcagccatgagaggagcatccacctgttcatcgacagcctgctgaatgaggagaaccccagcaaggcctaccgctgcagcagcaaggaggcctttgagaagggcctgtgcctgagctgcaggaagaaccgctgcaacaacctgggctatgagatcaacaaggtgcgggccaagaggagcagcaagatgtacctgaagaccaggagccagatgccctacaaggtgttccactaccaggtgaagatccacttcagcggcacagagagcgagacccacaccaaccaggcctttgagatcagcctgtatggaacagtggccgagagcgagaacatccccttcaccctgcctgaggtgtccaccaacaagacctacagcttcctgatctacacagaggtggacattggagagctgctgatgctgaagctgaagtggaagagtgacagctacttctcctggagcgactggtggagcagccctggctttgccatccagaagatccgggtgaaggccggggagacccagaagaaggtgatcttctgcagccgggagaaggtgagccacctgcagaagggcaaggccccagctgtgtttgtgaagtgccacgacaagagcctgaacaagaagagcggctag

SEQ ID NO: 3285 - DNA, 828 bp, Artificial Sequence
  Description of Artificial Sequence: Synthetic coding sequence
atggtgatccacggctggacagtgacaggcatgtatgagagctgggtgcccaagctggtggccgccctgtacaagcgggagccagacagcaatgtgattgtggtggactggctgagccgggcccaggagcactaccctgtgtctgctggctacaccaagctggtgggccaggatgtggcccgcttcatcaactggatggaggaggagttcaactaccccctggacaacgtgcacctgctgggctacagcctgggcgcccacgccgccggcattgctggcagcctgaccaacaagaaggtgaaccgcatcaccggcctggaccctgctggccccaactttgaatatgcagaggcccccagccggctgagcccagatgatgctgactttgtggatgtgctgcacaccttcacccggggcagccctggccgcagcatcggcatccagaagcctgtgggccacgtggacatctacccaaatggaggcaccttccagcccggctgcaacattggagaggccatccgggtgattgctgagcggggcctgggagatgtggaccagctggtgaagtgcagccatgagaggagcatccacctgttcatcgacagcctgctgaatgaggagaaccccagcaaggcctaccgctgcagcagcaaggaggcctttgagaagggcctgtgcctgagctgcaggaagaaccgctgcaacaacctgggctatgagatcaacaaggtgcgggccaagaggagcagcaagatgtatgaggacagcttcagtgatgccctgcagagcctgcccctgcccagcaaggacagcttcttctgggactag

SEQ ID NO: 3286 - DNA, 2079 bp, Artificial Sequence
  Description of Artificial Sequence: Synthetic coding sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcctgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaacggcggctgcagccacgtgtgcaatgacctgaagattggctatgaatgtctgtgcccagatggcttccagctggtggcccagaggcgctgtgaagatattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccacggcgtgagcagctatgacaccgtcatcagccgggacatccaggccccagatggcctggccgtggactggatccacagcaacatctactggacagattctgtgctgggcaccgtgtctgtggccgacaccaagggcgtgaagaggaagaccctcttccgggagaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgactggaagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaagctgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 3287 - DNA, 2460 bp, Artificial Sequence
  Description of Artificial Sequence: Synthetic coding sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcagccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgtctggagagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 3288 - DNA, 2049 bp, Artificial Sequence
  Description of Artificial Sequence: Synthetic coding sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgccctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccgggaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 3289 - DNA, 2577 bp, Artificial Sequence
  Description of Artificial Sequence: Synthetic coding sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcccccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgagcggggagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaacggcggctgcagccacgtgtgcaatgacctgaagattggctatgaatgtctgtgcccagatggcttccagctggtggcccagaggcgctgtgaagatattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccacggcgtgagcagctatgacaccgtcatcagccgggacatccaggccccagatggcctggccgtggactggatccacagcaacatctactggacagattctgtgctgggcaccgtgtctgtggccgacaccaagggcgtgaagaggaagaccctcttccgggagaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgactggaagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaagctgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagcatggtgtccctggaggatgatgtggcctag

SEQ ID NO: 3290 - DNA, 2583 bp, Artificial Sequence
  Description of Artificial Sequence: Synthetic coding sequence
atgggcccctggggctggaagctgcgctggacagtggccctgctgctggccgctgctggaacagctgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcccccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgagcggggagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaacggcggctgcagccacgtgtgcaatgacctgaagattggctatgaatgtctgtgcccagatggcttccagctggtggcccagaggcgctgtgaagatattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccacggcgtgagcagctatgacaccgtcatcagccgggacatccaggccccagatggcctggccgtggactggatccacagcaacatctactggacagattctgtgctgggcaccgtgtctgtggccgacaccaagggcgtgaagaggaagaccctcttccgggagaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgactggaagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaagctgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 3291 - DNA, 2220 bp, Artificial Sequence
  Description of Artificial Sequence: Synthetic coding sequence
atgggcccctggggctggaagctgcgctggacagtggccctgctgctggccgctgctggaacagctgtgggggacagatgtgaaagaaatgacttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgtctggagagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 3292 - DNA, 2838 bp, Artificial Sequence
  Description of Artificial Sequence: Synthetic coding sequence
tgaggaagacctggggtgcccccacgcttcctgagccagaggcggcggcaggtgcccggccccaggagccggctgcgggacatccacgagagccccagcgtcatcctgggccccccaggagaggtgcccggcttccgctgtgccctgtggaggcacctgcggccccacctggtgctgggcggggccctggcccccccagcccccatcaagttcacagagggccccccagccaccctgaaggcctctgtgccctatgaggtggagaccctgccccagaacctgcctgccccaccctggagcgctgctgagatcttcagccacgtgggggacagatgtgaaagaaatgagttccagtgccaggacggcaagtgcatctcctacaagtgggtgtgtgatggcagcgctgagtgccaggacggcagtgatgagagccaggagacctgcctgtctgtgacctgcaagagcggggacttcagctgtggcggccgggtgaaccgctgcatcccccagttctggaggtgtgatggccaggtggactgtgacaatggaagtgatgagcagggctgcccccccaagacctgcagccaggatgagttccgctgccatgatggcaagtgcatcagccggcagtttgtgtgtgacagcgaccgggactgcctggatggcagtgatgaggccagctgccctgtgctgacctgtggccctgccagcttccagtgcaacagcagcacctgcatcccccagctgtgggcctgtgacaatgaccctgactgtgaagatggcagtgatgagtggccccagcgctgccggggcctgtatgtgttccagggcgacagcagcccctgcagcgcctttgagttccactgcctgtctggagagtgcatccacagctcctggaggtgtgatggcggccctgactgcaaggacaagagtgatgaggagaactgtgctgtggccacctgcaggccagatgagttccagtgcagtgatggcaactgcatccacggcagccggcagtgtgaccgggagtatgactgcaaggacatgtctgatgaggtgggctgtgtgaatgtgaccctgtgtgagggccccaacaagttcaagtgccacagcggggagtgcatcaccctggacaaggtgtgcaacatggcccgggactgccgggactggagcgatgagcccatcaaggaatgtggcaccaatgaatgtctggacaacaatggaggctgcagccacgtgtgcaatgacctgaagattggctatgagtgcctgtgcccagatggcttccagctggtggcccagaggcgctgtgaggacattgatgagtgccaggaccctgacacctgcagccagctgtgtgtgaacctggagggcggctacaagtgccagtgtgaggagggcttccagctggacccccacaccaaggcctgcaaggctgtgggcagcatcgcctacctgttcttcaccaacagacatgaggtgaggaagatgaccctggacagaagtgagtacaccagcctcatccccaacctgagaaatgtggtggccctggacacagaggtggccagcaaccgcatctactggagcgacctgagccagaggatgatctgcagcacccagctggaccgggcccatggagtgtcctcctatgacaccgtcatcagccgggacatccaggccccagatggcctggccgtggactggatccacagcaacatctactggacagacagcgtgctgggcaccgtgtctgtggccgacaccaagggcgtgaagaggaagaccctcttcagagaaaatggcagcaagccccgggccatcgtggtggaccctgtgcacggcttcatgtactggacagactggggcaccccagccaagatcaagaagggcggcctgaatggagtggacatctacagcctggtgacagagaacatccagtggcccaacggcatcaccctggacctgctgagcggccgcctgtactgggtggacagcaagctgcacagcatcagcagcattgatgtgaatggaggcaacaggaagaccatcctggaggatgagaagaggctggcccaccccttcagcctggccgtgtttgaggacaaggtgttctggacagacatcatcaatgaggccatcttcagcgccaaccggctgaccggcagtgatgtgaacctgctggccgagaacctgctgagccctgaggacatggtgctcttccacaacctgacccagccccggggcgtgaactggtgtgagaggaccaccctgagcaatggaggctgccagtacctgtgcctgcctgccccccagatcaacccccacagccccaagttcacctgtgcctgcccagatggcatgctgctggcccgggacatgaggagctgcctgacagaggccgaggccgctgtggccacccaggagaccagcacagtgcggctgaaggtgagcagcacagctgtgaggacccagcacaccaccaccaggcctgtgcctgacaccagccggctgcccggggccaccccaggcctgaccaccgtggagatcgtgaccatgagccaccaggccctgggagatgtggccggcagaggaaatgagaagaagcccagctctgtgcgggccctgagcatcgtgctgcccatcgtgctgctggtgttcctgtgcctgggcgtcttcctgctgtggaagaactggaggctgaagaacatcaacagcatcaactttgacaaccctgtgtaccagaagaccacagaagatgaggtgcacatctgccacaaccaggacggctacagctaccccagccggcagatggtgtccctggaggatgatgtggcctag

SEQ ID NO: 3293 - DNA, 1770 bp, Artificial Sequence
  Description of Artificial Sequence: Synthetic coding sequence
atgagccggcggctgctgcccagggctgagaagagaagaagaaggctggagcagaggcagcagccagatgagcagaggagaagaagtggggccatggtgaagatggctgctgctgggggcggcggcggcggcggccgctactacggcggcggcagcgagggcggccgggcccccaagaggctgaagacagacaatgctggggaccagcacggcggcggcggcggcggcggcggcggggccggggctgctgggggcggcggcggcggggagaactatgatgacccccacaagaccccagccagccctgtggtgcacatccggggcctgattgatggagtggtggaggccgacctggtggaggccctgcaggagtttggccccatctcctatgtggtggtgatgcccaagaagaggcaggccctggtggagtttgaagatgtgctgggcgcctgcaatgctgtgaactatgctgctgacaaccagatctacatcgccggccacccagcctttgtgaactacagcaccagccagaagatcagcaggcctggggacagtgatgacagccgctctgtgaacagcgtgctgctcttcaccatcctgaaccccatctacagcatcaccacagatgtgctgtacaccatctgcaacccctgtggccctgtgcagagaattgtcatcttcaggaagaatggagtgcaggccatggtggagtttgacagcgtgcagagcgcccagagggccaaggccagcctgaatggagctgacatctacagcggctgctgcaccctgaagattgaatatgccaagcccacccggctgaatgtgttcaagaatgaccaggacacctgggactacaccaaccccaacctgagcggccagggcgaccccggcagcaaccccaacaagaggcagaggcagccccccctgctgggggaccacccagcagaatatggaggcccccatggaggctaccacagccactaccatgatgagggctacggccccccaccaccccactatgagggccgcaggatgggcccccctgtgggcggccacagaagaggccccagccgctatggcccccagtatggccaccccccacctcctcctcctcctccagaatatggcccccatgctgacagccctgtgctgatggtgtatggcctggaccagagcaagatgaactgtgacagagtcttcaacgtgttctgcctgtatggaaatgtggagaaggtgaagttcatgaagagcaagccaggagctgccatggtggagatggctgatggctatgctgtggaccgggccatcacccacctgaacaacaacttcatgtttggccagaagctgaatgtgtgtgtgtccaagcagcctgccatcatgcctggccagagctatggcctggaggatggcagctgcagctacaaggacttcagcgagagcaggaacaaccgcttcagcaccccagagcaggccgccaagaaccgcatccagcaccccagcaatgtgctgcacttcttcaatgcccccctggaggtgacagaggagaacttctttgagatctgtgatgagctgggcgtgaagaggcccagctctgtgaaggtgttcagcggcaagtctgagaggagcagcagcggcctgctggagtgggagagcaagagtgatgccctggagaccctgggcttcctgaaccactaccagatgaagaaccccaacggcccctacccctacaccctgaagctgtgcttcagcacagcccagcacgccagctag

SEQ ID NO: 3294 - DNA, 540 bp, Artificial Sequence
  Description of Artificial Sequence: Synthetic coding sequence
atgggccggcccggcctgggcgctgctgtgtctgacctgggggaggccgtgtccctgagccagggcctgctgctgctgctgctgctgtccatgggcggggcctgggccagccgggagcccctgcggccctggtgccaccccatcaatgccatcctggccgtggagaaggagggctgccctgtgtgcatcaccgtgaacaccaccatctgtgccggctactgccccaccatgatgagggtgctgcaggccgtgctgccccccctgccccaggtggtgtgcacctacagagatgtgcgctttgagagcatccggctgcccggctgcccccggggcgtggaccctgtggtgtccttccctgtggccctgagctgccgctgtggcccctgccgccgcagcaccagtgactgtggcggccccaaggaccaccccctgacctgtgaccacccccagcaggccagcagcagcagcaaggaccccccaagaagcctgcccagccccagccggctgctggagccagacacccccatcctgccccagtag

SEQ ID NO: 3295 - DNA, 294 bp, Artificial Sequence
  Description of Artificial Sequence: Synthetic coding sequence
atgcagctgggcaccggcctgctgctggccgctgtgctgagcctgcagctggccgctgctgaggccatctggtgccaccagtgcaccggctttggaggctgcagccacggcagccgctgcctgcgggacagcacccactgtgtgaccacagccaccagggtgctgagcaacacagaggacctgcccctggtgaccaagatgtgccacatcggctgcccagacatccccagcctgggcctgggcccctacgtgtccatcgcctgctgccagaccagcctgtgcaaccacgactag

SEQ ID NO: 3296 - DNA, 2058 bp, Artificial Sequence
  Description of Artificial Sequence: Synthetic coding sequence
atgcctgcctacacccacgccagccccatccacaacacccacaagccctatgagtgcaaggaatgtgggaagtacttcagctgtggcagcaacctgatccagcaccagagcatccacactggagagaagccctacaagtgcaaggaatgtgggaaggccttccagctgcacatccagctgaccaggcaccagaagttccacactggagagaagacctttgagtgcaaggaatgtgggaaggccttcaacctgcccacccagctgaacagacacaagaacatccacacagtgaagaagctgtttgagtgcaaggaatgtgggaagagcttcaacagaagcagcaacctgacccagcaccagagcatccacgccggcgtgaagccctaccagtgcaaggaatgtgggaaggccttcaacagaggcagcaacctgatccagcaccagaagatccacagcaatgagaagccctttgtgtgcagagaatgtgagatggccttccgctaccactaccagctgattgagcactgccgcatccacactggagagaagccctttgagtgcaaggaatgtaggaaggccttcaccctgctgaccaagctggtgcgccaccagaagatccacatgggagagaagccctttgagtgcagagaatgtgggaaggccttcagcctgctgaaccagctgaacagacacaagaacatccacactggagagaagccctttgagtgcaaggaatgtgggaagagcttcaacagaagcagcaacctgatccagcaccagagcatccacgcagatgtgaagccctatgagtgcaaggaatgtgggaagggcttcaacagaggagccaacctgatccagcaccagaagatccacagcaatgagaagccctttgtgtgcagagaatgtgagatggccttccgctaccactaccagctgatccagcactgccagatccacactggaggcaagccctttgagtgcaaggaatgtgggaaggccttcagcctgctgacccagctggcccggcacaagaacatccacactggagagaagccctttgagtgcaaggactgtgggaaggccttcaacagaggcagcaacctggtgcagcaccagagcatccacactggagagaagccctatgagtgcaaggaatgtgggaaggccttccggctgcacctgcagctgagccagcacgagaagacccacactggagagaagccctttgagtgcaaggaatgtgggaagttcttcagaagaggcagcaacctgaaccagcacaggagcatccacacaggcaagaagccctttgagtgcaaggaatgtgggaaggccttccggctgcacatgcacctgatccgccaccagaagttccacactggagagaagccctttgagtgcaaggaatgtgggaaggccttcagcctgcacacccagctgaaccaccacaagaacatccacactggagagaagcccttcaagtgcaaggaatgtgggaagagcttcaacagagtgagcaacctggtgcagcaccagagcatccacgccggcgtgaagccctatgagtgcaaggaatgtgggaagggcttcagccgggtgagcaacctgatccagcaccagaagacccacagcagcgccaagccctttgtgtgcaaggaatgtaggaagaccttccgctaccactaccagctgacagagcactaccgcatccacactggagagaagccctttgagtgcaaggaatgtgggaaggccttcggcctgctgacccagctggcccagcaccagatcatccacactggagagaagcccttcaagtgcaaggaatgtgggaaggccttcaacagaggcagcaacctggtgcagccccagagcatccacactggagagaagccctatgagtgcaaggaatgtgggaaggccttccggctgcacctgcagctgagcctgcaccagaagctggtgcaggtgaggaaccccctgaatgtgagaaatgtgggccagcccagcgacatcagcagcaacctgctgaacatcaggaagttcatcctgggctag

SEQ ID NO: 3297 - DNA, 564 bp, Artificial Sequence
  Description of Artificial Sequence: Synthetic coding sequence
tgaagaggaggaggagacagctatggagtgctgctgagcaatgccctggcccggctgcggggcttcaaggaccacttcaccttctgccagcagctgaacatcagcatctgccccctgagccagacagctgcccgcttccaggtgattgtgtacaaccccctgggcaggaaggtgaactggatggtgcggctgcctgtgtctgaaggagtgtttgtggtgaaggaccccaatggaagaacagtgcccagtgatgtggtgatcttccccagcagtgacagccaggcccaccccccagagctgctcttcagcgccagcctgcctgccctgggcttcagcacctacagcgtggcccaggtgccccgctggaagccccaggcccgggccccccagcccatcccccggcgctcctggagccctgccctgaccattgaaaatgagcacatccgggccacctttgatcctgacaccggcctgctgatggagatcatgaacatgaaccagcagctgctgctgcctgtgcggcagaccttcttctggtacaatgccagcatcggggacaactag

SEQ ID NO: 3298 - DNA, 3036 bp, Artificial Sequence
  Description of Artificial Sequence: Synthetic coding sequence
atgggcgcctatgcccgggccagcggcgtgtgtgcccggggctgcctggacagcgctggcccctggaccatgagccgggccctgcggccccccctgccccccctgtgcttcttcctgctgctgctggccgctgctggggcccgggccggcggctatgagacctgccccaccgtgcagcccaacatgctgaatgtgcacctgctgccccacacccatgatgatgtgggctggctgaagacagtggaccagtacttctacggcatcaagaatgacatccagcacgccggcgtgcagtacatcctggacagcgtcatcagcgccctgctggccgaccccacccggcgcttcatctacgtggagatcgccttcttcagccgctggtggcaccagcagaccaatgccacccaggaggtggtgcgggacctggtgcggcagggccgcctggagtttgccaacggcggctgggtgatgaatgatgaagctgccacccactatggagccatcgtggaccagatgaccctgggcctgcgcttcctggaggacacctttggaaatgatggccggccccgggtggcctggcacatcgaccccttcggccacagccgggagcaggccagcctgtttgcccagatgggctttgatggcttcttcttcggccgcctggactaccaggacaagtgggtgaggatgcagaagctggagatggagcaggtgtggagggccagcaccagcctgaagcccccaacagctgacctcttcaccggggtgctgcccaacggctacaaccccccaagaaacctgtgctgggatgtgctgtgtgtggaccagcccctggtggaggaccccaggagccctgagtacaatgccaaggagctggtggactacttcctgaatgtggccacagcccagggccgctactaccgcaccaaccacacagtgatgaccatgggcagtgacttccagtatgaaaatgccaacatgtggttcaagaacctggacaagctgatccggctggtgaatgcccagcaggccaagggcagctctgtgcacgtgctgtacagcaccccagcctgctacctgtgggagctgaacaaggccaacctgacctggagcgtgaagcatgatgacttcttcccctatgcagatggcccccaccagttctggacaggctacttcagcagcaggcctgccctgaagagatatgagcggctgagctacaacttcctgcaggtgtgcaaccagctggaggccctggtgggcctggccgccaacgtgggcccctacggcagcggggacagcgcccccctgaatgaggccatggctgtgctgcagcaccatgatgctgtgtctggcaccagccggcagcacgtggccaatgactatgcccggcagctggccgccggctggggcccctgtgaggtgctgctgagcaatgccctggcccggctgcggggcttcaaggaccacttcaccttctgccagcagctgaacatcagcatctgccccctgagccagacagctgcccgcttccaggtgattgtgtacaaccccctgggcaggaaggtgaactggatggtgcggctgcctgtgtctgaaggagtgtttgtggtgaaggaccccaatggaagaacagtgcccagtgatgtggtgatcttccccagcagtgacagccaggcccaccccccagagctgctcttcagcgccagcctgcctgccctgggcttcagcacctacagcgtggcccaggtgccccgctggaagccccaggcccgggccccccagcccatcccccggcgctcctggagccctgccctgaccattgaaaatgagcacatccgggccacctttgatcctgacaccggcctgctgatggagatcatgaacatgaaccagcagctgctgctgcctgtgcggcagaccttcttctggtacaatgccagcatcggggacaatgaaagtgaccaggccagcggggcctacatcttccggcccaaccagcagaagcccctgcctgtgagccgctgggcccagatccacctggtgaagacccccctggtgcaggaggtgcaccagaacttcagcgcctggtgcagccaggtggtgcggctgtacccaggccagaggcacctggagctggagtggagcgtgggccccatccctgtgggggacacctggggcaaggaggtgatcagcagatttgacacccccctggagaccaagggccgcttctacacagacagcaatggccgggagatcctggagcggcggcgggactaccggcccacctggaagctgaaccagacagagcctgtggccggcaactactaccctgtgaacacccgcatctacatcacagatggcaacatgcagctgactgtgctgacagacaggagccagggcggcagcagcctgagagatggcagcctggagctgatggtgcaccggcggctgctgaaggatgatggccggggcgtgtctgagcccctgatggagaatggcagcggggcctgggtgcggggccgccacctggtgctgctggacacagcccaggccgctgctgctggccaccggctgctggccgagcaggaggtgctggccccccaggtggtgctggcccctgggggcggggccgcctacaacctgggcgccccacccaggacccagttcagcggcctgcggcgggacctgcccccatctgtgcacctgctgaccctggcctcctggggccctgagatggtgctgctgcggctggagcaccagtttgctgtgggagaagattctggaagaaacctgagcgcccctgtgaccctgaacctgcgggacctcttcagcaccttcaccatcacccggctgcaggagaccaccctggtggccaaccagctgcgggaggccgccagccggctgaagtggaccaccaacacaggccccaccccccaccagaccccctaccagctggaccctgccaacatcaccctggagcccatggagatccgcaccttcctggcctctgtgcagtggaaggaggtggatggatag

SEQ ID NO: 3299 - DNA, 2853 bp, Artificial Sequence
  Description of Artificial Sequence: Synthetic coding sequence
atgctgaatgtgcacctgctgccccacacccatgatgatgtgggctggctgaagacagtggaccagtacttctacggcatcaagaatgacatccagcacgccggcgtgcagtacatcctggacagcgtcatcagcgccctgctggccgaccccacccggcgcttcatctacgtggagatcgccttcttcagccgctggtggcaccagcagaccaatgccacccaggaggtggtgcgggacctggtgcggcagggccgcctggagtttgccaatggaggctgggtgatgaatgatgaggccgccacccactacggggccatcgtggaccagatgaccctgggcctgcgcttcctggaggacacctttggaaatgatggccggccccgggtggcctggcacatcgaccccttcggccacagccgggagcaggccagcctgtttgcccagatgggctttgatggcttcttcttcggccgcctggactaccaggacaagtgggtgaggatgcagaagctggagatggagcaggtgtggagggccagcaccagcctgaagccacccacagctgacctcttcaccggggtgctgcccaacggctacaacccccccaggaacctgtgctgggatgtgctgtgtgtggaccagcccctggtggaggaccccaggagccctgagtacaatgccaaggagctggtggactacttcctgaatgtggccacagcccagggccgctactaccgcaccaaccacacagtgatgaccatgggcagtgacttccagtatgaaaatgccaacatgtggttcaagaacctggacaagctgatccggctggtgaatgcccagcaggccaagggcagctctgtgcacgtgctgtacagcaccccagcctgctacctgtgggagctgaacaaggccaacctgacctggagcgtgaagcatgatgacttcttcccctatgcagatggcccccaccagttctggacaggctacttcagcagcaggcctgccctgaagagatatgaaaggctgagctacaacttcctgcaggtgtgcaaccagctggaggccctggtgggcctggccgccaacgtgggcccctacggcagcggggacagcgcccccctgaatgaggccatggctgtgctgcagcaccatgatgctgtgtctggcaccagccggcagcacgtggccaatgactatgcccggcagctggccgccggctggggcccctgtgaggtgctgctgagcaatgccctggcccggctgcggggcttcaaggaccacttcaccttctgccagcagctgaacatcagcatctgccccctgagccagacagctgcccgcttccaggtgattgtgtacaaccccctgggcaggaaggtgaactggatggtgcggctgcctgtgtctgagggcgtgtttgtggtgaaggaccccaacggccgcacagtgcccagtgatgtggtgatcttccccagcagtgacagccaggcccaccccccagagctgctcttcagcgccagcctgcctgccctgggcttcagcacctacagcgtggcccaggtgccccgctggaagccccaggcccgggccccccagcccatccccaggaggtcctggagccctgccctgaccattgaaaatgagcacatccgggccacctttgatcctgacaccggcctgctgatggagatcatgaacatgaaccagcagctgctgctgcctgtgcggcagaccttcttctggtacaatgccagcattggagacaatgaaagtgaccaggccagcggggcctacatcttccggcccaaccagcagaagcccctgcctgtgagccgctgggcccagatccacctggtgaagacccccctggtgcaggaggtgcaccagaacttcagcgcctggtgcagccaggtggtgcggctgtacccaggccagaggcacctggagctggagtggagcgtgggccccatccctgtgggggacacctggggcaaggaggtgatcagcagatttgacacccccctggagaccaagggccgcttctacacagacagcaatggccgggagatcctggagaggagaagagactaccggcccacctggaagctgaaccagacagagcctgtggccggcaactactaccctgtgaacacccgcatctacatcacagatggcaacatgcagctgactgtgctgacagacaggagccagggcggcagcagcctgagagatggcagcctggagctgatggtgcaccggcggctgctgaaggatgatggccggggcgtgtctgagcccctgatggagaatggaagtggggcctgggtgcggggccgccacctggtgctgctggacacagcccaggccgctgctgctggccaccggctgctggccgagcaggaggtgctggccccccaggtggtgctggcccctgggggcggggccgcctacaacctgggcgccccacccaggacccagttcagcggcctgcggcgggacctgccccccagcgtgcacctgctgaccctggcctcctggggccctgagatggtgctgctgcggctggagcaccagtttgctgtgggggaggacagcggcaggaacctgagcgcccctgtgaccctgaacctgcgggacctcttcagcaccttcaccatcacccggctgcaggagaccaccctggtggccaaccagctgcgggaggccgccagccggctgaagtggaccaccaacacaggccccaccccccaccagaccccctaccagctggaccctgccaacatcaccctggagcccatggagatccgcaccttcctggcctctgtgcagtggaaggaggtggatggatag

SEQ ID NO: 3300 - DNA, 882 bp, Artificial Sequence
  Description of Artificial Sequence: Synthetic coding sequence
atgggcttccctgctgctgccctgctgtgtgccctgtgctgcggcctgctggccccagctgcccgggccggctacagcgaggagcgctgctcctggaggggcagcggcctgacccaggagcccggctctgtgggccagctggccctggcctgtgccgagggcgctgtggagtggctgtacccagctggggccctgcggctgaccctgggcggccctgacccccgggcccggcccggcatcgcctgcctgcggcctgtgcggccctttgctggggcccaggtgtttgctgagagagctggaggagccctggagctgctgctggccgagggccctggccctgctgggggccgctgtgtgcgctggggcccccgggagcggcgggccctcttcctgcaggccaccccccaccaggacatcagcagaagagtggccgccttccgctttgagctgcgggaggatggccggcctgagctgcccccccaggcccacggcctgggcgtggatggagcctgccggccctgcagtgatgctgagctgctgctggccgcctgcaccagtgactttgtgattcatggcatcatccatggagtgacccatgatgtggagctgcaggagagcgtcatcaccgtggtggccgcccgggtgctgcggcagaccccacccctcttccaggccggccgcagcggggaccagggcctgaccagcatccgcacccccctgcgctgtggggtgcaccctggccctggcaccttcctgttcatgggctggagcagatttggagaggcccggctgggctgtgccccccgcttccaggagttccggcgggcctatgaagctgcccgggccgcccacctgcacccctgtgaggtggccctgcactag

SEQ ID NO: 3301 - DNA, 708 bp, Artificial Sequence
  Description of Artificial Sequence: Synthetic coding sequence
atggagcaggatgatcctgtggaggccctgacagagctgcgggagcggcggctgggcgccctggagctgctgcaggccgccgccggcagcggcctggccgcctatgctgtgtgggccctgctgctgcagcccggcttcagaagagtgcccctgcggctgcaggtgccctacgtgggcgccagcgcccggcaggtggagcacgtgctgagcctgctgcggggccggcctgggaagacagtggacctgggcagcggagatggaagaattgtgctggccgcccaccgctgtggcctgcggcctgctgtgggctatgagctgaacccctggctggtggccctggcccggctgcacgcctggagggctggctgtgccggctctgtgtgctacagaaggaaggacctgtggaaggtgtccctgcgggactgcagaaatgtgtctgtgttcctggcccccagcgtgctgcccctgctggaggacaagctgaggacagagctgcctgctggggcccgggtggtgtctggccgcttccccctgcccacctggcagcctgtgacagctgtgggggagggcctggacagagtgtgggcctatgatgtgcctgagggcggccaggccggggaggccgccagcagccgcatccccatccaggccgcccctggccccagcagcgcccccatccctgggggcctcatcagccaggccagctag

SEQ ID NO: 3302 - DNA, 2253 bp, Artificial Sequence
  Description of Artificial Sequence: Synthetic coding sequence
atgctgcgggccaagaaccagctgttcctgctgagcccccactacctgcggcaggtgaaggagagcagcggcagccgcctcatccagcagaggctgctgcaccagcagcagcccctgcaccctgagtgggccgccctggccaagaagcagctgaagggcaagaacccagaagatctcatctggcacaccccagagggcatcagcatcaagcccctgtacagcaagagggacaccatggacctgcctgaggagctgcccggggtgaagcccttcacccggggcccctaccccaccatgtacaccttccggccctggaccatccggcagtatgccggcttcagcacagtggaggagagcaacaagttctacaaggacaacatcaaggccggccagcagggcctgtctgtggcctttgacctggccacccaccggggctatgacagcgacaacccccgggtgagaggagatgtgggcatggccggcgtggccatcgacacagtggaggacaccaagatcctgtttgatggcatccccctggagaagatgtctgtgtccatgaccatgaatggagctgtgattcctgtgctggccaacttcatcgtgactggagaggagcagggcgtgcccaaggagaagctgaccggcaccatccagaatgacatcctgaaggagttcatggtgaggaacacctacatcttccccccagagcccagcatgaagatcatcgctgacatctttgagtacacagccaagcacatgcccaagttcaacagcatcagcatcagcggctaccacatgcaggaggccggggctgatgccatcctggagctggcctacaccctggctgatggcctggagtacagcaggacaggcctgcaggccggcctgaccattgatgaatttgccccccggctgtccttcttctggggcatcggcatgaacttctacatggagatcgccaagatgagagctggccggcggctgtgggcccacctgattgagaagatgttccagcccaagaacagcaagagcctgctgctgcgggcccactgccagaccagcggctggagcctgacagagcaggacccctacaacaacatcgtgaggacagccatcgaggccatggctgctgtgtttggaggcacccagagcctgcacaccaacagctttgatgaggccctgggcctgcccaccgtgaagagcgcccgcatcgccaggaacacccagatcatcatccaggaggagagcggcatccccaaggtggccgacccctggggcggcagctacatgatggagtgcctgaccaatgatgtgtatgatgctgccctgaagctgatcaatgaaattgaggagatgggcggcatggccaaggctgtggccgagggcatccccaagctgcgcatcgaggagtgtgccgcccggcggcaggccagaattgattctggcagcgaggtgattgtgggcgtgaacaagtaccagctggagaaggaggatgctgtggaggtgctggccatcgacaacacctctgtgaggaaccggcagatcgagaagctgaagaagatcaagagcagccgggaccaggccctggccgagcgctgcctggccgccctgacagaatgtgccgccagcggagatggcaacatcctggccctggccgtggatgccagccgggcccgctgcaccgtgggggagatcacagatgccctgaagaaggtgtttggagagcacaaggccaatgacaggatggtgtctggggcctaccggcaggagtttggagagagcaaggagatcaccagcgccatcaagagggtgcacaagttcatggagcgggagggcagaagaccccggctgctggtggccaagatgggccaggacggccatgacagaggagccaaggtgattgccaccggctttgctgacctgggctttgatgtggacatcggccccctcttccagaccccccgggaggtggcccagcaggccgtggatgctgatgtgcatgctgtgggcatcagcaccctggccgccggccacaagaccctggtgcctgagctgatcaaggagctgaacagcctgggccgcccagacatcctggtgatgtgtggcggcgtcatccccccccaggactatgagttcctgtttgaggtgggcgtgtccaatgtgtttggacctggcacccgcatccccaaggctgctgtgcaggtgctggatgacatcgagaagtgcctggagaagaagcagcagagcgtgtag

SEQ ID NO: 3303 - DNA, 594 bp, Artificial Sequence
  Description of Artificial Sequence: Synthetic coding sequence
acccgctacctggcccgctgcaccgtgggggagatcacagatgccctgaagaaggtgtttggagagcacaaggccaatgacaggatggtgtctggggcctaccggcaggagtttggagagagcaaggagatcaccagcgccatcaagagggtgcacaagttcatggagcgggagggccggcggccccggctgctggtggccaagatgggccaggacggccatgacagaggagccaaggtgattgccactggatttgctgacctgggctttgatgtggacatcggccccctcttccagaccccccgggaggtggcccagcaggccgtggatgctgatgtgcatgctgtgggcatcagcaccctggccgccggccacaagaccctggtgcctgagctgatcaaggagctgaacagcctgggccgcccagacatcctggtgatgtgtggcggcgtcatccccccccaggactatgagttcctgtttgaggtgggcgtgtccaatgtgtttggacctggcacccgcatccccaaggctgctgtgcaggtgctggatgacatcgagaagtgcctggagaagaagcagcagagcgtgtag

SEQ ID NO: 3304 - DNA, 2685 bp, Artificial Sequence
  Description of Artificial Sequence: Synthetic coding sequence
atgatcctgctggccgtgctcttcctgtgcttcatcagcagctacagcgcctctgtgaagggccacaccaccggcctgagcctgaacaatgaccggctgtacaagctgacctacagcacagaggtgctgctggaccggggcaagggcaagctgcaggacagcgtgggctaccgcatcagcagcaatgtggatgtggccctgctgtggaggaacccagatggagatgatgaccagctgatccagatcaccatgaaggatgtgaatgtggagaatgtgaaccagcagagaggagagaagagcatcttcaagggcaagagccccagcaagatcatgggcaaggagaacctggaggccctgcagaggcccaccctgctgcacctgattcatggcaaggtgaaggagttctacagctaccagaatgaggccgtggccatcgagaacatcaagaggggcctggccagcctcttccagacccagctgagcagcggcaccaccaatgaggtggacatcagcggcaactgcaaggtgacctaccaggcccaccaggacaaggtgatcaagatcaaggccctggacagctgcaagatcgcccggagcggcttcaccacccccaaccaggtgctgggcgtgagcagcaaggccacctctgtgaccacctacaagattgaagattcttttgtgattgctgtgctggccgaggagacccacaactttggcctgaacttcctgcagaccatcaagggcaagatcgtgtccaagcagaagctggagctgaagaccacagaagctggcccccggctgatgtctgggaagcaggccgccgccatcatcaaggctgtggacagcaagtacacagccatccccatcgtgggccaggtgttccagagccactgcaagggctgccccagcctgtctgagctgtggaggagcaccaggaagtacctgcagcctgacaacctgagcaaggccgaggccgtgaggaacttcctggccttcatccagcacctgaggacagccaagaaggaggagatcctgcagatcctgaagatggagaacaaggaggtgctgccccagctggtggatgctgtgaccagcgcccagaccagtgacagcctggaggccatcctggacttcctggacttcaagagtgacagcagcatcatcctgcaggagcgcttcctgtatgcctgtggctttgccagccaccccaatgaggagctgctgcgggccctgatcagcaagttcaagggcagcatcggcagcagtgacatccgggagaccgtgatgatcatcaccggcaccctggtgaggaagctgtgccagaatgaaggctgcaagctgaaggctgtggtggaggccaagaagctgatcctgggcggcctggagaaggccgagaagaaggaggacaccaggatgtacctgctggccctgaagaatgccctgctgcctgagggcatccccagcctgctgaagtatgcagaggccggggagggccccatcagccacctggccaccacagccctgcagagatatgacctgcccttcatcacagatgaggtgaagaagaccctgaaccgcatctaccaccagaacaggaaggtgcatgagaagacagtgaggacagctgctgctgccatcatcctgaacaacaaccccagctacatggatgtgaagaacatcctgctgagcatcggggagctgccccaggagatgaacaagtacatgctggccatcgtgcaggacatcctgcgctttgagatgcctgccagcaagatcgtgcggcgggtgctgaaggagatggtggcccacaactatgaccgcttcagccgcagcggcagcagcagcgcctacacaggctacatcgagaggagccccaggtctgccagcacctacagcctggacatcctgtacagcggcagcggcatcctgcggcgcagcaacctgaacatcttccagtacatcggcaaggccggcctgcacggcagccaggtggtgattgaggcccagggcctggaggccctgattgctgccaccccagatgaaggagaggagaacctggacagctatgccggcatgtctgccatcctgtttgatgtgcagctgcggcctgtgaccttcttcaacggctacagcgacctgatgagcaagatgctgagcgccagcggggaccccatctctgtggtgaagggcctcatcctgctgattgaccacagccaggagctgcagctgcagagcggcctgaaggccaacatcgaggtgcagggcggcctggccatcgacatcagcggggccatggagttcagcctgtggtaccgggagagcaagaccagggtgaagaacagagtgacagtggtgatcaccacagacatcaccgtggacagcagctttgtgaaggccggcctggagaccagcacagaaacagaagctggcctggagttcatcagcacagtgcagttcagccagtaccccttcctggtgtgcatgcagatggacaaggatgaggcccccttccggcagtttgagaagaagtatgaaaggctgagcacaggccggggctacgtgtcccagaagaggaaggagagcgtgctggccggctgtgagttccccctgcaccaggagaacagcgagatgtgcaaggtggtgtttgccccccagcctgacagcaccagcagcggctggttctag

SEQ ID NO: 3305 - DNA, 2685 bp, Artificial Sequence; identical to SEQ ID NO: 3304
  Description of Artificial Sequence: Synthetic coding sequence

SEQ ID NO: 3306 - DNA, 537 bp, Artificial Sequence
  Description of Artificial Sequence: Synthetic coding sequence
atggcccgggcccccctgcggcctgagaacaccatcgtgcggggcagcgccaaccagtgccaggacacctacagagctgaggagctgaccggccacaccaccggcctgagcctgaacaatgaccggctgtacaagctgacctacagcacagaggtgctgctggaccggggcaagggcaagctgcaggacagcgtgggctaccgcatcagcagcaatgtggatgtggccctgctgtggaggaacccagatggagatgatgaccagctgatccagatcaccatgaaggatgtgaatgtggagaatgtgaaccagcagagaggagagaagagcatcttcaagggcaagagccccagcaagatcatgggcaaggagaacctggaggccctgcagaggcccaccctgctgcacctgattcatggcaaggtgaaggagttctacagctaccagaatgaggccgtggccatcgagaacatcaagaggggcctggccagcctcttccagacccagctgagcagcggcaccaccaatgaggtgtag

SEQ ID NO: 3307 - DNA, 1551 bp, Artificial Sequence
  Description of Artificial Sequence: Synthetic coding sequence
atgatcctgctggccgtgctcttcctgtgcttcatcagcagctacagcgcctctgtgaagggccacaccaccggcctgagcctgaacaatgaccggctgtacaagctgacctacagcacagaggtgctgctggaccggggcaagggcaagctgcaggacagcgtgggctaccgcatcagcagcaatgtggatgtggccctgctgtggaggaacccagatggagatgatgaccagctgatccagatcaccatgaaggatgtgaatgtggagaatgtgaaccagcagagaggagagaagagcatcttcaagggcaagagccccagcaagatcatgggcaaggagaacctggaggccctgcagaggcccaccctgctgcacctgattcatggcaaggtgaaggagttctacagctaccagaatgaggccgtggccatcgagaacatcaagaggggcctggccagcctcttccagacccagctgagcagcggcaccaccaatgaggtggacatcagcggcaactgcaaggtgacctaccaggcccaccaggacaaggtgatcaagatcaaggccctggacagctgcaagatcgcccggagcggcttcaccacccccaaccaggtgctgggcgtgagcagcaaggccacctctgtgaccacctacaagattgaagattcttttgtgattgctgtgctggccgaggagacccacaactttggcctgaacttcctgcagaccatcaagggcaagatcgtgtccaagcagaagctggagctgaagaccacagaagctggcccccggctgatgtctgggaagcaggccgccgccatcatcaaggctgtggacagcaagtacacagccatccccatcgtgggccaggtgttccagagccactgcaagggctgccccagcctgtctgagctgtggaggagcaccaggaagtacctgcagcctgacaacctgagcaaggccgaggccgtgaggaacttcctggccttcatccagcacctgaggacagccaagaaggaggagatcctgcagatcctgaagatggagaacaaggaggtgctgccccagctggtggatgctgtgaccagcgcccagaccagtgacagcctggaggccatcctggacttcctggacttcaagagtgacagcagcatcatcctgcaggagcgcttcctgtatgcctgtggctttgccagccaccccaatgaggagctgctgcgggccctgatcagcaagttcaagggcagcatcggcagcagtgacatccgggagaccgtgatgatcatcaccggcaccctggtgaggaagctgtgccagaatgaaggctgcaagctgaaggctgtggtggaggccaagaagctgatcctgggcggcctggagaaggccgagaagaaggaggacaccaggatgtacctgctggccctgaagaatgccctgctgcctgagggcatccccagcctgctgaagtatgcagaggccggggagggccccatcagccacctggccaccacagccctgcagagatatgacctcttccacaactag

SEQ ID NO: 3308 - DNA, 3771 bp, Artificial Sequence
  Description of Artificial Sequence: Synthetic coding sequence
atgctgttcaagctgctgcagaggcagacctacacctgcctgagccacagatatggcctgtatgtgtgcttcctgggcgtggtggtgaccatcgtgtctgccttccagtttggagaggtggtgctggagtggagccgggaccagtaccacgtgctgtttgacagctacagagacaacattgctgggaagagcttccagaaccggctgtgcctgcccatgcccattgatgtggtgtacacctgggtgaatggaacagacctggagctgctgaaggagctgcagcaggtgcgggagcagatggaggaggagcagaaggccatgagggagatcctgggcaagaacaccacagagcccaccaagaagtctgagaagcagctggagtgcctgctgacccactgcatcaaggtgcccatgctggtgctggaccctgccctgcctgccaacatcaccctgaaggacctgcccagcctgtaccccagcttccacagcgccagtgacatcttcaacgtggccaagcccaagaaccccagcaccaacgtgtctgtggtggtgtttgacagcaccaaggatgtggaggatgcccacagcggcctgctgaagggcaacagccggcagacagtgtggaggggctacctgaccacagacaaggaggtgcccggcctggtgctgatgcaggacctggccttcctgagcggcttcccccccaccttcaaggagaccaaccagctgaagaccaagctgcctgagaacctgagcagcaaggtgaagctgctgcagctgtacagcgaggcctctgtggccctgctgaagctgaacaaccccaaggacttccaggagctgaacaagcagaccaagaagaacatgaccattgatggcaaggagctgaccatcagccctgcctacctgctgtgggacctgagcgccatcagccagagcaagcaggatgaggacatcagcgccagcagatttgaggacaatgaggagctgcgctacagcctgcggagcattgaaagacatgccccctgggtgaggaacatcttcatcgtgaccaacggccagatccccagctggctgaacctggacaacccccgggtgaccatcgtgacccaccaggatgtgttcaggaacctgagccacctgcccaccttcagcagccctgccatcgagagccacatccacagaattgagggcctgagccagaagttcatctacctgaatgatgatgtgatgtttgggaaggatgtgtggccagatgacttctacagccacagcaagggccagaaggtgtacctgacctggcctgtgcccaactgtgccgagggctgccccggctcctggatcaaggatggctactgtgacaaggcctgcaacaacagcgcctgtgactgggatggaggagactgcagcggcaacagcggcggcagccgctacatcgccggcggcggcggcaccggcagcattggagtgggccagccctggcagtttggaggcggcatcaacagcgtgtcctactgcaaccagggctgtgccaacagctggctggccgacaagttctgtgaccaggcctgcaatgtgctgagctgtggctttgatgctggggactgtggccaggaccacttccacgagctgtacaaggtgatcctgctgcccaaccagacccactacatcatccccaagggagaatgtctgccctacttctcctttgctgaggtggccaagaggggcgtggagggcgcctacagcgacaaccccatcatcagacatgccagcatcgccaacaagtggaagaccatccacctgatcatgcacagcggcatgaatgccaccaccatccacttcaacctgaccttccagaacaccaatgatgaggagttcaagatgcagatcaccgtggaggtggacacccgggagggccccaagctgaacagcacagcccagaagggctatgagaacctggtgagccccatcaccctgctgcctgaggccgagatcctgtttgaggacatccccaaggagaagcgcttccccaagttcaagagacatgatgtgaacagcacccggcgggcccaggaggaggtgaagatccccctggtgaacatcagcctgctgcccaaggatgcccagctgagcctgaacaccctggacctgcagctggagcacggggacatcaccctgaagggctacaacctgagcaagagcgccctgctgcggagcttcctgatgaacagccagcacgccaagatcaagaaccaggccatcatcacagatgagaccaatgacagcctggtggccccccaggagaagcaggtgcacaagagcatcctgcccaacagcctgggcgtgtctgagcggctgcagaggctgaccttccctgctgtgtctgtgaaggtgaatggacatgaccagggccagaacccccccctggacctggagaccacagcccgcttccgggtggagacccacacccagaagaccatcggcggcaatgtgaccaaggagaagccacccagcctgattgtgcccctggagagccagatgaccaaggagaagaagatcaccgggaaggagaaggagaacagcaggatggaggagaatgctgagaaccacatcggcgtgacagaggtgctgctgggcaggaagctgcagcactacacagacagctacctgggcttcctgccctgggagaagaagaagtacttccaggacctgctggatgaggaggagagcctgaagacccagctggcctacttcacagacagcaagaacacaggccggcagctgaaggacacctttgctgacagcctgcgctacgtgaacaagatcctgaacagcaagtttggcttcaccagcaggaaggtgcctgcccacatgccccacatgattgaccgcatcgtgatgcaggagctgcaggacatgtttcctgaggagtttgacaagaccagcttccacaaggtgcgccacagcgaggacatgcagtttgccttctcctacttctactacctgatgtctgctgtgcagcccctgaacatcagccaggtgtttgatgaggtggacacagaccagagcggcgtgctgagtgaccgggagatccgcaccctggccacccgcatccacgagctgcccctgagcctgcaggacctgaccggcctggagcacatgctgatcaactgcagcaagatgctgcctgctgacatcacccagctgaacaacatcccccccacccaggagagctactatgaccccaacctgccccctgtgaccaagagcctggtgaccaactgcaagcctgtgacagacaagatccacaaggcctacaaggacaagaacaagtacagatttgagatcatgggagaggaggagatcgccttcaagatgatccgcaccaacgtgagccacgtggtgggccagctggatgacatcaggaagaaccccaggaagtttgtgtgcctgaatgacaacatcgaccacaaccacaaggatgcccagacagtgaaggctgtgctgcgggacttctatgagagcatgttccccatccccagccagtttgagctgccccgggagtacagaaaccgcttcctgcacatgcatgagctgcaggagtggagggcctacagagacaagctgaagttctggacccactgtgtgctggccaccctcatcatgttcaccatcttctccttctttgctgagcagctgattgccctgaagaggaagatcttcccccggcggcgcatccacaaggaggccagccccaaccgcatccgggtgtag

SEQ ID NO: 3309 - DNA, 1473 bp, Artificial Sequence
  Description of Artificial Sequence: Synthetic coding sequence
atgctgttcaagctgctgcagaggcagacctacacctgcctgagccacagatatggcctgtatgtgtgcttcctgggcgtggtggtgaccatcgtgtctgccttccagtttggagaggtggtgctggagtggagccgggaccagtaccacgtgctgtttgacagctacagagacaacattgctgggaagagcttccagaaccggctgtgcctgcccatgcccattgatgtggtgtacacctgggtgaatggaacagacctggagctgctgaaggagctgcagcaggtgcgggagcagatggaggaggagcagaaggccatgagggagatcctgggcaagaacaccacagagcccaccaagaagtctgagaagcagctggagtgcctgctgacccactgcatcaaggtgcccatgctggtgctggaccctgccctgcctgccaacatcaccctgaaggacctgcccagcctgtaccccagcttccacagcgccagtgacatcttcaacgtggccaagcccaagaaccccagcaccaacgtgtctgtggtggtgtttgacagcaccaaggatgtggaggatgcccacagcggcctgctgaagggcaacagccggcagacagtgtggaggggctacctgaccacagacaaggaggtgcccggcctggtgctgatgcaggacctggccttcctgagcggcttcccccccaccttcaaggagaccaaccagctgaagaccaagctgcctgagaacctgagcagcaaggtgaagctgctgcagctgtacagcgaggcctctgtggccctgctgaagctgaacaaccccaaggacttccaggagctgaacaagcagaccaagaagaacatgaccattgatggcaaggagctgaccatcagccctgcctacctgctgtgggacctgagcgccatcagccagagcaagcaggatgaggacatcagcgccagcagatttgaggacaatgaggagctgcgctacagcctgcggagcattgaaagacatgccccctgggtgaggaacatcttcatcgtgaccaacggccagatccccagctggctgaacctggacaacccccgggtgaccatcgtgacccaccaggatgtgttcaggaacctgagccacctgcccaccttcagcagccctgccatcgagagccacatccacagaattgagggcctgagccagaagttcatctacctgaatgatgatgtgatgtttgggaaggatgtgtggccagatgacttctacagccacagcaagggccagaaggtgtacctgacctggcctgtgcccaactgtgccgagggctgccccggctcctggatcaaggatggctactgtgacaaggcctgcaacaacagcgcctgtgactgggatggaggagactgcagcggcaaggatgtgctgaactgcaacagcttcatcttcatggagtacttcctgctgaaccactactag

SEQ ID NO: 3310 - DNA, 1605 bp, Artificial Sequence
  Description of Artificial Sequence: Synthetic coding sequence
atggccacagccctgatggctgtggtgctgcgggctgctgctgtggccccccggctgcggggccggggcggcactggaggagcccggcggctgagctgtggggccaggagaagagctgcccggggcaccagccctggaagaaggctgagcacagcctggagccagccccagcccccacctgaggagtatgctggagcagatgatgtgtcccagagccctgtggccgaggagcccagctgggtgcccagcccccggccccctgtgccccatgagagccctgagcccccatctggccgcagcctggtgcagagggacatccaggccttcctgaaccagtgtggggccagccctggagaggcccggcactggctgacccagttccagacctgccaccacagcgctgacaagccctttgctgtgattgaggtggatgaggaggtgctgaagtgccagcagggcgtgagcagcctggcctttgccctggccttcctgcagaggatggacatgaagcccctggtggtgctgggcctgcctgcccccacagcccccagcggctgcctgtccttctgggaggccaaggcccagctggccaagagctgcaaggtgctggtggatgccctgcggcacaatgctgctgctgctgtgcccttcttcggcggcggctctgtgctgcgggctgctgagcccgccccccacgccagctatggaggcatcgtgtctgtggagacagacctgctgcagtggtgcctggagagcggcagcatccccatcctgtgccccatcggggagacagctgccaggagatctgtgctgctggacagcctggaggtgacagccagcctggccaaggccctgcggcccaccaagatcatcttcctgaacaacacaggaggcctgcgggacagcagccacaaggtgctgagcaatgtgaacctgcctgctgacctggacctggtgtgcaatgctgagtgggtgtccaccaaggagcggcagcagatgaggctcatcgtggatgtgctgagccggctgccccaccacagcagcgctgtgatcacagctgccagcaccctgctgacagagctgttcagcaacaagggcagcggcaccctcttcaagaatgctgagaggatgctgcgggtgcgcagcctggacaagctggaccagggccgcctggtggacctggtgaatgccagctttgggaagaagctgagagatgactacctggccagcctgcggccccggctgcacagcatctacgtgtctgagggctacaatgctgctgccatcctgaccatggagcctgtgctgggcggcaccccctacctggacaagtttgtggtgagcagcagccggcagggccagggcagcggccagatgctgtgggagtgcctgcggcgggacctgcagaccctcttctggaggagccgggtgaccaaccccatcaacccctggtacttcaagcacagtgatggcagcttcagcaacaagcagtggatcttcttctggtttggcctggccgacatccgggacagctatgagctggtgaaccacgccaagggcctgcctgacagcttccacaagccagccagtgaccccggcagctag

SEQ ID NO: 3311 - DNA, 1107 bp, Artificial Sequence
  Description of Artificial Sequence: Synthetic coding sequence
atggacatgaagcccctggtggtgctgggcctgcctgcccccacagcccccagcggctgcctgtccttctgggaggccaaggcccagctggccaagagctgcaaggtgctggtggatgccctgcggcacaatgctgctgctgctgtgcccttcttcggcggcggctctgtgctgcgggctgctgagcccgccccccacgccagctatggaggcatcgtgtctgtggagacagacctgctgcagtggtgcctggagagcggcagcatccccatcctgtgccccatcggggagacagctgccaggagatctgtgctgctggacagcctggaggtgacagccagcctggccaaggccctgcggcccaccaagatcatcttcctgaacaacacaggaggcctgcgggacagcagccacaaggtgctgagcaatgtgaacctgcctgctgacctggacctggtgtgcaatgctgagtgggtgtccaccaaggagcggcagcagatgaggctcatcgtggatgtgctgagccggctgccccaccacagcagcgctgtgatcacagctgccagcaccctgctgacagagctgttcagcaacaagggcagcggcaccctcttcaagaatgctgagaggatgctgcgggtgcgcagcctggacaagctggaccagggccgcctggtggacctggtgaatgccagctttgggaagaagctgagagatgactacctggccagcctgcggccccggctgcacagcatctacgtgtctgagggctacaatgctgctgccatcctgaccatggagcctgtgctgggcggcaccccctacctggacaagtttgtggtgagcagcagccggcagggccagggcagcggccagatgctgtgggagtgcctgcggcgggacctgcagaccctcttctggaggagccgggtgaccaaccccatcaacccctggtacttcaagcacagtgatggcagcttcagcaacaagcagtggatcttcttctggtttggcctggccgacatccgggacagctatgagctggtgaaccacgccaagggcctgcctgacagcttccacaagccagccagtgaccccggcagctag

SEQ ID NO: 3312 - DNA, 1188 bp, Artificial Sequence
  Description of Artificial Sequence: Synthetic coding sequence
atgcctggccgcagctgtgtggccctggtgctgctggccgctgctgtgtcctgtgctgtggcccagcacgccccaccctggacagaggactgcaggaagagcacctacccaccttctggccccacctacagaggagctgtgccctggtacaccatcaacctggacctgcccccctacaagcgctggcatgagctgatgctggacaaggcccctgtgctgaaggtgattgtgaacagcctgaagaacatgatcaacacctttgtgcccagcggcaagatcatgcaggtggtggatgagaagctgcccggcctgctgggcaacttccctggcccctttgaggaggagatgaagggcattgctgctgtgacagacatccccctgggggagatcatctccttcaacatcttctatgagctgttcaccatctgcaccagcatcgtggccgaggacaagaagggccacctgattcatggaagaaacatggactttggagtcttcctgggctggaacatcaacaatgacacctgggtgatcacagagcagctgaagcccctgactgtgaacctggacttccagaggaacaacaagacagtgttcaaggccagcagctttgctggctacgtgggcatgctgaccggcttcaagccaggcctcttcagcctgaccctgaatgaacgcttcagcatcaatggaggctacctgggcatcctggagtggatcctgggcaagaaggatgtgatgtggattggcttcctgaccaggacagtgctggagaacagcaccagctatgaggaggccaagaacctgctgaccaagaccaagatcctggccccagcctacttcatcctgggcggcaaccagagcggggagggctgcgtcatcacccgggacaggaaggagagcctggatgtgtatgagctggatgccaagcagggccgctggtacgtggtgcagaccaactatgaccgctggaagcaccccttcttcctggatgacaggaggaccccagccaagatgtgcctgaacagaaccagccaggagaacatcagctttgagaccatgtatgatgtgctgagcaccaagcctgtgctgaacaagctgactgtgtacaccaccctgattgatgtgaccaagggccagtttgagacctacctgcgggactgcccagacccctgcatcggctggtag

SEQ ID NO: 3313 - DNA, 1170 bp, Artificial Sequence
  Description of Artificial Sequence: Synthetic coding sequence
atgaactgctgcatcggcctgggggagaaggcccggggcagccaccgggccagctaccccagcctgagcgccctcttcacagaggccagcatcctgggcttcggcagctttgctgtgaaggcccagtggacagaggactgcaggaagagcacctacccaccttctggccccaccgtcttccctgctgtgatccgctacagaggagctgtgccctggtacaccatcaacctggacctgcccccctacaagcgctggcatgagctgatgctggacaaggcccctgtgcccggcctgctgggcaacttccctggcccctttgaggaggagatgaagggcattgctgctgtgacagacatccccctgggggagatcatctccttcaacatcttctatgagctgttcaccatctgcaccagcatcgtggccgaggacaagaagggccacctgattcatggaagaaacatggactttggagtcttcctgggctggaacatcaacaatgacacctgggtgatcacagagcagctgaagcccctgactgtgaacctggacttccagaggaacaacaagacagtgttcaaggccagcagctttgctggctacgtgggcatgctgaccggcttcaagccaggcctcttcagcctgaccctgaatgaacgcttcagcatcaatggaggctacctgggcatcctggagtggatcctgggcaagaaggatgtgatgtggattggcttcctgaccaggacagtgctggagaacagcaccagctatgaggaggccaagaacctgctgaccaagaccaagatcctggccccagcctacttcatcctgggcggcaaccagagcggggagggctgcgtcatcacccgggacaggaaggagagcctggatgtgtatgagctggatgccaagcagggccgctggtacgtggtgcagaccaactatgaccgctggaagcaccccttcttcctggatgacaggaggaccccagccaagatgtgcctgaacagaaccagccaggagaacatcagctttgagaccatgtatgatgtgctgagcaccaagcctgtgctgaacaagctgactgtgtacaccaccctgattgatgtgaccaagggccagtttgagacctacctgcgggactgcccagacccctgcatcggctggtag

SEQ ID NO: 3314 - DNA, 1236 bp, Artificial Sequence
  Description of Artificial Sequence: Synthetic coding sequence
atgaactgctgcatcggcctgggggagaaggcccggggcagccaccgggccagctaccccagcctgagcgccctcttcacagaggccagcatcctgggcttcggcagctttgctgtgaaggcccagtggacagaggactgcaggaagagcacctacccaccttctggccccacctacagaggagctgtgccctggtacaccatcaacctggacctgcccccctacaagcgctggcatgagctgatgctggacaaggcccctgtgctgaaggtgattgtgaacagcctgaagaacatgatcaacacctttgtgcccagcggcaagatcatgcaggtggtggatgagaagctgcccggcctgctgggcaacttccctggcccctttgaggaggagatgaagggcattgctgctgtgacagacatccccctgggggagatcatctccttcaacatcttctatgagctgttcaccatctgcaccagcatcgtggccgaggacaagaagggccacctgattcatggaagaaacatggactttggagtcttcctgggctggaacatcaacaatgacacctgggtgatcacagagcagctgaagcccctgactgtgaacctggacttccagaggaacaacaagacagtgttcaaggccagcagctttgctggctacgtgggcatgctgaccggcttcaagccaggcctcttcagcctgaccctgaatgaacgcttcagcatcaatggaggctacctgggcatcctggagtggatcctgggcaagaaggatgtgatgtggattggcttcctgaccaggacagtgctggagaacagcaccagctatgaggaggccaagaacctgctgaccaagaccaagatcctggccccagcctacttcatcctgggcggcaaccagagcggggagggctgcgtcatcacccgggacaggaaggagagcctggatgtgtatgagctggatgccaagcagggccgctggtacgtggtgcagaccaactatgaccgctggaagcaccccttcttcctggatgacaggaggaccccagccaagatgtgcctgaacagaaccagccaggagaacatcagctttgagaccatgtatgatgtgctgagcaccaagcctgtgctgaacaagctgactgtgtacaccaccctgattgatgtgaccaagggccagtttgagacctacctgcgggactgcccagacccctgcatcggctggtag

SEQ ID NO: 3315 - DNA, 918 bp, Artificial Sequence
  Description of Artificial Sequence: Synthetic coding sequence
atgctggacaaggcccctgtgctgaaggtgattgtgaacagcctgaagaacatgatcaacacctttgtgcccagcggcaagatcatgcaggtggtggatgagaagctgcccggcctgctgggcaacttccctggcccctttgaggaggagatgaagggcattgctgctgtgacagacatccccctgggccacctgattcatggaagaaacatggactttggagtcttcctgggctggaacatcaacaatgacacctgggtgatcacagagcagctgaagcccctgactgtgaacctggacttccagaggaacaacaagacagtgttcaaggccagcagctttgctggctacgtgggcatgctgaccggcttcaagccaggcctcttcagcctgaccctgaatgaacgcttcagcatcaatggaggctacctgggcatcctggagtggatcctgggcaagaaggatgtgatgtggattggcttcctgaccaggacagtgctggagaacagcaccagctatgaggaggccaagaacctgctgaccaagaccaagatcctggccccagcctacttcatcctgggcggcaaccagagcggggagggctgcgtcatcacccgggacaggaaggagagcctggatgtgtatgagctggatgccaagcagggccgctggtacgtggtgcagaccaactatgaccgctggaagcaccccttcttcctggatgacaggaggaccccagccaagatgtgcctgaacagaaccagccaggagaacatcagctttgagaccatgtatgatgtgctgagcaccaagcctgtgctgaacaagctgactgtgtacaccaccctgattgatgtgaccaagggccagtttgagacctacctgcgggactgcccagacccctgcatcggctggtag

SEQ ID NO: 3316 - DNA, 1113 bp, Artificial Sequence
  Description of Artificial Sequence: Synthetic coding sequence
atgcctggccgcagctgtgtggccctggtgctgctggccgctgctgtgtcctgtgctgtggcccagcacgccccaccctggacagaggactgcaggaagagcacctacccaccttctggccccacctacagaggagctgtgccctggtacaccatcaacctggacctgcccccctacaagcgctggcatgagctgatgctggacaaggcccctgtgctgaaggtgattgtgaacagcctgaagaacatgatcaacacctttgtgcccagcggcaagatcatgcaggtggtggatgagaagctgcccggcctgctgggcaacttccctggcccctttgaggaggagatgaagggcattgctgctgtgacagacatccccctgggccacctgatccacggcaggaacatggactttggagtcttcctgggctggaacatcaacaatgacacctgggtgatcacagagcagctgaagcccctgactgtgaacctggacttccagaggaacaacaagacagtgttcaaggccagcagctttgctggctacgtgggcatgctgaccggcttcaagccaggcctcttcagcctgaccctgaatgaacgcttcagcatcaatggaggctacctgggcatcctggagtggatcctgggcaagaaggatgtgatgtggattggcttcctgaccaggacagtgctggagaacagcaccagctatgaggaggccaagaacctgctgaccaagaccaagatcctggccccagcctacttcatcctgggcggcaaccagagcggggagggctgtgtgatcacccgggacaggaaggagagcctggatgtgtatgagctggatgccaagcagggccgctggtacgtggtgcagaccaactatgaccgctggaagcaccccttcttcctggatgacaggaggaccccagccaagatgtgcctgaacagaaccagccaggagaacatcagctttgagaccatgtatgatgtgctgagcaccaagcctgtgctgaacaagctgactgtgtacaccaccctgattgatgtgaccaagggccagtttgagacctacctgcgggactgcccagacccctgcatcggctggtag

SEQ ID NO: 3317 - DNA, 405 bp, Artificial Sequence
  Description of Artificial Sequence: Synthetic coding sequence
atggacccccagacagcccccagccgggccctgctgctgctgctcttcctgcacctggccttcctgggcggccgcagccaccccctgggcagccctggcagcgccagtgacctggagaccagcggcctgcaggagcagaggaaccacctgcagggcaagctgtctgagctgcaggtggagcagaccagcctggagcccctgcaggagagcccccggcccaccggggtgtggaagagccgggaggtggccacagagggcatccggggccacaggaagatggtgctgtacaccctgcgggcccccaggagccccaagatggtgcagggcagcggctgctttggaaggaagatggaccgcatcagcagcagcagcggcctgggctgcaaggtgctgcggcggcactag

SEQ ID NO: 3318 - DNA, 726 bp, Artificial Sequence
  Description of Artificial Sequence: Synthetic coding sequence
atgtccatgctgttctacaccctcatcacagccttcctgattggcatccaggccgagccccacagcgagagcaatgtgcctgctggccacaccatcccccaggcccactggaccaagctgcagcacagcctggacacagccctgcggcgggcccggagcgccccagctgctgccatcgccgcccgggtggccggccagaccaggaacatcaccgtggaccccaggctcttcaagaagaggcggctgcggagcccccgggtgctcttcagcacccagcccccccgggaggccgctgacacccaggacctggactttgaggtgggcggggccgcccccttcaacagaacccacaggagcaagaggagcagcagccaccccatcttccacagaggagagttctctgtgtgtgacagcgtgtctgtgtgggtgggggacaagaccacagccacagacatcaagggcaaggaggtgatggtgctgggggaggtgaacatcaacaacagcgtcttcaagcagtacttctttgagaccaagtgccgggaccccaaccctgtggacagcggctgccggggcatcgacagcaagcactggaacagctactgcaccaccacccacacctttgtgaaggccctgaccatggatggcaagcaggccgcctggaggttcatcagaattgacacagcctgtgtgtgtgtgctgagcaggaaggctgtgagaagagcctag

SEQ ID NO: 3319 - DNA, 1923 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccagcccggcttcaccggggcccgctgcacagaaaatgtgcccatgaaggtgcagaaccaggagaaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggtctgagaggaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtgattgtgatgagctctgtggagaacagccgccacagcagccccactggaggcccccggggccgcctgaatggaactggaggcccccgggagtgcaacagcttcctgcggcatgcccgggagaccccagacagctacagagacagcccccacagcgagcgctacgtgtctgccatgaccaccccagccaggatgagccctgtggacttccacacccccagcagccccaagagcccccccagcgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgagaattgtggaggatgaggagtatgagaccacccaggagtatgagcccgcccaggagcctgtgaagaagctggccaacagcagaagagccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagcagcgtcatcgccaaccaggaccccatcgctgtgtag

SEQ ID NO: 3320 - DNA, 1914 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacaaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggagtgaaagaaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtcatcgtgatgagctctgtggagaacagccgccacagcagccccaccggcggcccccggggccgcctgaatggcaccggcggcccccgggagtgcaacagcttcctgcggcatgcccgggagaccccagacagctacagagacagcccccacagcgagagatatgtgtctgccatgaccaccccagccaggatgagccctgtggacttccacacccccagcagccccaagagccccccatctgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgcgcatcgtggaggatgaggagtatgagaccacccaggagtatgagcccgcccaggagcctgtgaagaagctggccaacagccggcgggccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagctctgtgattgccaaccaggaccccatcgctgtgtag

SEQ ID NO: 3321 - DNA, 1836 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgccaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacaagcacctgggcatcgagttcatggaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggagtgaaagaaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtcatcgtgatgagctctgtggagaacagccgccacagcagccccaccggcggcccccggggccgcctgaatggcaccggcggcccccgggagtgcaacagcttcctgcggcatgcccgggagaccccagacagctacagagacagcccccacagcgagagatatgtgtctgccatgaccaccccagccaggatgagccctgtggacttccacacccccagcagccccaagagccccccatctgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgcgcatcgtggaggatgaggagtatgagaccacccaggagtatgagcccgcccaggagcctgtgaagaagctggccaacagccggcgggccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagctctgtgattgccaaccaggaccccatcgctgtgtag

SEQ ID NO: 3322 - DNA, 1947 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccagcccggcttcaccggggcccgctgcacagaaaatgtgcccatgaaggtgcagaaccaggagaagcacagcggggagcccttccctgaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggtctgagaggaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtgattgtgatgagctctgtggagaacagccgccacagcagccccactggaggcccccggggccgcctgaatggaactggaggcccccgggagtgcaacagcttcctgcggcatgcccgggagaccccagacagctacagagacagcccccacagcgagcgctacgtgtctgccatgaccaccccagccaggatgagccctgtggacttccacacccccagcagccccaagagcccccccagcgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgagaattgtggaggatgaggagtatgagaccacccaggagtatgagcccgcccaggagcctgtgaagaagctggccaacagcagaagagccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagcagcgtcatcgccaaccaggaccccatcgctgtgtag

SEQ ID NO: 3323 - DNA, 744 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccagcccggcttcaccggggcccgctgcacagaaaatgtgcccatgaaggtgcagaaccaggagagcgcccagatgagcctgctggtgattgctgccaagaccacctag

SEQ ID NO: 3324 - DNA, 1938 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacaagcacctgggcatcgagttcatggaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggagtgaaagaaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtcatcgtgatgagctctgtggagaacagccgccacagcagccccaccggcggcccccggggccgcctgaatggcaccggcggcccccgggagtgcaacagcttcctgcggcatgcccgggagaccccagacagctacagagacagcccccacagcgagagatatgtgtctgccatgaccaccccagccaggatgagccctgtggacttccacacccccagcagccccaagagccccccatctgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgcgcatcgtggaggatgaggagtatgagaccacccaggagtatgagcccgcccaggagcctgtgaagaagctggccaacagccggcgggccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagctctgtgattgccaaccaggaccccatcgctgtgtag

SEQ ID NO: 3325 - DNA, 1923 bp, Artificial Sequence; identical to SEQ ID NO: 3319
  Description of Artificial Sequence: Synthetic coding sequence

SEQ ID NO: 3326 - DNA, 1773 bp, Artificial Sequence
  Description of Artificial Sequence: Synthetic coding sequence
atgggcaagggccgggccggccgggtgggcaccacagccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgattctgccagcgccaacatcaccatcgtggagagcaatgccaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacaagcacctgggcatcgagttcatggaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggtctgagaggaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtgattgtgatgagctctgtggagaacagccgccacagcagccccactggaggcccccggggccgcctgaatggaactggaggcccccgggagtgcaacagcttcctgcggcatgcccgggagaccccagacagctacagagacagcccccacagcgagcgctacgtgtctgccatgaccaccccagccaggatgagccctgtggacttccacacccccagcagccccaagagcccccccagcgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgagaattgtggaggatgaggagtatgagaccacccaggagtatgagcccgcccaggagcctgtgaagaagctggccaacagcagaagagccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagcagcgtcatcgccaaccaggaccccatcgctgtgtag

SEQ ID NO: 3327 - DNA, 1269 bp, Artificial Sequence
  Description of Artificial Sequence: Synthetic coding sequence
atgcgctggaggcgggccccccggcgcagcggccggcccggcccccgggcccagaggcctggcagcgctgcccggagcagcccccccctgcccctgctgcccctgctgctgctgctgggcacagctgccctggcccctggagctgctgctggaaatgaggccgccccagctggggcctctgtgtgctacagcagcccccccagcgtgggctctgtgcaggagctggcccagagagctgctgtggtgattgagggcaaggtgcacccccagaggcggcagcagggcgccctggacaggaaggctgctgctgctgctggggaggccggggcctggggcggggaccgggagcccccagctgctggcccccgggccctgggccccccagctgaggagcccctgctggccgccaatggaacagtgcccagctggcccacagcccctgtgcccagcgctggggagcccggggaggaggccccctacctggtgaaggtgcaccaggtgtgggccgtgaaggccggcggcctgaagaaggacagcctgctgactgtgcggctgggcacctggggccacccagccttccccagctgtggccgcctgaaggaggacagccgctacatcttcttcatggagccagatgccaacagcaccagccgggccccagctgccttccgggccagcttcccccccctggagaccggcaggaacctgaagaaggaggtgtcccgggtgctgtgcaagagatgtgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgattctgccagcgccaacatcaccatcgtggagagcaatgccaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacagcaccagcacccccttcctgagcctgcctgagtag

SEQ ID NO: 3328 - DNA, 891 bp, Artificial Sequence
  Description of Artificial Sequence: Synthetic coding sequence
atggagatctacagcccagacatgtctgaggtggccgctgagaggagcagcagccccagcacccagctgtctgctgaccccagcctggatggcctgcctgctgctgaggacatgcctgagccccagacagaagatggccgcaccccaggcctggtgggcctggccgtgccctgctgtgcctgcctggaggccgagcggctgcggggctgcctgaacagcgagaagatctgcatcgtgcccatcctggcctgcctggtgtccctgtgcctgtgcatcgccggcctgaagtgggtgtttgtggacaagatctttgaatatgacagccccacccacctggaccccggcggcctgggccaggaccccatcatcagcctggatgccacagctgccagcgctgtgtgggtgtcctctgaggcctacaccagccctgtgtcccgggcccagagcgagagcgaggtgcaggtgacagtgcagggcgacaaggctgtggtgtcctttgagcccagcgctgcccccacccccaagaaccgcatctttgccttctccttcctgcccagcacagcccccagcttccccagccccaccaggaaccctgaggtgaggacccccaagagcgccacccagccccagaccacagagaccaacctgcagacagcccccaagctgagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacagcaccagcacccccttcctgagcctgcctgagtag

SEQ ID NO: 3329 - DNA, 1389 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccagcccggcttcaccggggcccgctgcacagaaaatgtgcccatgaaggtgcagaaccaggagaaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggtctgagaggaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtgattgtgatgagctctgtggagaacagccgccacagcagccccactggaggcccccggggccgcctgaatggaactggaggcccccgggagtgcaacagcttcctgcggcatgcccgggagaccccagacagctacagagacagcccccacagcgagcggcacaacctgattgctgagctgcggaggaacaaggcccacaggagcaagtgcatgcagatccagctgagcgccacccacctgcggagcagcagcatcccccacctgggcttcatcctgtag

SEQ ID NO: 3330 - DNA, 1452 bp, Artificial Sequence
  Description of Artificial Sequence: Synthetic coding sequence
atgcagatccccaagcacatcagcattgaggacatcacagccaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacaaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggagtgaaagaaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtcatcgtgatgagctctgtggagaacagccgccacagcagccccaccggcggcccccggggccgcctgaatggcaccggcggcccccgggagtgcaacagcttcctgcggcatgcccgggagaccccagacagctacagagacagcccccacagcgagagatatgtgtctgccatgaccaccccagccaggatgagccctgtggacttccacacccccagcagccccaagagccccccatctgagatgagcccccctgtgtcctccatgacagtgtccatgcccagcatggctgtgagccccttcatggaggaggagcggcccctgctgctggtgaccccaccccggctgcgggagaagaagtttgaccaccacccccagcagttcagcagcttccaccacaacccagcccatgacagcaacagcctgcctgccagccccctgcgcatcgtggaggatgaggagtatgagaccacccaggagtatgagcccgcccaggagcctgtgaagaagctggccaacagccggcgggccaagaggaccaagcccaacggccacatcgccaaccggctggaggtggacagcaacaccagcagccagagcagcaacagcgagagcgagacagaagatgagcgggtgggggaggacacccccttcctgggcatccagaaccccctggccgccagcctggaggccaccccagccttccggctggccgacagcaggaccaacccagctggccgcttcagcacccaggaggagatccaggcccggctgagctctgtgattgccaaccaggaccccatcgctgtgtag

SEQ ID NO: 3331 - DNA, 1263 bp, Artificial Sequence
  Description of Artificial Sequence: Synthetic coding sequence
atgtctgagaggaaggagggccggggcaagggcaagggcaagaagaaggagcggggcagcggcaagaagccagagagcgctgctggcagccagagccctgccctgcccccccggctgaaggagatgaagagccaggagagcgctgctggcagcaagctggtgctgcgctgtgagaccagcagcgagtacagcagcctgcgcttcaagtggttcaagaatggaaatgagctgaacaggaagaacaagccccagaacatcaagatccagaagaagccaggcaagtctgagctgcgcatcaacaaggccagcctggccgacagcggggagtacatgtgcaaggtgatcagcaagctgggcaatgacagcgccagcgccaacatcaccatcgtggagagcaatgagatcatcaccggcatgcctgccagcacagaaggagcctacgtgagcagcgagagccccatccgcatctctgtgtccacagagggcgccaacaccagcagcagcaccagcaccagcaccaccggcaccagccacctggtgaagtgtgccgagaaggagaagaccttctgtgtgaatggaggagagtgcttcatggtgaaggacctgagcaaccccagccgctacctgtgcaagtgccccaatgagttcaccggggaccgctgccagaactacgtgatggccagcttctacaaggccgaggagctgtaccagaagagggtgctgaccatcaccggcatctgcatcgccctgctggtggtgggcatcatgtgtgtggtggcctactgcaagaccaagaagcagaggaagaagctgcatgaccggctgcggcagagcctgcggagtgaaagaaacaacatgatgaacatcgccaacggcccccaccaccccaaccccccaccagaaaatgtgcagctggtgaaccagtatgtgtccaagaatgtcatcagcagcgagcacatcgtggagcgggaggccgagaccagcttcagcaccagccactacaccagcacagcccaccacagcaccaccgtgacccagacccccagccacagctggagcaatggccacacagagagcatcctgtctgagagccacagcgtcatcgtgatgagctctgtggagaacagccgccacagcagccccaccggcggcccccggggccgcctgaatggcaccggcggcccccgggagtgcaacagcttcctgcggcatgcccgggagaccccagacagctacagagacagcccccacagcgagaggtag

SEQ ID NO: 3332 - DNA, 1065 bp, Artificial Sequence
  Description of Artificial Sequence: Synthetic coding sequence
atgctgttcaacctgcgcatcctgctgaacaatgctgccttcagaaatggccacaacttcatggtgaggaacttccgctgtggccagcccctgcagaacaaggtgcagctgaagggccgggacctgctgaccctgaagaacttcaccggggaggagatcaagtacatgctgtggctgtctgctgacctgaagttccgcatcaagcagaagggggagtacctgcccctgctgcagggcaagagcctgggcatgatctttgagaagaggagcaccaggacccggctgagcacagaaacaggctttgccctgctgggcggccacccctgcttcctgaccacccaggacatccacctgggcgtgaatgaaagcctgacagacacagcccgggtgctgagctccatggctgatgctgtgctggcccgggtgtacaagcagagcgacctggacaccctggccaaggaggccagcatccccatcatcaatggcctgagtgacctgtaccaccccatccagatcctggccgactacctgaccctgcaggagcactacagcagcctgaagggcctgaccctgtcctggattggagatggcaacaacatcctgcacagcatcatgatgtctgctgccaagtttggcatgcacctgcaggccgccacccccaagggctatgagccagatgcctctgtgaccaagctggccgagcagtatgccaaggaaaatggcaccaagctgctgctgaccaatgaccccctggaggccgcccatggaggaaatgtgctgatcacagacacctggatctccatgggccaggaggaggagaagaagaagaggctgcaggccttccagggctaccaggtgaccatgaagacagccaaggtggccgccagtgactggaccttcctgcactgcctgcccaggaagccagaggaggtggatgatgaggtgttctacagccccaggagcctggtgtttcctgaggccgagaacaggaagtggaccatcatggctgtgatggtgtccctgctgacagactacagcccccagctgcagaagcccaagttctag

SEQ ID NO: 3333 - DNA, 348 bp, Artificial Sequence
  Description of Artificial Sequence: Synthetic coding sequence
atgatcccagccaaggacatggccaaggtgatgattgtgatgctggccatctgcttcctgaccaagagtgatggcaagtctgtgaagaagaggtctgtgtctgagatccagctgatgcacaacctgggcaagcacctgaacagcatggagcgggtggagtggctgaggaagaagctgcaggatgtgcacaactttgtggccctgggcgcccccctggcccccagagatgctggcagccagaggcccaggaagaaggaggacaacgtgctggtggagagccatgagaagagcctgggggaggccgacaaggcagatgtgaatgtgctgaccaaggccaagagccagtag

SEQ ID NO: 3334 - DNA, 348 bp, Artificial Sequence; identical to SEQ ID NO: 3333
  Description of Artificial Sequence: Synthetic coding sequence

SEQ ID NO: 3335 - DNA, 354 bp, Artificial Sequence
  Description of Artificial Sequence: Synthetic coding sequence
atgagcacagctgtgctggagaaccctggcctgggcaggaagctgagtgactttggccaggagaccagctacatcgaggacaactgcaaccagaatggagccatcagcctcatcttcagcctgaaggaggaggtgggcgccctggccaaggtgctgcggctgtttgaagaaaatgatgtgaacctgacccacatcgagagccggcccagccggctgaagaaggatgaatatgagttcttcacccacctggacaagaggagcctgcctgccctgaccaacatcatcaagatcctgcggcatgacatcggggccaccgtgcatgagctgagccgggacaagaagaaggacacctag

SEQ ID NO: 3336 - DNA, 411 bp, Artificial Sequence
  Description of Artificial Sequence: Synthetic coding sequence
atgagcacagctgtgctggagaaccctggcctgggcaggaagctgagtgactttggccaggagaccagctacatcgaggacaactgcaaccagaatggagccatcagcctcatcttcagcctgaaggaggaggtgggcgccctggccaaggtgctgcggctgtttgaagaaaatgatgtgaacctgacccacatcgagagccggcccagccggctgaagaaggatgaatatgagttcttcacccacctggacaagaggagcctgcctgccctgaccaacatcatcaagatcctgcggcatgacatcggggccaccgtgcatgagctgagccgggacaagaagaaggacacagtgccctggttccccaggaccatccaggagctggacagatttgccaaccagatcctgtag

SEQ ID NO: 3337 - DNA, 1359 bp, Artificial Sequence
  Description of Artificial Sequence: Synthetic coding sequence
atgagcacagctgtgctggagaaccctggcctgggcaggaagctgagtgactttggccaggagaccagctacatcgaggacaactgcaaccagaatggagccatcagcctcatcttcagcctgaaggaggaggtgggcgccctggccaaggtgctgcggctgtttgaagaaaatgatgtgaacctgacccacatcgagagccggcccagccggctgaagaaggatgaatatgagttcttcacccacctggacaagaggagcctgcctgccctgaccaacatcatcaagatcctgcggcatgacatcggggccaccgtgcatgagctgagccgggacaagaagaaggacacagtgccctggttccccaggaccatccaggagctggacagatttgccaaccagatcctgtcctatggagctgagctggatgctgaccaccctggcttcaaggaccctgtgtaccgggcccggaggaagcagtttgctgacatcgcctacaactaccgccacggccagcccatcccccgggtggagtacatggaggaggagaagaagacctggggcaccgtcttcaagaccctgaagagcctgtacaagacccacgcctgctatgagtacaaccacatcttccccctgctggagaagtactgcggcttccacgaggacaacatcccccagctggaggatgtgtcccagttcctgcagacctgcaccggcttccggctgcggcctgtggccggcctgctgagcagccgggacttcctgggcggcctggccttccgggtcttccactgcacccagtacatcagacatggcagcaagcccatgtacaccccagagccagacatctgccacgagctgctgggccacgtgcccctcttcagtgacaggagctttgcccagttcagccaggagatcggcctggccagcctgggcgccccagatgagtacatcgagaagctggccaccatctactggttcaccgtggagtttggcctgtgcaagcagggcgacagcatcaaggcctatggagctggcctgctgagcagctttggagagctgcagtactgcctgtctgagaagcccaagctgctgcccctggagctggagaagacagccatccagaactacacagtgacagagttccagcccctgtactacgtggccgagagcttcaatgatgccaaggagaaggtgaggaactttgctgccaccatcccccggcccttctctgtgcgctatgacccctacacccagagaattgaggtgctggacaacacccagcagctgaagatcctggccgacagcatcaacagcgagatcggcatcctgtgcagcgccctgcagaagatcaagtag

SEQ ID NO: 3338 - DNA, 3261 bp, Artificial Sequence
  Description of Artificial Sequence: Synthetic coding sequence
atggcctgcagcccagatgctgtggtgagccccagcagcgccttcctgcggagcggctctgtgtatgagcccctgaagagcatcaacctgcccaggccagacaatgagaccctgtgggacaagctggaccactactaccgcatcgtgaagagcaccctgctgctgtaccagagccccaccaccggcctcttccccaccaagacctgtggcggggaccagaaggccaagatccaggacagcctgtactgtgccgccggggcctgggccctggccctggcctacagaagaattgatgatgacaagggccgcacccatgagctggagcacagcgccatcaagtgcatgaggggcatcctgtactgctacatgaggcaggccgacaaggtgcagcagttcaagcaggacccccggcccaccacctgcctgcacagcgtcttcaacgtgcacactggagatgagctgctgtcctatgaggagtatggccacctgcagatcaatgctgtgtccctgtacctgctgtacctggtggagatgatcagcagcggcctgcagatcatctacaacacagatgaggtgtccttcatccagaacctggtgttctgtgtggagcgggtgtacagagtgcctgactttggagtgtgggagcggggcagcaagtacaacaacggcagcacagagctgcacagcagctctgtgggcctggccaaggccgccctggaggccatcaatggcttcaacctgtttggaaaccagggctgctcctggagcgtcatctttgtggacctggatgcccacaacagaaaccggcagaccctgtgcagcctgctgccccgggagagccgcagccacaacacagatgctgccctgctgccctgcatctcctacccagcctttgccctggatgatgaggtgctcttcagccagaccctggacaaggtggtgaggaagctgaagggcaagtatggcttcaagcgcttcctgagagatggctaccgcaccagcctggaggaccccaaccgctgctactacaagccagctgagatcaagctgtttgatggcattgaatgtgagttccccatcttcttcctgtacatgatgattgatggagtcttccggggcaaccccaagcaggtgcaggagtaccaggacctgctgacccctgtgctgcaccacaccacagagggctaccctgtggtgcccaagtactactacgtgcctgctgactttgtggagtatgagaagaacaaccctggcagccagaagcgcttccccagcaactgtggcagagatggcaagctgttcctgtggggccaggccctgtacatcatcgccaagctgctggctgatgagctgatcagccccaaggacattgatcctgtgcagagatatgtgcccctgaaggaccagagaaatgtgtccatgaggttcagcaaccagggccccctggagaatgacctggtggtgcacgtggccctgattgctgagagccagaggctgcaggtgttcctgaacacctacggcatccagacccagaccccccagcaggtggagcccatccagatctggccccagcaggagctggtgaaggcctacctgcagctgggcatcaatgagaagctgggcctgagcggccgcccagaccggcccatcggctgcctgggcaccagcaagatctaccgcatcctgggcaagacagtggtgtgctaccccatcatctttgacctgagtgacttctacatgagccaggatgtgttcctgctgattgatgacatcaagaatgccctgcagttcatcaagcagtactggaagatgcacggccggcccctcttcctggtgctgatccgggaggacaacatccggggcagccgcttcaaccccatcctggacatgctggccgccctgaagaagggcatcattggaggagtgaaggtgcacgtggaccggctgcagaccctcatcagcggggctgtggtggagcagctggacttcctgcgcatcagtgacacagaggagctgcctgagttcaagagctttgaggagctggagccccccaagcacagcaaggtgaagaggcagagcagcaccccatctgcccctgagctgggccagcagccagatgtgaacatcagcgagtggaaggacaagcccacccatgagatcctgcagaagctgaatgactgcagctgcctggccagccaggccatcctgctgggcatcctgctgaagcgggagggccccaacttcatcaccaaggagggcaccgtgtctgaccacatcgagcgggtgtaccgccgggccggcagccagaagctgtggagcgtggtgcggcgggccgccagcctgctgagcaaggtggtggacagcctggcccccagcatcaccaacgtgctggtgcagggcaagcaggtgaccctgggcgccttcggccacgaggaggaggtgatcagcaaccccctgagccccagggtcatccagaacatcatctactacaagtgcaacacccatgatgagcgggaggccgtcatccagcaggagctggtgatccacatcggctggatcatcagcaacaaccctgagctgttcagcggcatgctgaagatcagaattggctggatcatccacgccatggagtatgagctgcagatccggggcggggacaagccagccctggacctgtaccagctgagccccagcgaggtgaagcagctgctgctggacatcctgcagccccagcagaatggccgctgctggctgaacagacggcagattgatggcagcctgaacagaacacccaccggcttctatgacagagtgtggcagatcctggagaggaccccaaatggcatcatcgtggccggcaagcacctgccccagcagcccaccctgagtgacatgaccatgtatgagatgaacttcagcctgctggtggaggacaccctgggcaacatcgaccagccccagtaccggcagatcgtggtggagctgctgatggtggtgtccatcgtgctggagagaaatcctgagctggagttccaggacaaggtggacctggaccggctggtgaaggaggccttcaatgagttccagaaggaccagagccggctgaaggagattgagaagcaggatgacatgaccagcttctacaacaccccacccctgggcaagaggggcacctgcagctacctgaccaaggctgtgatgaacctgctgctggagggggaggtgaagcccaacaatgatgacccctgcctgatctcctag

SEQ ID NO: 3339 - DNA, 1221 bp, Artificial Sequence
  Description of Artificial Sequence: Synthetic coding sequence
atgaccctggatgtgggcccagaagatgagctgcctgactgggccgccgccaaggagttctaccagaagtatgaccccaaggatgtgattggccggggcgtgtcctctgtggtgagaagatgtgtgcaccgggccaccggccacgagtttgctgtgaagatcatggaggtgacagctgagcggctgagccctgagcagctggaggaggtgcgggaggccacccggcgggagacccacatcctgcggcaggtggccggccacccccacatcatcaccctgattgacagctatgagagcagcagcttcatgttcctggtgtttgacctgatgaggaagggggagctgtttgactacctgacagagaaggtggccctgtctgagaaggagaccaggagcatcatgaggagcctgctggaggccgtgtccttcctgcacgccaacaacatcgtgcaccgggacctgaagccagagaacatcctgctggatgacaacatgcagatccggctgagtgactttggcttcagctgccacctggagcccggggagaagctgcgggagctgtgtggcaccccaggctacctggcccctgagatcctgaagtgcagcatggatgagacccaccctggctacggcaaggaggtggacctgtgggcctgtggggtcatcctcttcaccctgctggccggcagcccccccttctggcaccggcggcagatcctgatgctgaggatgatcatggagggccagtaccagttcagcagccctgagtgggatgacaggagcagcacagtgaaggacctgatcagccggctgctgcaggtggaccctgaggcccggctgacagctgagcaggccctgcagcaccccttctttgagcgctgtgagggcagccagccctggaacctgaccccccggcagcgcttccgggtggccgtgtggacagtgctggccgccggccgggtggccctgagcacccaccgggtgcggcccctgaccaagaatgccctgctgcgggacccctatgccctgcggtctgtgcgccacctgattgacaactgtgccttccggctgtatggccactgggtgaagaagggggagcagcagaacagagctgccctcttccagcaccggcccccaggccccttccccatcatgggccctgaggaggagggggacagcgctgccatcacagaagatgaagctgtgctggtgctgggctag

SEQ ID NO: 3340 - DNA, 3708 bp, Artificial Sequence
  Description of Artificial Sequence: Synthetic coding sequence
atgaggagccgcagcaacagcggcgtgcggctggatggctacgcccggctggtgcagcagaccatcctgtgctaccagaaccctgtgacaggcctgctgagcgccagccatgagcagaaggatgcctgggtgcgggacaacatctacagcatcctggccgtgtggggcctgggcatggcctacaggaagaatgctgacagagatgaggacaaggccaaggcctatgagctggagcagaatgtggtgaagctgatgaggggcctgctgcagtgcatgatgaggcaggtggccaaggtggagaagttcaagcacacccagagcaccaaggacagcctgcacgccaagtacaacacagccacctgtggcaccgtggtgggagatgaccagtggggccacctgcaggtggatgccaccagcctcttcctgctcttcctggcccagatgacagccagcggcctgcgcatcatcttcaccctggatgaggtggccttcatccagaacctggtgttctacatcgaggccgcctacaaggtggccgactatggcatgtgggagcggggggacaagaccaaccagggcatccctgagctgaatgccagctctgtgggcatggccaaggccgccctggaggccattgatgagctggacctgtttggagcccatggaggcaggaagagcgtcatccacgtgctgcctgatgaggtggagcactgccagagcatcctcttctccatgctgccccgggccagcaccagcaaggagattgatgctggcctgctgagcatcatctccttccctgcctttgctgtggaggatgtgaacctggtgaatgtgaccaagaatgagatcatcagcaagctgcagggccgctatggctgctgccgcttcctgagagatggctacaagaccccccgggaggaccccaaccggctgcactatgaccctgctgagctgaagctgtttgagaacattgaatgtgagtggcctgtgttctggacctacttcatcattgatggagtcttctctggagatgctgtgcaggtgcaggagtaccgggaggccctggagggcatcctgatccggggcaagaatggcatccggctggtgcctgagctgtatgctgtgccccccaacaaggtggatgaggagtacaagaacccccacacagtggacagagtgcccatgggcaaggtgccccacctgtggggccagagcctgtacatcctgagcagcctgctggccgagggcttcctggccgccggggagattgaccccctgaacagacgcttcagcacctctgtgaagccagatgtggtggtgcaggtgacagtgctggccgagaacaaccacatcaaggacctgctgaggaagcacggcgtgaatgtgcagagcattgctgacatccaccccatccaggtgcagcccggccgcatcctgagccacatctatgccaagctgggcaggaacaagaacatgaacctgagcggccggccctaccgccacatcggcgtgctgggcaccagcaagctgtatgtgatccggaaccagatcttcaccttcaccccccagttcacagaccagcaccacttctacctggccctggacaatgagatgattgtggagatgctgagaattgagctggcctacctgtgcacctgctggaggatgacaggccggcccaccctgaccttccccatcagcaggaccatgctgaccaatgatggcagtgacatccacagcgctgtgctgagcaccatcaggaagctggaggatggctactttggaggagcccgggtgaagctgggcaacctgtctgagttcctgaccaccagcttctacacctacctgaccttcctggaccctgactgtgatgagaagctgtttgacaatgccagcgagggcaccttctccccagacagcgacagcgacctggtgggctacctggaggacacctgcaaccaggagagccaggatgagctggaccactacatcaaccacctgctgcagagcaccagcctgcggagctacctgccccccctgtgcaagaacacagaagatagacatgtgttttctgccatccacagcacccgggacatcctgtctgtgatggccaaggccaagggcctggaggtgccctttgtgcccatgaccctgcccaccaaggtgctgagcgcccacaggaagagcctgaacctggtggacagcccccagcccctgctggagaaggtgcctgagagtgacttccagtggcccagagatgaccatggagatgtggactgtgagaagctggtggagcagctgaaggactgcagcaacctgcaggaccaggccgacatcctgtacatcctgtatgtgatcaagggccccagctgggacaccaacctgagcggccagcacggcgtgacagtgcagaacctgctgggggagctgtatggcaaggccggcctgaaccaggagtggggcctcatccgctacatcagcggcctgctgaggaagaaggtggaggtgctggccgaggcctgcacagacctgctgagccaccagaagcagctgactgtgggcctgcccccagagccccgggagaagatcatcagcgcccccctgcccccagaggagctgaccaagctgatctatgaggccagcggccaggacatcagcattgctgtgctgacccaggagatcgtggtgtacctggccatgtatgtgcgggcccagcccagcctgtttgtggagatgctgcggctgagaattggcctcatcatccaggtgatggccacagagctggcccggagcctgaactgcagcggggaggaggccagcgagagcctgatgaacctgagcccctttgacatgaagaacctgctgcaccacatcctgagcggcaaggagtttggagtggagaggtctgtgcggcccatccacagcagcaccagcagccccaccatcagcatccacgaggtgggccacactggagtgaccaagacagagaggagcggcatcaaccggctgcggtctgagatgaagcagatgacccggcgcttcagcgcagatgagcagttcttctctgtgggccaggccgccagcagcagcgcccacagcagcaagagcgcccggagcagcacccccagcagccccaccggcaccagcagcagtgacagcggcggccaccacatcggctggggcgagcggcagggccagtggctgcggcggcggcggctggatggagccatcaacagagtgcctgtgggcttctaccagagggtgtggaagatcctgcagaagtgccacggcctgagcattgatggctacgtgctgcccagcagcaccacccgggagatgacccctcatgagatcaagtttgctgtgcacgtggagagcgtgctgaacagagtgccccagcctgagtaccggcagctgctggtggaggccatcatggtgctgaccctgctgagtgacacagagatgaccagcatcggcggcatcatccacgtggaccagatcgtgcagatggccagccagctgttcctgcaggaccaggtgtccatcggggccatggacaccctggagaaggaccaggccaccggcatctgccacttcttctatgattctgcccccagcggggcctacggcaccatgacctacctgaccagggctgtggccagctacctgcaggagctgctgcccaacagcggctgccagatgcagtag

SEQ ID NO: 3341 - DNA, 3261 bp, Artificial Sequence; identical to SEQ ID NO: 3338
  Description of Artificial Sequence: Synthetic coding sequence

SEQ ID NO: 3342 - DNA, 3282 bp, Artificial Sequence
  Description of Artificial Sequence: Synthetic coding sequence
atggccggggctgctggcctgacagctgaggtgtcctggaaggtgctggagcggcgggcccggaccaagaggagcggctctgtgtatgagcccctgaagagcatcaacctgcccaggccagacaatgagaccctgtgggacaagctggaccactactacagaattgtgaagagcaccctgctgctgtaccagagccccaccaccggcctcttccccaccaagacctgtggcggggaccagaaggccaagatccaggacagcctgtactgtgccgccggggcctgggccctggccctggcctacagaagaattgatgatgacaagggccgcacccatgagctggagcacagcgccatcaagtgcatgaggggcatcctgtactgctacatgaggcaggccgacaaggtgcagcagttcaagcaggacccccggcccaccacctgcctgcacagcgtcttcaacgtgcacactggagatgagctgctgtcctatgaggagtatggccacctgcagatcaatgctgtgtccctgtacctgctgtacctggtggagatgatcagcagcggcctgcagatcatctacaacacagatgaggtgtccttcatccagaacctggtgttctgtgtggagcgggtgtacagagtgcctgactttggagtgtgggagcggggcagcaagtacaacaacggcagcacagagctgcacagcagctctgtgggcctggccaaggccgccctggaggccatcaatggcttcaacctgtttggaaaccagggctgctcctggagcgtcatctttgtggacctggatgcccacaacagaaaccggcagaccctgtgcagcctgctgccccgggagagccgcagccacaacacagatgctgccctgctgccctgcatctcctacccagcctttgccctggatgatgaggtgctcttcagccagaccctggacaaggtggtgaggaagctgaagggcaagtatggcttcaagcgcttcctgagagatggctaccgcaccagcctggaggaccccaaccgctgctactacaagccagctgagatcaagctgtttgatggcattgaatgtgagttccccatcttcttcctgtacatgatgattgatggagtcttccggggcaaccccaagcaggtgcaggagtaccaggacctgctgacccctgtgctgcaccacaccacagagggctaccctgtggtgcccaagtactactacgtgcctgctgactttgtggagtatgagaagaacaaccctggcagccagaagcgcttccccagcaactgtggcagagatggcaagctgttcctgtggggccaggccctgtacatcatcgccaagctgctggctgatgagctgatcagccccaaggacatcgaccctgtgcagcgctacgtgcccctgaaggaccagagaaatgtgtccatgaggttcagcaaccagggccccctggagaatgacctggtggtgcacgtggccctgattgctgagagccagaggctgcaggtgttcctgaacacctacggcatccagacccagaccccccagcaggtggagcccatccagatctggccccagcaggagctggtgaaggcctacctgcagctgggcatcaatgagaagctgggcctgagcggccgcccagaccggcccatcggctgcctgggcaccagcaagatctaccgcatcctgggcaagacagtggtgtgctaccccatcatctttgacctgagtgacttctacatgagccaggatgtgttcctgctgattgatgacatcaagaatgccctgcagttcatcaagcagtactggaagatgcacggccggcccctcttcctggtgctgatccgggaggacaacatccggggcagccgcttcaaccccatcctggacatgctggccgccctgaagaagggcatcatcggcggcgtgaaggtgcacgtggaccggctgcagaccctcatctctggagctgtggtggagcagctggacttcctgcgcatcagtgacacagaggagctgcctgagttcaagagctttgaggagctggagccccccaagcacagcaaggtgaagaggcagagcagcacccccagcgcccctgagctgggccagcagccagatgtgaacatcagcgagtggaaggacaagcccacccatgagatcctgcagaagctgaatgactgcagctgcctggccagccaggccatcctgctgggcatcctgctgaagcgggagggccccaacttcatcaccaaggagggcaccgtgtctgaccacatcgagcgggtgtacagaagagctggcagccagaagctgtggctggccgtgcgctacggggccgccttcacccagaagttcagcagcagcatcgccccccacatcaccaccttcctggtgcacggcaagcaggtgaccctgggcgcctttggacatgaggaggaggtgatcagcaaccccctgagccccagggtcatccagaacatcatctactacaagtgcaacacccatgatgagcgggaggccgtcatccagcaggagctggtgatccacatcggctggatcatcagcaacaaccctgagctgttcagcggcatgctgaagatccgcatcggctggatcatccacgccatggagtatgagctgcagatccggggcggggacaagccagccctggacctgtaccagctgagccccagcgaggtgaagcagctgctgctggacatcctgcagccccagcagaatggccgctgctggctgaacagacggcagattgatggcagcctgaacagaacacccaccggcttctatgacagagtgtggcagatcctggagaggacccccaacggcatcatcgtggccggcaagcacctgccccagcagcccaccctgagtgacatgaccatgtatgagatgaacttcagcctgctggtggaggacaccctgggcaacatcgaccagccccagtaccggcagatcgtggtggagctgctgatggtggtgtccatcgtgctggagaggaaccctgagctggagttccaggacaaggtggacctggaccggctggtgaaggaggccttcaatgagttccagaaggaccagagccggctgaaggagattgagaagcaggatgacatgaccagcttctacaacaccccacccctgggcaagaggggcacctgcagctacctgaccaaggctgtgatgaacctgctgctggagggggaggtgaagcccaacaatgatgacccctgcctgatctcctag

SEQ ID NO: 3343 - DNA, 3261 bp, Artificial Sequence
  Description of Artificial Sequence: Synthetic coding sequence
atggcctgcagcccagatgctgtggtgagccccagcagcgccttcctgcggagcggctctgtgtatgagcccctgaagagcatcaacctgcccaggccagacaatgagaccctgtgggacaagctggaccactactaccgcatcgtgaagagcaccctgctgctgtaccagagccccaccaccggcctcttccccaccaagacctgtggcggggaccagaaggccaagatccaggacagcctgtactgtgccgccggggcctgggccctggccctggcctacagaagaattgatgatgacaagggccgcacccatgagctggagcacagcgccatcaagtgcatgaggggcatcctgtactgctacatgaggcaggccgacaaggtgcagcagttcaagcaggacccccggcccaccacctgcctgcacagcgtcttcaacgtgcacactggagatgagctgctgtcctatgaggagtatggccacctgcagatcaatgctgtgtccctgtacctgctgtacctggtggagatgatcagcagcggcctgcagatcatctacaacacagatgaggtgtccttcatccagaacctggtgttctgtgtggagcgggtgtacagagtgcctgactttggagtgtgggagcggggcagcaagtacaacaacggcagcacagagctgcacagcagctctgtgggcctggccaaggccgccctggaggccatcaatggcttcaacctgtttggaaaccagggctgctcctggagcgtcatctttgtggacctggatgcccacaacagaaaccggcagaccctgtgcagcctgctgccccgggagagccgcagccacaacacagatgctgccctgctgccctgcatctcctacccagcctttgccctggatgatgaggtgctcttcagccagaccctggacaaggtggtgaggaagctgaagggcaagtatggcttcaagcgcttcctgagagatggctaccgcaccagcctggaggaccccaaccgctgctactacaagccagctgagatcaagctgtttgatggcattgaatgtgagttccccatcttcttcctgtacatgatgattgatggagtcttccggggcaaccccaagcaggtgcaggagtaccaggacctgctgacccctgtgctgcaccacaccacagagggctaccctgtggtgcccaagtactactacgtgcctgctgactttgtggagtatgagaagaacaaccctggcagccagaagcgcttccccagcaactgtggcagagatggcaagctgttcctgtggggccaggccctgtacatcatcgccaagctgctggctgatgagctgatcagccccaaggacattgatcctgtgcagagatatgtgcccctgaaggaccagagaaatgtgtccatgaggttcagcaaccagggccccctggagaatgacctggtggtgcacgtggccctgattgctgagagccagaggctgcaggtgttcctgaacacctacggcatccagacccagaccccccagcaggtggagcccatccagatctggccccagcaggagctggtgaaggcctacctgcagctgggcatcaatgagaagctgggcctgagcggccgcccagaccggcccatcggctgcctgggcaccagcaagatctaccgcatcctgggcaagacagtggtgtgctaccccatcatctttgacctgagtgacttctacatgagccaggatgtgttcctgctgattgatgacatcaagaatgccctgcagttcatcaagcagtactggaagatgcacggccggcccctcttcctggtgctgatccgggaggacaacatccggggcagccgcttcaaccccatcctggacatgctggccgccctgaagaagggcatcattggaggagtgaaggtgcacgtggaccggctgcagaccctcatcagcggggctgtggtggagcagctggacttcctgcgcatcagtgacacagaggagctgcctgagttcaagagctttgaggagctggagccccccaagcacagcaaggtgaagaggcagagcagcaccccatctgcccctgagctgggccagcagccagatgtgaacatcagcgagtggaaggacaagcccacccatgagatcctgcagaagctgaatgactgcagctgcctggccagccaggccatcctgctgggcatcctgctgaagcgggagggccccaacttcatcaccaaggagggcaccgtgtctgaccacatcgagcgggtgtaccgccgggccggcagccagaagctgtggctggccgtgcgctatggagctgccttcacccagaagttcagcagcagcatcgccccccacatcaccaccttcctggtgcacggcaagcaggtgaccctgggcgccttcggccacgaggaggaggtgatcagcaaccccctgagccccagggtcatccagaacatcatctactacaagtgcaacacccatgatgagcgggaggccgtcatccagcaggagctggtgatccacatcggctggatcatcagcaacaaccctgagctgttcagcggcatgctgaagatcagaattggctggatcatccacgccatggagtatgagctgcagatccggggcggggacaagccagccctggacctgtaccagctgagccccagcgaggtgaagcagctgctgctggacatcctgcagccccagcagaatggccgctgctggctgaacagacggcagattgatggcagcctgaacagaacacccaccggcttctatgacagagtgtggcagatcctggagaggaccccaaatggcatcatcgtggccggcaagcacctgccccagcagcccaccctgagtgacatgaccatgtatgagatgaacttcagcctgctggtggaggacaccctgggcaacatcgaccagccccagtaccggcagatcgtggtggagctgctgatggtggtgtccatcgtgctggagagaaatcctgagctggagttccaggacaaggtggacctggaccggctggtgaaggaggccttcaatgagttccagaaggaccagagccggctgaaggagattgagaagcaggatgacatgaccagcttctacaacaccccacccctgggcaagaggggcacctgcagctacctgaccaaggctgtgatgaacctgctgctggagggggaggtgaagcccaacaatgatgacccctgcctgatctcctag

SEQ ID NO: 3344 - DNA, 1221 bp, Artificial Sequence; identical to SEQ ID NO: 3339
  Description of Artificial Sequence: Synthetic coding sequence

SEQ ID NO: 3345 - DNA, 1125 bp, Artificial Sequence
  Description of Artificial Sequence: Synthetic coding sequence
atgaccctggatgtgggcccagaagatgagctgcctgactgggccgccgccaaggagttctaccagaagtatgaccccaaggatgtgattggccggggcgtgtcctctgtggtgagaagatgtgtgcaccgggccaccggccacgagtttgctgtgaagatcatggaggtgacagctgagcggctgagccctgagcagctggaggaggtgcgggaggccacccggcgggagacccacatcctgcggcaggtggccggccacccccacatcatcaccctgattgacagctatgagagcagcagcttcatgttcctggtgtttgacctgatgaggaagggggagctgtttgactacctgacagagaaggtggccctgtctgagaaggagaccaggagcatcatgaggagcctgctggaggccgtgtccttcctgcacgccaacaacatcgtgcaccgggacctgaagccagagaacatcctgctggatgacaacatgcagatccggctgagtgactttggcttcagctgccacctggagcccggggagaagctgcgggagctgtgtggcaccccaggctacctggcccctgagatcctgaagtgcagcatggatgagacccaccctggctacggcaaggaggtggacctgtgggcctgtggggtcatcctcttcaccctgctggccggcagcccccccttctggcaccggcggcagatcctgatgctgaggatgatcatggagggccagtaccagttcagcagccctgagtgggatgacaggagcagcacagtgaaggacctgatcagccggctgctgcaggtggaccctgaggcccggctgacagctgagcaggccctgcagcaccccttctttgagcgctgtgagggcagccagccctggaacctgaccccccggcagcgcttccgggtggccgtgtggacagtgctggccgccggccgggtggccctgagcacccaccgggtgcggcccctgaccaagaatgccctgctgcgggacccctatgccctgcggtctgtgcgccacctgattgacaactgtgccttccggctgtatggccactggatcaggaagcagtggattggcaagctgatggcctgtgtgtag

SEQ ID NO: 3346 - DNA, 3999 bp, Artificial Sequence
  Description of Artificial Sequence: Synthetic coding sequence
atgcagcaggccccccagccctatgagttcttcagcgaggagaacagccccaagtggaggggcctgctggtgtctgccctgaggaaggtgcaggagcaggtgcaccccaccctgagcgccaatgaggagagcctgtactacatcgaggagctgatcttccagctgctgaacaagctgtgcatggcccagcccaggacagtgcaggatgtggaggagcgggtgcagaagaccttcccccaccccatcgacaagtgggccatcgcagatgcccagagcgccatcgagaagaggaagagaagaaaccccctgctgctgcctgtggacaagatccaccccagcctgaaggaggtgctgggctacaaggtggactaccacgtgtccctgtacatcgtggccgtgctggagtacatctctgctgacatcctgaagctggccggcaactacgtgttcaacatccgccactatgagatcagccagcaggacatcaaggtgtccatgtgtgccgacaaggtgctgatggacatgtttgaccaggatgacatcggcctggtgtccctgtgtgaagatgagcccagcagcagcggggagctgaactactatgacctggtgaggacagaaattgctgaggagcggcagtacctgcgggagctgaacatgatcatcaaggtgttccgggaggccttcctgagtgacaggaagctgttcaagcccagcgacatcgagaagatcttcagcaacatcagtgacatccacgagctgactgtgaagctgctgggcctgattgaggacacagtggagatgacagatgagagcagcccccaccccctggccggcagctgctttgaggacctggccgaggagcaggcctttgacccctatgagaccctgagccaggacatcctgagccctgagttccacgagcacttcaacaagctgatggcccggcctgctgtggccctgcacttccagagcattgctgatggcttcaaggaggccgtgcgctacgtgctgccccggctgatgctggtgcctgtgtaccactgctggcactactttgagctgctgaagcagctgaaggcctgcagcgaggagcaggaggacagagaatgtctgaaccaggccatcacagccctgatgaacctgcagggctccatggaccgcatctacaagcagtacagcccccggcggcggcctggggaccctgtgtgccccttctacagccaccagctgcggagcaagcacctggccatcaagaagatgaatgagatccagaagaacattgatggctgggagggcaaggacatcggccagtgctgcaatgagttcatcatggagggccccctgaccagaattggagccaagcatgagcggcacatcttcctgtttgatggcctgatgatcagctgcaagcccaaccacggccagacccggctgcccggctacagcagcgctgagtaccgcctgaaggagaagtttgtgatgaggaagatccagatctgtgacaaggaggacacctgtgagcacaagcacgcctttgagctggtgtccaaggatgaaaattccatcatctttgctgccaagtctgctgaggagaagaacaactggatggccgccctgatcagcctgcactaccgcagcaccctggacaggatgctggacagcgtgctgctgaaggaggagaatgagcagcccctgcggctgcccagccctgaggtgtacagatttgtggtgaaggacagcgaggagaacatcgtgtttgaggacaacctgcagagccgcagcggcatccccatcatcaagggcggcaccgtggtgaagctgattgaaaggctgacctaccacatgtatgctgaccccaactttgtgaggaccttcctgaccacctaccgctccttctgcaagccccaggagctgctgagcctgctgattgaaagatttgagatccctgagcctgagcccacagatgctgacaagctggccattgaaaaaggagagcagcccatctctgctgacctgaagcgcttcaggaaggagtatgtgcagcctgtgcagctgcgcatcctgaatgtgttccgccactgggtggagcaccacttctatgactttgagcgggacctggagctgctggagcggctggagagcttcatcagctctgtgcggggcaaggccatgaagaagtgggtggagagcatcgccaagatcatccggaggaagaagcaggcccaggccaacggggtgagccacaacatcacctttgagagccccccaccacccatcgagtggcacatcagcaagccaggccagtttgagacctttgacctgatgaccctgcaccccatcgagatcgcccggcagctgaccctgctggagagtgacctgtacaggaaggtgcagcccagcgagctggtgggctctgtgtggaccaaggaggacaaggagatcaacagccccaacctgctgaagatgatccgccacaccaccaacctgaccctgtggtttgagaagtgcatcgtggaggctgaaaattttgaggagcgggtggccgtgctgagccgcatcatcgagatcctgcaggtgttccaggacctgaacaacttcaatggagtgctggagatcgtgtctgctgtgaacagcgtgtctgtgtaccgcctggaccacacctttgaggccctgcaggagaggaagaggaagatcctggatgaggccgtggagctgagccaggaccacttcaagaagtacctggtgaagctgaagagcatcaaccccccctgtgtgcccttcttcggcatctacctgaccaacatcctgaagacagaggagggcaacaatgacttcctgaagaagaagggcaaggacctgatcaacttcagcaagaggaggaaggtggccgagatcaccggggagatccagcagtaccagaaccagccctactgcctgagaattgaaccagacatgaggcgcttctttgagaacctgaaccccatgggcagcgccagcgagaaggagttcacagactacctgttcaacaagagcctggagattgagcccaggaactgcaagcagcccccacgcttccccaggaagagcaccttcagcctgaagagccctggcatccggcccaacacaggaagacatggcagcaccagcggcaccctgcggggccaccccacccccctggagcgggagccctgcaagatctccttcagcagaattgctgagacagagctggagagcacagtgtctgcccccaccagccccaacacccccagcaccccacctgtgtctgccagcagtgacctgtctgtgttcctggatgtggacctgaacagcagctgtggcagcaacagcatctttgcccctgtgctgctgccccacagcaagagcttcttcagcagctgtggcagcctgcacaagctgtctgaggagcccctcatccccccacccctgccccccaggaagaagtttgaccatgatgccagcaacagcaaaggaaacatgaagagtgatgatgaccccccagccatccccccccggcagcccccaccacccaaggtgaagccccgggtgcctgtgcccactggagcctttgatggccccctgcacagccccccacctcctccaccccgggaccccctgcctgacaccccacctcctgtgcccctgcggcccccagagcacttcatcaactgccccttcaacctgcagcccccacccctgggccacctgcaccgggacagcgactggctgcgggacatcagcacctgccccaacagccccagcaccccacccagcacccccagcccccgggtgccccggcgctgctacgtgctgagcagcagccagaacaacctggcccaccccccagcccctcctgtgcccccccggcagaacagcagcccccacctgcccaagctgccccccaagacctacaagcgggagctgagccacccccccctgtaccgcctgcccctgctggagaatgctgagaccccccagtag

SEQ ID NO: 3347 - DNA, 2442 bp, Artificial Sequence
  Description of Artificial Sequence: Synthetic coding sequence
atggccaagcccctgacagaccaggagaagaggcggcagatcagcatccggggcatcgtgggcgtggagaatgtggccgagctgaagaagagcttcaacagacacctgcacttcaccctggtgaaggacagaaatgtggccaccacccgggactactactttgccctggcccacacagtgcgggaccacctggtgggccgctggatccgcacccagcagcactactatgacaagtgccccaagctgggcctggacatcgaggagctggaggagattgaggaggatgctggcctgggcaatggaggcctgggccgcctggccgcctgcttcctggacagcatggccaccctgggcctggccgcctacggctacggcatccgctatgaatatggcatcttcaaccagaagatcagagatggctggcaggtggaggaggctgatgactggctgcgctatggcaacccctgggagaagagcaggcctgagttcatgctgcctgtgcacttctacggcaaggtggagcacaccaacacaggcaccaagtggattgacacccaggtggtgctggccctgccctatgacacccctgtgcccggctacatgaacaacacagtgaacaccatgaggctgtggagcgcccgggccccaaatgacttcaacctgcgggacttcaacgtgggggactacatccaggccgtgctggacaggaacctggccgagaacatcagccgggtgctgtacccaaatgacaacttctttgagggcaaggagctgcggctgaagcaggagtactttgtggtggccgccaccctgcaggacatcatccgccgcttcaaggccagcaagtttggcagcaccagaggagctggcaccgtgtttgatgccttcccagaccaggtggccatccagctgaatgacacccacccagccctggccatccctgagctgatgaggatctttgtggacatcgagaagctgccctggagcaaggcctgggagctgacccagaagacctttgcctacaccaaccacacagtgctgcctgaggccctggagcgctggcctgtggacctggtggagaagctgctgcccaggcacctggagatcatctatgagatcaaccagaagcacctggacagaattgtggccctcttccccaaggatgtggaccggctgcggaggatgagcctcatcgaggaggagggcagcaagaggatcaacatggcccacctgtgcatcgtgggcagccatgctgtgaatggagtggccaagatccacagcgacatcgtgaagaccaaggtgttcaaggacttcagcgagctggagccagacaagttccagaacaagaccaacggcatcaccccccggcgctggctgctgctgtgcaaccctggcctggccgagctgattgctgagaagatcggggaggactatgtgaaggacctgagccagctgaccaagctgcacagcttcctgggagatgatgtgttcctgcgggagctggccaaggtgaagcaggagaacaagctgaagttcagccagttcctggagacagagtacaaggtgaagatcaaccccagctccatgtttgatgtgcaggtgaagaggatccacgagtacaagaggcagctgctgaactgcctgcacgtgatcaccatgtacaaccgcatcaagaaggaccccaagaagctgtttgtgcccaggacagtcatcatcggcggcaaggccgcccctggctaccacatggccaagatgatcatcaagctgatcacctctgtggctgatgtggtgaacaatgaccccatggtgggcagcaagctgaaggtgatcttcctggagaactacagagtgtccctggccgagaaggtgatcccagccacagacctgtctgagcagatcagcacagctggaacagaggccagcggcactggaaacatgaagttcatgctgaatggagccctgaccatcggcaccatggatggagccaacgtggagatggccgaggaggccggggaggagaacctcttcatcttcggcatgagaattgatgatgtggccgccctggacaagaagggctatgaggccaaggagtactatgaggccctgcctgagctgaagctggtgattgaccagattgacaatggcttcttcagccccaagcagcctgacctcttcaaggacatcatcaacatgctgttctaccatgaccgcttcaaggtgtttgctgactatgaggcctacgtgaagtgccaggacaaggtgtcccagctgtacatgaaccccaaggcctggaacaccatggtgctgaagaacattgctgccagcggcaagttcagcagtgacaggaccatcaaggagtatgcccagaacatctggaatgtggagcccagcgacctgaagatcagcctgagcaatgaaagcaacaaggtgaatggaaattag

SEQ ID NO: 3348 - DNA, 2433 bp, Artificial Sequence
  Description of Artificial Sequence: Synthetic coding sequence
atggagcacaaggaggtggtgctgctgctgctgctcttcctgaagagcggccagggcgagcccctggatgattatgtgaacacccagggcgccagcctcttctctgtgaccaagaagcagctgggcgccggcagcattgaggagtgtgccgccaagtgtgaagaagatgaggagttcacctgccgggccttccagtaccacagcaaggagcagcagtgtgtgatcatggccgagaacaggaagagcagcatcatcatccgcatgagagatgtggtgctgtttgagaagaaggtgtacctgtctgagtgcaagacaggaaatggcaagaactaccggggcaccatgagcaagaccaagaatggcatcacctgccagaagtggagcagcaccagcccccaccggccccgcttctccccagccacccaccccagcgagggcctggaggagaactactgcagaaatccagacaatgacccccagggcccctggtgctacaccacagatcctgagaagagatatgactactgtgacatcctggagtgtgaggaggagtgcatgcactgcagcggagaaaattatgatggcaagatcagcaagaccatgagcggcctggagtgccaggcctgggacagccagagcccccacgcccacggctacatccccagcaagttccccaacaagaacctgaagaagaactactgcagaaatccagaccgggagctgcggccctggtgcttcaccacagaccccaacaagcgctgggagctgtgtgacatcccccgctgcaccaccccaccacccagcagcggccccacctaccagtgcctgaagggcactggagagaactacagaggaaatgtggccgtgacagtgtctggccacacctgccagcactggagcgcccagaccccccacacccacaacagaacacctgagaacttcccctgcaagaacctggatgagaactactgcagaaatccagatggcaagagggccccctggtgccacaccaccaacagccaggtgcgctgggagtactgcaagatccccagctgtgacagcagccctgtgtccacagagcagctggcccccacagcccctcctgagctgacccctgtggtgcaggactgctaccatggagatggccagagctaccggggcaccagcagcaccaccaccaccgggaagaagtgccagagctggagctccatgaccccccaccgccaccagaagaccccagagaactacccaaatgccggcctgaccatgaactactgcagaaatccagatgctgacaagggcccctggtgcttcaccacagaccccagcgtgcgctgggagtactgcaacctgaagaagtgcagcggcacagaggcctctgtggtggcccctcctcctgtggtgctgctgcctgatgtggagaccccatctgaggaggactgcatgtttggaaatggcaagggctaccggggcaagagggccaccaccgtgacaggcaccccctgccaggactgggccgcccaggagccccaccgccacagcatcttcaccccagagaccaacccccgggccggcctggagaagaactactgcaggaacccagatggagatgtgggcggcccctggtgctacaccaccaaccccaggaagctgtatgactactgtgatgtgccccagtgtgccgcccccagctttgactgtgggaagccccaggtggagcccaagaagtgccccggccgggtggtgggcggctgtgtggcccacccccacagctggccctggcaggtgtccctgcggacccgcttcggcatgcacttctgtggcggcaccctcatcagccctgagtgggtgctgacagctgcccactgcctggagaagagcccccggcccagcagctacaaggtgatcctgggcgcccaccaggaggtgaacctggagccccacgtgcaggagattgaggtgagccgcctcttcctggagcccaccaggaaggacatcgccctgctgaagctgagcagccctgctgtgatcacagacaaggtgatcccagcctgcctgcccagccccaactacgtggtggccgacagaacagagtgcttcatcaccggctggggcgagacccagggcacctttggagctggcctgctgaaggaggcccagctgcctgtgattgagaacaaggtgtgcaacagatatgagttcctgaatggccgggtgcagagcacagagctgtgtgccggccacctggccggcggcacagacagctgccagggcgacagcggcggccccctggtgtgctttgagaaggacaagtacatcctgcagggcgtgacctcctggggcctgggctgtgcccggcccaacaagccaggagtgtatgtgcgggtgtccagatttgtgacctggattgaaggagtgatgaggaacaactag

SEQ ID NO: 3349 - DNA, 633 bp, Artificial Sequence
  Description of Artificial Sequence: Synthetic coding sequence
cgcttcggcatgcacttctgtggcggcaccctcatcagccctgagtgggtgctgacagctgcccactgcctggagaagagcccccggcccagcagctacaaggtgatcctgggcgcccaccaggaggtgaacctggagccccacgtgcaggagattgaggtgagccgcctcttcctggagcccaccaggaaggacatcgccctgctgaagctgagcagccctgctgtgatcacagacaaggtgatcccagcctgcctgcccagccccaactacgtggtggccgacagaacagagtgcttcatcaccggctggggcgagacccagggcacctttggagctggcctgctgaaggaggcccagctgcctgtgattgagaacaaggtgtgcaacagatatgagttcctgaatggccgggtgcagagcacagagctgtgtgccggccacctggccggcggcacagacagctgccagggcgacagcggcggccccctggtgtgctttgagaaggacaagtacatcctgcagggcgtgacctcctggggcctgggctgtgcccggcccaacaagccaggagtgtatgtgcgggtgtccagatttgtgacctggattgaaggagtgatgaggaacaactag

SEQ ID NO: 3350 - DNA, 411 bp, Artificial Sequence
  Description of Artificial Sequence: Synthetic coding sequence
atggagcacaaggaggtggtgctgctgctgctgctcttcctgaagagcggccagggcgagcccctggatgattatgtgaacacccagggcgccagcctcttctctgtgaccaagaagcagctgggcgccggcagcattgaggagtgtgccgccaagtgtgaagaagatgaggagttcacctgccgggccttccagtaccacagcaaggagcagcagtgtgtgatcatggccgagaacaggaagagcagcatcatcatccgcatgagagatgtggtgctgtttgagaagaaggtgtacctgtctgagtgcaagacaggaaatggcaagaactaccggggcaccatgagcaagaccaagaatggcatcacctgccagaagtggagcagcaccagcccccaccggcccaggtag

SEQ ID NO: 3351 - DNA, 945 bp, Artificial Sequence
  Description of Artificial Sequence: Synthetic coding sequence
atgggcatcggccgctctgagggcggcagaagaggagctgccctgggcgtgctgctggccctgggcgccgccctgctggccgtgggcagcgcctctgaatatgactatgtgtccttccagagcgacatcggcccctaccagagcggccgcttctacaccaagccaccccagtgtgtggacatcccagctgacctgcggctgtgccacaacgtgggctacaagaagatggtgctgcccaacctgctggagcacgagaccatggccgaggtgaagcagcaggccagctcctgggtgcccctgctgaacaagaactgccacgccggcacccaggtgttcctgtgcagcctgtttgcccctgtgtgcctggaccggcccatctacccctgccgctggctgtgtgaggccgtgcgggacagctgtgagcctgtgatgcagttcttcggcttctactggccagagatgctgaagtgtgacaagtttcctgaaggagatgtgtgcatcgccatgaccccaccaaatgccacagaggccagcaagccccagggcaccaccgtgtgccccccctgtgacaatgagctgaagtctgaggccatcatcgagcacctgtgtgccagcgagtttgccctgaggatgaagatcaaggaggtgaagaaggaaaatggagacaagaagatcgtgcccaagaagaagaagcccctgaagctgggccccatcaagaagaaggacctgaagaagctggtgctgtacctgaagaatggagctgactgcccctgccaccagctggacaacctgagccaccacttcctgatcatgggcaggaaggtgaagagccagtacctgctgacagccatccacaagtgggacaagaagaacaaggagttcaagaacttcatgaagaagatgaagaaccatgaatgtcccaccttccagagcgtcttcaagtag

SEQ ID NO: 3352 - DNA, 882 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattgacacccgggccacctgctatgaggaccagggcatctcctaccggggcacctggagcacagctgagagcggggctgaatgtaccaactggaacagcagcgccctggcccagaagccctacagcggccggcggccagatgccatccggctgggcctgggcaaccacaactactgcaggaacccagaccgggacagcaagccctggtgctacgtgttcaaggccggcaagtacagcagcgagttctgcagcaccccagcctgcagcgagggcaacagcgactgctactttggaaatggaagtgcctaccggggcacccacagcctgacagagagcggggccagctgcctgccctggaacagcatgatcctgattggcaaggtgtacacagcccagaaccccagcgcccaggccctgggcctgggcaagcacaactactgccgctgcaggacaggccgctctgtgagcagccctgccacagcctccatgaggccctgcctgctgagcatccgcagcggctag

SEQ ID NO: 3353 - DNA, 1551 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccagggctgcagcgagccccgctgcttcaatggaggcacctgccagcaggccctgtacttcagtgactttgtgtgccagtgcccagagggctttgctgggaagtgctgtgaaattgacacccgggccacctgctatgaggaccagggcatctcctaccggggcacctggagcacagctgagagcggggctgaatgtaccaactggaacagcagcgccctggcccagaagccctacagcggccggcggccagatgccatccggctgggcctgggcaaccacaactactgcaggaacccagaccgggacagcaagccctggtgctacgtgttcaaggccggcaagtacagcagcgagttctgcagcaccccagcctgcagcgagggcaacagcgactgctactttggaaatggaagtgcctaccggggcacccacagcctgacagagagcggggccagctgcctgccctggaacagcatgatcctgattggcaaggtgtacacagcccagaaccccagcgcccaggccctgggcctgggcaagcacaactactgcaggaacccagatggagatgccaagccctggtgccacgtgctgaagaacagaaggctgacctgggagtactgtgatgtgcccagctgcagcacctgtggcctgcggcagtacagccagccccagttccgcatcaagggcggcctgtttgctgacatcgccagccacccctggcaggccgccatctttgccaagcacagaagaagccctggagagcgcttcctgtgtggcggcatcctgatcagcagctgctggatcctgtctgctgcccactgcttccaggagcgcttccccccccaccacctgaccgtcatcctgggccgcacctacagagtggtgcctggagaggaggagcagaagtttgaggtggagaagtacatcgtgcacaaggagtttgatgatgacacctatgacaatgacatcgccctgctgcagctgaagagtgacagcagccgctgtgcccaggagagctctgtggtgaggacagtgtgcctgcccccagctgacctgcagctgcctgactggacagaatgtgagctgagcggctacggcaagcatgaggccctgagccccttctacagcgagcggctgaaggaggcccacgtgcggctgtaccccagcagccgctgcaccagccagcacctgctgaacagaacagtgacagacaacatgctgtgtgccggggacaccaggtctgggggcccccaggccaacctgcatgatgcctgccagggcgacagcggcggccccctggtgtgcctgaatgatggccgcatgaccctggtgggcatcatctcctggggcctgggctgcggccagaaggatgtgcctggggtgtacaccaaggtgaccaactacctggactggatccgggacaacatgaggccctag

SEQ ID NO: 3354 - DNA, 1689 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattgacacccgggccacctgctatgaggaccagggcatctcctaccggggcacctggagcacagctgagagcggggctgaatgtaccaactggaacagcagcgccctggcccagaagccctacagcggccggcggccagatgccatccggctgggcctgggcaaccacaactactgcaggaacccagaccgggacagcaagccctggtgctacgtgttcaaggccggcaagtacagcagcgagttctgcagcaccccagcctgcagcgagggcaacagcgactgctactttggaaatggaagtgcctaccggggcacccacagcctgacagagagcggggccagctgcctgccctggaacagcatgatcctgattggcaaggtgtacacagcccagaaccccagcgcccaggccctgggcctgggcaagcacaactactgcaggaacccagatggagatgccaagccctggtgccacgtgctgaagaacagaaggctgacctgggagtactgtgatgtgcccagctgcagcacctgtggcctgcggcagtacagccagccccagttccgcatcaagggcggcctgtttgctgacatcgccagccacccctggcaggccgccatctttgccaagcacagaagaagccctggagagcgcttcctgtgtggcggcatcctgatcagcagctgctggatcctgtctgctgcccactgcttccaggagcgcttccccccccaccacctgaccgtcatcctgggccgcacctacagagtggtgcctggagaggaggagcagaagtttgaggtggagaagtacatcgtgcacaaggagtttgatgatgacacctatgacaatgacatcgccctgctgcagctgaagagtgacagcagccgctgtgcccaggagagctctgtggtgaggacagtgtgcctgcccccagctgacctgcagctgcctgactggacagaatgtgagctgagcggctacggcaagcatgaggccctgagccccttctacagcgagcggctgaaggaggcccacgtgcggctgtaccccagcagccgctgcaccagccagcacctgctgaacagaacagtgacagacaacatgctgtgtgccggggacaccaggtctgggggcccccaggccaacctgcatgatgcctgccagggcgacagcggcggccccctggtgtgcctgaatgatggccgcatgaccctggtgggcatcatctcctggggcctgggctgcggccagaaggatgtgcctggggtgtacaccaaggtgaccaactacctggactggatccgggacaacatgaggccctag

SEQ ID NO: 3355 - DNA, 1311 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagaggaacagcgactgctactttggaaatggaagtgcctaccggggcacccacagcctgacagagagcggggccagctgcctgccctggaacagcatgatcctgattggcaaggtgtacacagcccagaaccccagcgcccaggccctgggcctgggcaagcacaactactgcaggaacccagatggagatgccaagccctggtgccacgtgctgaagaacagaaggctgacctgggagtactgtgatgtgcccagctgcagcacctgtggcctgcggcagtacagccagccccagttccgcatcaagggcggcctgtttgctgacatcgccagccacccctggcaggccgccatctttgccaagcacagaagaagccctggagagcgcttcctgtgtggcggcatcctgatcagcagctgctggatcctgtctgctgcccactgcttccaggagcgcttccccccccaccacctgaccgtcatcctgggccgcacctacagagtggtgcctggagaggaggagcagaagtttgaggtggagaagtacatcgtgcacaaggagtttgatgatgacacctatgacaatgacatcgccctgctgcagctgaagagtgacagcagccgctgtgcccaggagagctctgtggtgaggacagtgtgcctgcccccagctgacctgcagctgcctgactggacagaatgtgagctgagcggctacggcaagcatgaggccctgagccccttctacagcgagcggctgaaggaggcccacgtgcggctgtaccccagcagccgctgcaccagccagcacctgctgaacagaacagtgacagacaacatgctgtgtgccggggacaccaggtctgggggcccccaggccaacctgcatgatgcctgccagggcgacagcggcggccccctggtgtgcctgaatgatggccgcatgaccctggtgggcatcatctcctggggcctgggctgcggccagaaggatgtgcctggggtgtacaccaaggtgaccaactacctggactggatccgggacaacatgaggccctag

SEQ ID NO: 3356 - DNA, 1500 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattgacagcaagccctggtgctacgtgttcaaggccggcaagtacagcagcgagttctgcagcaccccagcctgcagcgagggcaacagcgactgctactttggaaatggcagcgcctaccggggcacccacagcctgacagaaagtggggccagctgcctgccctggaacagcatgatcctgattggcaaggtgtacacagcccagaaccccagcgcccaggccctgggcctgggcaagcacaactactgcagaaatccagatggagatgccaagccctggtgccacgtgctgaagaacagaaggctgacctgggagtactgtgatgtgcccagctgcagcacctgtggcctgcggcagtacagccagccccagttccgcatcaagggcggcctgtttgctgacatcgccagccacccctggcaggccgccatctttgccaagcaccggcgcagccctggagagcgcttcctgtgtggcggcatcctgatcagcagctgctggatcctgtctgctgcccactgcttccaggagcgcttccccccccaccacctgaccgtcatcctgggccgcacctacagagtggtgcctggagaggaggagcagaagtttgaggtggagaagtacatcgtgcacaaggagtttgatgatgacacctatgacaatgacatcgccctgctgcagctgaagagtgacagcagccgctgtgcccaggagagctctgtggtgaggacagtgtgcctgcccccagctgacctgcagctgcctgactggacagaatgtgagctgagcggctacggcaagcatgaggccctgagccccttctacagcgagcggctgaaggaggcccacgtgcggctgtaccccagcagccgctgcaccagccagcacctgctgaacagaacagtgacagacaacatgctgtgtgccggggacaccaggtctgggggcccccaggccaacctgcatgatgcctgccagggcgacagcggcggccccctggtgtgcctgaatgatggccgcatgaccctggtgggcatcatctcctggggcctgggctgcggccagaaggatgtgcctggggtgtacaccaaggtgaccaactacctggactggatccgggacaacatgaggccctag

SEQ ID NO: 3357 - DNA, 537 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattgacacccgggccacctgctatgaggaccagggcatctcctaccggggcacctggagcacagctgagagcggggctgaatgtaccaactggaacagcagcgccctggcccagaagccctacagcggccggcggccagatgccatccggctgggcctgggcaaccacaactactag

SEQ ID NO: 3358 - DNA, 474 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattgacacccgggccacctgctatgaggaccagggcatctcctaccggggcacctggagcacagctgagagcggggctgaatgtaccaactggaacagcagcgccctggcctag

SEQ ID NO: 3359 - DNA, 1422 bp, Artificial Sequence
  Description of Artificial Sequence: Synthetic coding sequence
atggatgccatgaagaggggcctgtgctgcgtgctgctgctgtgtggggctgtgtttgtgagccccagccaggagatccacgcccgcttcagaagaggagcccggagctaccaggtgatctgcagagatgagaagacccagatgatctaccagcagcaccagagctggctgcggcctgtgctgcggagcaacagagtggagtactgctggtgcaacagcggccgggcccagtgccacagcgtgcctgtgaagagctgcagcgagccccgctgcttcaatggaggcacctgccagcaggccctgtacttcagtgactttgtgtgccagtgcccagagggctttgctgggaagtgctgtgaaattggcaacagcgactgctactttggaaatggcagcgcctaccggggcacccacagcctgacagaaagtggggccagctgcctgccctggaacagcatgatcctgattggcaaggtgtacacagcccagaaccccagcgcccaggccctgggcctgggcaagcacaactactgcagaaatccagatggagatgccaagccctggtgccacgtgctgaagaacagaaggctgacctgggagtactgtgatgtgcccagctgcagcacctgtggcctgcggcagtacagccagccccagttccgcatcaagggcggcctgtttgctgacatcgccagccacccctggcaggccgccatctttgccaagcaccggcgcagccctggagagcgcttcctgtgtggcggcatcctgatcagcagctgctggatcctgtctgctgcccactgcttccaggagcgcttccccccccaccacctgaccgtcatcctgggccgcacctacagagtggtgcctggagaggaggagcagaagtttgaggtggagaagtacatcgtgcacaaggagtttgatgatgacacctatgacaatgacatcgccctgctgcagctgaagagtgacagcagccgctgtgcccaggagagctctgtggtgaggacagtgtgcctgcccccagctgacctgcagctgcctgactggacagaatgtgagctgagcggctacggcaagcatgaggccctgagccccttctacagcgagcggctgaaggaggcccacgtgcggctgtaccccagcagccgctgcaccagccagcacctgctgaacagaacagtgacagacaacatgctgtgtgccggggacaccaggtctgggggcccccaggccaacctgcatgatgcctgccagggcgacagcggcggccccctggtgtgcctgaatgatggccgcatgaccctggtgggcatcatctcctggggcctgggctgcggccagaaggatgtgcctggggtgtacaccaaggtgaccaactacctggactggatccgggacaacatgaggccctag

SEQ ID NO: 3360 - DNA, 1083 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcgtgggcgtggagagcaacagtgatggagccagccctgagccctgcaccgtgaccccaggagctgtgaagctggagaaggagaagctggagcagaaccctgaggagagccaggacatcaaggccctgcagaaggagctggagcagtttgccaagctgctgaagcagaagaggatcaccctgggctacacccaggctgatgtgggcctgaccctgggcgtgctgtttgggaaggtgttcagccagaccaccatctgccgctttgaggccctgcagctgtccttcaagaacatgtgcaagctgcggcccctgctgcagaagtgggtggaggaggccgacaacaatgaaaacctgcaggagatctgcaaggccgagaccctggtgcaggccaggaagaggaagaggaccagcattgagaacagagtgcggggcaacctggagaacctcttcctgcagtgccccaagcccaccctgcagcagatcagccacatcgcccagcagctgggcctggagaaggatgtggtgcgggtgtggttctgcaacagacggcagaagggcaagaggagcagcagtgactatgcccagcgggaggactttgaggccgccggcagccccttcagcggcggccctgtgtccttccccctggcccctggcccccacttcggcaccccaggctacggcagcccccacttcaccgccctgtacagctctgtgcccttccctgagggggaggccttcccccctgtgtctgtgaccaccctgggcagccccatgcacagcaactag

SEQ ID NO: 3361 - DNA, 798 bp, Artificial Sequence
  Description of Artificial Sequence: Synthetic coding sequence
atgcacttctaccgcctcttcctgggcgccacccggcgcttcctgaaccctgagtggaagggggagattgacaactggtgtgtgtatgtgctgaccagcctgctgcccttcaagatccagagccaggacatcaaggccctgcagaaggagctggagcagtttgccaagctgctgaagcagaagaggatcaccctgggctacacccaggctgatgtgggcctgaccctgggcgtgctgtttgggaaggtgttcagccagaccaccatctgccgctttgaggccctgcagctgtccttcaagaacatgtgcaagctgcggcccctgctgcagaagtgggtggaggaggccgacaacaatgaaaacctgcaggagatctgcaaggccgagaccctggtgcaggccaggaagaggaagaggaccagcattgaaaatagagtgcggggcaacctggagaacctcttcctgcagtgccccaagcccaccctgcagcagatcagccacatcgcccagcagctgggcctggagaaggatgtggtgcgggtgtggttctgcaacagacggcagaagggcaagaggagcagcagtgactatgcccagagagaagattttgaagctgctggcagccccttcagcggcggccctgtgtccttccccctggcccctggcccccacttcggcaccccaggctacggcagcccccacttcaccgccctgtacagctctgtgcccttccctgagggggaggccttcccccctgtgtctgtgaccaccctgggcagccccatgcacagcaactag

SEQ ID NO: 3362 - DNA, 1083 bp, Artificial Sequence; identical to SEQ ID NO: 3360
  Description of Artificial Sequence: Synthetic coding sequence

SEQ ID NO: 3363 - DNA, 798 bp, Artificial Sequence; identical to SEQ ID NO: 3361
  Description of Artificial Sequence: Synthetic coding sequence

SEQ ID NO: 3364 - DNA, 798 bp, Artificial Sequence; identical to SEQ ID NO: 3361
  Description of Artificial Sequence: Synthetic coding sequence

SEQ ID NO: 3365 - DNA, 1083 bp, Artificial Sequence; identical to SEQ ID NO: 3360
  Description of Artificial Sequence: Synthetic coding sequence

SEQ ID NO: 3366 - DNA, 1083 bp, Artificial Sequence; identical to SEQ ID NO: 3360
  Description of Artificial Sequence: Synthetic coding sequence

SEQ ID NO: 3367 - DNA, 798 bp, Artificial Sequence; identical to SEQ ID NO: 3361
  Description of Artificial Sequence: Synthetic coding sequence

SEQ ID NO: 3368 - DNA, 1083 bp, Artificial Sequence; identical to SEQ ID NO: 3360
  Description of Artificial Sequence: Synthetic coding sequence

SEQ ID NO: 3369 - DNA, 369 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcggcggggagcagctgcgctggggcctgcccggggccctgcaccgccacccctggtgccgggaggcctag

SEQ ID NO: 3370 - DNA, 798 bp, Artificial Sequence; identical to SEQ ID NO: 3361
  Description of Artificial Sequence: Synthetic coding sequence

SEQ ID NO: 3371 - DNA, 1083 bp, Artificial Sequence; identical to SEQ ID NO: 3360
  Description of Artificial Sequence: Synthetic coding sequence

SEQ ID NO: 3372 - DNA, 372 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcgtgggcgtggagacccccatgggccccccaagaagccctgccccccaccccttccccttccccctgctgtag

SEQ ID NO: 3373 - DNA, 558 bp, Artificial Sequence
  Description of Artificial Sequence: Synthetic coding sequence
atggccggccacctggccagtgactttgccttcagccccccacctgggggcggcggagatggccctgggggccctgagcccggctgggtggaccccaggacctggctgtccttccagggccccccaggcggccctggcatcggccctggggtgggccctggcagcgaggtgtggggcatccccccctgccccccaccctatgagttctgtggcggcatggcctactgcggcccccaggtgggcgtgggcctggtgccccagggcggcctggagaccagccagcctgagggggaggccggcgtgggcgtggagagcaacagtgatggagccagccctgagccctgcaccgtgaccccaggagctgtgaagctggagaaggagaagctggagcagaaccctgaggagagccaggacatcaaggccctgcagaaggagctggagcagtttgccaagctgctgaagcagaagaggatcaccctgggctacacccaggctgatgtgcaccctgggggcagcatctgggagggcatccagcccaatgaccacctgcccctgtag

SEQ ID NO: 3374 - DNA, 372 bp, Artificial Sequence; identical to SEQ ID NO: 3372
  Description of Artificial Sequence: Synthetic coding sequence

SEQ ID NO: 3375 - DNA, 558 bp, Artificial Sequence; identical to SEQ ID NO: 3373
  Description of Artificial Sequence: Synthetic coding sequence

SEQ ID NO: 3376 - DNA, 372 bp, Artificial Sequence; identical to SEQ ID NO: 3372
  Description of Artificial Sequence: Synthetic coding sequence

SEQ ID NO: 3377 - DNA, 558 bp, Artificial Sequence; identical to SEQ ID NO: 3373
  Description of Artificial Sequence: Synthetic coding sequence

SEQ ID NO: 3378 - DNA, 558 bp, Artificial Sequence; identical to SEQ ID NO: 3373
  Description of Artificial Sequence: Synthetic coding sequence

SEQ ID NO: 3379 - DNA, 372 bp, Artificial Sequence; identical to SEQ ID NO: 3372
  Description of Artificial Sequence: Synthetic coding sequence

SEQ ID NO: 3380 - DNA, 372 bp, Artificial Sequence; identical to SEQ ID NO: 3372
  Description of Artificial Sequence: Synthetic coding sequence

SEQ ID NO: 3381 - DNA, 2079 bp, Artificial Sequence
  Description of Artificial Sequence: Synthetic coding sequence
atgggcaccgtgagcagcagaagatcctggtggcccctgcccctgctgctgctgctgctgctgctgctgggccctgctggggcccgggcccaggaggatgaagatggagactatgaggagctggtgctggccctgcggagtgaagaagatggcctggccgaggcccctgagcacggcaccacagccaccttccaccgctgtgccaaggacccctggaggctgcccggcacctacgtggtggtgctgaaggaggagacccacctgagccagagcgagaggacagcccggcggctgcaggcccaggccgcccggcggggctacctgaccaagatcctgcacgtgttccacggcctgctgcccggcttcctggtgaagatgtctggggacctgctggagctggccctgaagctgccccacgtggactacatcgaggaggacagctctgtgtttgcccagagcatcccctggaacctggagcgcatcaccccaccccgctacagagcagatgagtaccagcccccagatggcggcagcctggtggaggtgtacctgctggacaccagcatccagagcgaccaccgggagattgagggccgggtgatggtgacagactttgaaaatgtgcctgaagaagatggcacccgcttccaccggcaggccagcaaatgtgacagccacggcacccacctggccggcgtggtgtctggaagagatgctggggtggccaagggggcctccatgaggagcctgcgggtgctgaactgccagggcaagggcaccgtgtctggcaccctcatcggcctggagttcatcaggaagagccagctggtgcagcctgtgggccccctggtggtgctgctgcccctggccggcggctacagccgggtgctgaatgctgcctgccagaggctggcccgggccggcgtggtgctggtgacagctgctggcaacttcagagatgatgcctgcctgtacagccctgccagcgcccctgaggtgatcaccgtgggcgccaccaatgcccaggaccagcctgtgaccctgggcaccctgggcaccaactttggccgctgtgtggacctgtttgcccctggagaggacatcattggagccagcagtgactgcagcacctgctttgtgtcccagagcggcaccagccaggccgccgcccacgtggccggcattgctgccatgatgctgtctgctgagcctgagctgaccctggccgagctgcggcagaggctcatccacttcagcgccaaggatgtgatcaatgaggcctggttccctgaggaccagagggtgctgacccccaacctggtggccgccctgccccccagcacccatggagctggctggcagctgttctgcaggacagtgtggagcgcccacagcggccccaccaggatggccacagctgtggcccgctgtgccccagatgaggagctgctgagctgcagcagcttcagccgcagcggcaagagaagaggagagaggatggaggcccagggcggcaagctggtgtgccgggcccacaatgcctttggaggagaaggagtgtatgccatcgcccgctgctgcctgctgccccaggccaactgcagcgtgcacacagcccccccagctgaggcctccatgggcaccagggtgcactgccaccagcagggccacgtgctgaccggctgcagcagccactgggaggtggaggacctgggcacccacaagccccctgtgctgcggccccggggccagcccaaccagtgtgtgggccaccgggaggccagcatccacgccagctgctgccacgcccctggcctggagtgcaaggtgaaggagcacggcatcccagccccccaggagcaggtgacagtggcctgtgaggagggctggaccctgaccggctgcagcgccctgcccggcaccagccacgtgctgggcgcctatgctgtggacaacacctgtgtggtgcgcagcagagatgtgtccaccaccggcagcaccagcgagggcgctgtgacagctgtggccatctgctgccgcagccgccacctggcccaggccagccaggagctgcagtag

SEQ ID NO: 3382 - DNA, 618 bp, Artificial Sequence
  Description of Artificial Sequence: Synthetic coding sequence
atgggcaccgtgagcagcagaagatcctggtggcccctgcccctgctgctgctgctgctgctgctgctgggccctgctggggcccgggcccaggaggatgaagatggagactatgaggagctggtgctggccctgcggagtgaagaagatggcctggccgaggcccctgagcacggcaccacagccaccttccaccgctgtgccaaggacccctggaggctgcccggcacctacgtggtggtgctgaaggaggagacccacctgagccagagcgagaggacagcccggcggctgcaggcccaggccgcccggcggggctacctgaccaagatcctgcacgtgttccacggcctgctgcccggcttcctggtgaagatgtctggggacctgctggagctggccctgaagctgccccacgtggactacatcgaggaggacagctctgtgtttgcccagagcatcccctggaacctggagcgcatcaccccaccccgctacagagcagatgagtaccagcccccagcctacctggaggaccactgcggcggccacagaggagctgtgcagatggccctgcagaagacccaggagaccctgggccaggagcagtttgattag

SEQ ID NO: 3383 - DNA, 801 bp, Artificial Sequence
  Description of Artificial Sequence: Synthetic coding sequence
atggtgacagactttgaaaatgtgcctgaagaagatggcacccgcttccaccggcaggccagcaaatgtgacagccacggcacccacctggccggcgtggtgtctggaagagatgctggggtggccaagggggcctccatgaggagcctgcgggtgctgaactgccagggcaagggcaccgtgtctggcaccctcatcggcctggagttcatcaggaagagccagctggtgcagcctgtgggccccctggtggtgctgctgcccctggccggcggctacagccgggtgctgaatgctgcctgccagaggctggcccgggccggcgtggtgctggtgacagctgctggcaacttcagagatgatgcctgcctgtacagccctgccagcgcccctgaggtgatcaccgtgggcgccaccaatgcccaggaccagcctgtgaccctgggcaccctgggcaccaactttggccgctgtgtggacctgtttgcccctggagaggacatcattggagccagcagtgactgcagcacctgctttgtgtcccagagcggcaccagccaggccgccgcccacgtggccggcattgctgccatgatgctgtctgctgagcctgagctgaccctggccgagctgcggcagaggctcatccacttcagcgccaaggatgtgatcaatgaggcctggttccctgaggaccagagggtgggcagctgctttgctggcctgtatggccagcacacccggggcctgcacggctggccccagcccagccctgctgccccccagatgaggagctgctag

SEQ ID NO: 3384 - DNA, 3972 bp, Artificial Sequence
  Description of Artificial Sequence: Synthetic coding sequence
atggaggatggcggcctgacagcctttgaggaggaccagcgctgcctgagccagagcctgcccctgcctgtgtctgctgagggccctgctgcccagaccacagctgagcccagccgctccttcagcagcgcccaccgccacctgagcagaagaaatggcctgagccggctgtgccagagcaggacagccctgtctgaggaccgctggagcagctactgcctgagcagcctggccgcccagaacatctgcaccagcaagctgcactgcccagctgcccctgagcacacagaccccagcgagccccggggctctgtgtcctgctgcagcctgctgcggggcctgagcagcggctggagcagccccctgctgcctgcccctgtgtgcaaccccaacaaggccatcttcaccgtggatgccaagaccacagagatcctggtggccaatgacaaggcctgtggcctgctgggctacagcagccaggacctgattggccagaagctgacccagttcttcctgcggagtgacagtgatgtggtggaggccctgtctgaggagcacatggaggctgatggccatgctgctgtggtgtttggaacagtggtggacatcatcagccgctctggagagaagatccctgtgtctgtgtggatgaagaggatgaggcaggagcggcggctgtgctgcgtggtggtgctggagcctgtggagcgggtgtccacctgggtggccttccagagtgatggcaccgtgaccagctgtgacagcctgtttgcccacctgcacggctacgtgtctggagaagatgtggccggccagcacatcacagacctgatccccagcgtgcagctgccccccagcggccagcacatccccaagaacctgaagatccagaggtctgtgggccgggccagagatggcaccaccttccccctgagcctgaagctgaagagccagcccagcagcgaggaggccaccaccggggaggccgcccctgtgtctggctaccgggcctctgtgtgggtgttctgcaccatcagcggcctcatcaccctgctgcctgatggcaccatccacggcatcaaccacagctttgccctgaccctgtttggctacggcaagacagagctgctgggcaagaacatcaccttcctgatccctggcttctacagctacatggacctggcctacaacagcagcctgcagctgcctgacctggccagctgcctggatgtgggcaatgaaagtggctgtggggagaggaccctggacccctggcagggccaggaccctgctgagggcggccaggacccccgcatcaacgtggtgctggccggcggccacgtggtgcccagagatgagatcaggaagctgatggagagccaggacatcttcaccggcacccagacagagctgattgctgggggccagctgctgagctgcctgagcccccagcctgcccctggggtggacaacgtgcctgagggcagcctgcctgtgcacggggagcaggccctgcccaaggaccagcagatcacagccctgggccgggaggagcctgtggccatcgagagccctggccaggacctgctgggggagagccgctctgagcctgtggatgtgaagccctttgccagctgtgaagattctgaggcccctgtgcctgcagaagatggcggcagtgatgctggcatgtgtggcctgtgccagaaggcccagctggagaggatgggcgtgtctggccccagcggcagtgacctgtgggccggggctgctgtggccaagccccaggccaagggccagctggccggcggcagcctgctgatgcactgcccctgctacggcagcgagtggggcctgtggtggaggagccaggacctggcccccagccccagcggcatggccggcctgagctttggcacccccaccctggatgagccctggctgggcgtggagaatgaccgggaggagctgcagacctgcctgatcaaggagcagctgagccagctgagcctggccggggccctggatgtgccccacgccgagctggtgcccacagagtgccaggccgtgacagcccctgtgagcagctgtgacctgggcggccgggacctgtgtggcggctgcaccggcagcagcagcgcctgctacgccctggccacagacctgcccggcggcctggaggccgtggaggcccaggaggtggatgtgaacagcttctcctggaacctgaaggagctgttcttcagtgaccagacagaccagaccagcagcaactgcagctgtgccaccagcgagctgcgggagacccccagcagcctggccgtgggcagtgaccctgatgtgggcagcctgcaggagcagggcagctgtgtgctggatgaccgggagctgctgctgctgaccggcacctgtgtggacctgggccagggccgccgcttccgggagagctgtgtgggccatgaccccacagagcccctggaggtgtgcctggtgtcctctgagcactatgctgccagtgaccgggagagccctggccacgtgcccagcaccctggatgctggccctgaggacacctgccccagcgctgaggagccccggctgaatgtgcaggtgaccagcacccctgtgattgtgatgagaggagctgctggcctgcagcgggagatccaggagggcgcctacagcggcagctgctaccacagagatggcctgcggctgagcatccagtttgaggtgagaagagtggagctgcagggccccacccccctcttctgctgctggctggtgaaggacctgctgcacagccagagggacagcgctgcccggaccaggctcttcctggccagcctgcccggcagcacccacagcacagctgctgagctgaccggccccagcctggtggaggtgctgcgggcccggccctggtttgaggagccccccaaggctgtggagctggagggcctggccgcctgtgagggggagtacagccagaagtacagcaccatgagccccctgggcagcggggccttcggctttgtgtggacagctgtggacaaggagaagaacaaggaggtggtggtgaagttcatcaagaaggagaaggtgctggaggactgctggattgaggaccccaagctgggcaaggtgaccctggagatcgccatcctgagccgggtggagcacgccaacatcatcaaggtgctggacatctttgagaaccagggcttcttccagctggtgatggagaagcacggcagcggcctggacctgtttgccttcatcgacagacacccccggctggatgagcccctggccagctacatcttccggcagctggtgtctgctgtgggctacctgcggctgaaggacatcatccaccgggacatcaaggatgagaacatcgtgattgctgaggacttcaccatcaagctgattgactttggatctgctgcctacctggagcggggcaagctgttctacaccttctgtggcaccatcgagtactgtgcccctgaggtgctgatgggcaacccctaccggggccctgagctggagatgtggagcctgggcgtgaccctgtacaccctggtgtttgaggagaaccccttctgtgagctggaggagaccgtggaggccgccatccaccccccctacctggtgtccaaggagctgatgagcctggtgtctggcctgctgcagcctgtgcctgagaggaggaccaccctggagaagctggtgacagacccctgggtgacccagcctgtgaacctggccgactacacctgggaggaggtgttccgggtgaacaagccagagagcggcgtgctgtctgctgccagcctggagatgggcaacagaagcctgagtgatgtggcccaggcccaggagctgtgtggcggccctgtgcctggagaggcccccaacggccagggctgcctgcaccctggggacccccggctgctgaccagctag

SEQ ID NO: 3385 - DNA, 1488 bp, Artificial Sequence
  Description of Artificial Sequence: Synthetic coding sequence
atgtggcagctgaccagcctgctgctgtttgtggccacctggggcatcagcggcaccccagcccccctggacagcgtcttcagcagcagcgagcgggcccaccaggtgctgcgcatcaggaagagggccaacagcttcctggaggagctgcggcacagcagcctggagcgggagtgcatcgaggagatctgtgactttgaggaggccaaggagatcttccagaatgtggatgacaccctggccttctggagcaagcacgtggatggagaccagtgcctggtgctgcccctggagcacccctgtgccagcctgtgctgcggccacggcacctgcattgatggcatcggcagcttcagctgtgactgccgcagcggctgggagggccgcttctgccagagaggagagggggagcgctggatgctggccggcggcggggccggcctgggccctggctggggccggggcaccagcaccagctgccccaggcctcccctgcctgctgaggtgtccttcctgaactgcagcctggacaatggaggctgcacccactactgcctggaggaggtgggctggaggcgctgcagctgtgcccctggctacaagctgggagatgacctgctgcagtgccaccctgctgtgaagttcccctgtggccggccctggaagaggatggagaagaagaggagccacctgaagagggacacagaggaccaggaggaccaggtggacccccggctgattgatggcaagatgaccaggagaggagacagcccctggcaggtggtgctgctggacagcaagaagaagctggcctgtggggctgtgctgatccaccccagctgggtgctgacagctgcccactgcatggatgagagcaagaagctgctggtgcggctgggggagtatgacctgcggcgctgggagaagtgggagctggacctggacatcaaggaggtgtttgtgcaccccaactacagcaagagcaccacagacaatgacatcgccctgctgcacctggcccagcctgccaccctgagccagaccatcgtgcccatctgcctgcctgattctggcctggccgagcgggagctgaaccaggccggccaggagaccctggtgacaggctggggctaccacagcagccgggagaaggaggccaagaggaacagaacatttgtgctgaacttcatcaagatccctgtggtgccccacaatgaatgttctgaggtgatgagcaacatggtgtctgagaacatgctgtgtgccggcatcctgggggaccggcaggatgcctgtgagggggacagcggcggccccatggtggccagcttccacggcacctggttcctggtgggcctggtgtcctggggcgagggctgcggcctgctgcacaactacggcgtgtacaccaaggtgagccgctacctggactggatccacggccacatccgggacaaggaggccccccagaagtcctgggccccctag

SEQ ID NO: 3386 - DNA, 1386 bp, Artificial Sequence
  Description of Artificial Sequence: Synthetic coding sequence
atgtggcagctgaccagcctgctgctgtttgtggccacctggggcatcagcggcaccccagcccccctggacagcgtcttcagcagcagcgagcgggcccaccaggtgctgcgcatcaggaagagggccaacagcttcctggaggagctgcggcacagcagcctggagcgggagtgcatcgaggagatctgtgactttgaggaggccaaggagatcttccagaatgtggatgacaccctggccttctggagcaagcacgtggatggagaccagtgcctggtgctgcccctggagcacccctgtgccagcctgtgctgcggccacggcacctgcattgatggcatcggcagcttcagctgtgactgccgcagcggctgggagggccgcttctgccagcgggaggtgtccttcctgaactgcagcctggacaatggaggctgcacccactactgcctggaggaggtgggctggaggcgctgcagctgtgcccctggctacaagctgggagatgacctgctgcagtgccaccctgctgtgaagttcccctgtggccggccctggaagaggatggagaagaagaggagccacctgaagagggacacagaggaccaggaggaccaggtggacccccggctgattgatggcaagatgaccaggagaggagacagcccctggcaggtggtgctgctggacagcaagaagaagctggcctgtggggctgtgctgatccaccccagctgggtgctgacagctgcccactgcatggatgagagcaagaagctgctggtgcggctgggggagtatgacctgcggcgctgggagaagtgggagctggacctggacatcaaggaggtgtttgtgcaccccaactacagcaagagcaccacagacaatgacatcgccctgctgcacctggcccagcctgccaccctgagccagaccatcgtgcccatctgcctgcctgattctggcctggccgagcgggagctgaaccaggccggccaggagaccctggtgacaggctggggctaccacagcagccgggagaaggaggccaagaggaacagaacatttgtgctgaacttcatcaagatccctgtggtgccccacaatgaatgttctgaggtgatgagcaacatggtgtctgagaacatgctgtgtgccggcatcctgggggaccggcaggatgcctgtgagggggacagcggcggccccatggtggccagcttccacggcacctggttcctggtgggcctggtgtcctggggcgagggctgcggcctgctgcacaactacggcgtgtacaccaaggtgagccgctacctggactggatccacggccacatccgggacaaggaggccccccagaagtcctgggccccctag

SEQ ID NO: 3387 - DNA, 351 bp, Artificial Sequence
  Description of Artificial Sequence: Synthetic coding sequence
atgtggcagctgaccagcctgctgctgtttgtggccacctggggcatcagcggcaccccagcccccctggacagcgtcttcagcagcagcgagcgggcccaccaggtgctgcgcatcaggaagagggccaacagcttcctggaggagctgcggcacagcagcctggagcgggagtgcatcgaggagatctgtgactttgaggaggccaaggagatcttccagaatgtggatgacaccctggccttctggagcaagcacgtggatggagaccagtgcctggtgctgcccctggagcacccctgtgccagcctgtgctgcggccacggcacctgcattgatggcattggatag

SEQ ID NO: 3388 - DNA, 381 bp, Artificial Sequence
  Description of Artificial Sequence: Synthetic coding sequence
atgtggcagctgaccagcctgctgctgtttgtggccacctggggcatcagcggcaccccagcccccctggacagcgtcttcagcagcagcgagcgggcccaccaggtgctgcgcatcaggaagagggccaacagcttcctggaggagctgcggcacagcagcctggagcgggagtgcatcgaggagatctgtgactttgaggaggccaaggagatcttccagaatgtggatgacaccctggccttctggagcaagcacgtggatggagaccagtgcctggtgctgcccctggagcacccctgtgccagcctgtgctgcggccacggcacctgcattgatggcatcggcagcttcagctgtgactgccgcagcggctggtag

SEQ ID NO: 3389 - DNA, 1551 bp, Artificial Sequence
  Description of Artificial Sequence: Synthetic coding sequence
atggctgctggaagaaggacctgcagcatcagcaccacccggccctgtgccagcgccagcaggatgtggcagctgaccagcctgctgctgtttgtggccacctggggcatcagcggcaccccagcccccctggacagcgtcttcagcagcagcgagcgggcccaccaggtgctgcgcatcaggaagagggccaacagcttcctggaggagctgcggcacagcagcctggagagagaatgtattgaggagatctgtgactttgaggaggccaaggagatcttccagaatgtggatgacaccctggccttctggagcaagcacgtggatggagaccagtgcctggtgctgcccctggagcacccctgtgccagcctgtgctgcggccacggcacctgcattgatggcatcggcagcttcagctgtgactgccgcagcggctgggagggccgcttctgccagagaggagagggggagcgctggatgctggccggcggcggggccggcctgggccctggctggggccggggcaccagcaccagctgcccccggccccccctgcctgctgaggtgtccttcctgaactgcagcctggacaatggaggctgcacccactactgcctggaggaggtgggctggaggcgctgcagctgtgcccctggctacaagctgggagatgacctgctgcagtgccaccctgctgtgaagttcccctgtggccggccctggaagaggatggagaagaagaggagccacctgaagagggacacagaggaccaggaggaccaggtggacccccggctgattgatggcaagatgacccggcggggggacagcccctggcaggtggtgctgctggacagcaagaagaagctggcctgtggggctgtgctgatccaccccagctgggtgctgacagctgcccactgcatggatgagagcaagaagctgctggtgcggctgggggagtatgacctgcggcgctgggagaagtgggagctggacctggacatcaaggaggtgtttgtgcaccccaactacagcaagagcaccacagacaatgacatcgccctgctgcacctggcccagcctgccaccctgagccagaccatcgtgcccatctgcctgcctgacagcggcctggccgagcgggagctgaaccaggccggccaggagaccctggtgacaggctggggctaccacagcagccgggagaaggaggccaagaggaacagaacatttgtgctgaacttcatcaagatccctgtggtgccccacaatgaatgttctgaggtgatgagcaacatggtgtctgagaacatgctgtgtgccggcatcctgggggaccggcaggatgcctgtgagggggacagcggcggccccatggtggccagcttccacggcacctggttcctggtgggcctggtgtcctggggcgagggctgcggcctgctgcacaactatggagtgtacaccaaggtgagccgctacctggactggattcatggccacatccgggacaaggaggccccccagaagtcctgggccccctag

SEQ ID NO: 3390 - DNA, 1263 bp, Artificial Sequence
  Description of Artificial Sequence: Synthetic coding sequence
atgtggatgacccactggcccagcggccccagcaccagcacagtgaccagcgcctggagctgcccctggagcacccgggccccagcctgtgccgccggcacagcccgggccagcacagccagcgctgccagcgctgccacagctgctgctgctggccgggccgccagcgccagcgctgtgcggggccggggcggctgctggaggggcggggccggcctgggccctggctggggccggggcaccagcaccagctgcccccggccccccctgcctgctgaggtgtccttcctgaactgcagcctggacaatggaggctgcacccactactgcctggaggaggtgggctggaggcgctgcagctgtgcccctggctacaagctgggagatgacctgctgcagtgccaccctgctgtgaagttcccctgtggccggccctggaagaggatggagaagaagaggagccacctgaagagggacacagaggaccaggaggaccaggtggacccccggctgattgatggcaagatgacccggcggggggacagcccctggcaggtggtgctgctggacagcaagaagaagctggcctgtggggctgtgctgatccaccccagctgggtgctgacagctgcccactgcatggatgagagcaagaagctgctggtgcggctgggggagtatgacctgcggcgctgggagaagtgggagctggacctggacatcaaggaggtgtttgtgcaccccaactacagcaagagcaccacagacaatgacatcgccctgctgcacctggcccagcctgccaccctgagccagaccatcgtgcccatctgcctgcctgacagcggcctggccgagcgggagctgaaccaggccggccaggagaccctggtgacaggctggggctaccacagcagccgggagaaggaggccaagaggaacagaacatttgtgctgaacttcatcaagatccctgtggtgccccacaatgaatgttctgaggtgatgagcaacatggtgtctgagaacatgctgtgtgccggcatcctgggggaccggcaggatgcctgtgagggggacagcggcggccccatggtggccagcttccacggcacctggttcctggtgggcctggtgtcctggggcgagggctgcggcctgctgcacaactatggagtgtacaccaaggtgagccgctacctggactggattcatggccacatccgggacaaggaggccccccagaagtcctgggccccctag

SEQ ID NO: 3391 - DNA, 354 bp, Artificial Sequence
  Description of Artificial Sequence: Synthetic coding sequence
atgcccaggctcttcttcttccacctgctgggcgtgtgcctgctgctgaaccagttcagcagagctgtggccgacagctggatggaggaggtgatcaagctgtgtggccgggagctggtgcgggcccagatcgccatctgtggcatgagcacctggagcaagaggagcctgagccaggaggatgccccccagacccccaggcctgtggccggggacttcatccagacagtgtccctgggcatcagcccagatggcggcaaggccctgaggacaggcagctgcttcacccgggagttcctgggcgccctgagcaagctgtgccaccccagcagcaccaagatccagaagccctag

SEQ ID NO: 3392 - DNA, 558 bp, Artificial Sequence
  Description of Artificial Sequence: Synthetic coding sequence
atgcccaggctcttcttcttccacctgctgggcgtgtgcctgctgctgaaccagttcagcagagctgtggccgacagctggatggaggaggtgatcaagctgtgtggccgggagctggtgcgggcccagatcgccatctgtggcatgagcacctggagcaagaggagcctgagccaggaggatgccccccagacccccaggcctgtggccgagatcgtgcccagcttcatcaacaaggacacagagaccatcaacatgatgtctgaatttgtggccaacctgccccaggagctgaagctgaccctgtctgagatgcagcctgccctgccccagctgcagcagcacgtgcctgtgctgaaggacagcagcctgctgtttgaggagttcaagaagctgatccggaaccggcagagcgaggccgctgacagcagccccagcgagctgaagtacctgggcctggacacccacagcaggaagaagaggcagctgtacagcgccctggccaacaagtgctgccacgtgggctgcaccaagaggagcctggcccgcttctgctag

SEQ ID NO: 3393 - DNA, 1047 bp, Artificial Sequence
  Description of Artificial Sequence: Synthetic coding sequence
atgaatggaacagagggccccaacttctacgtgcccttcagcaatgccactggagtggtgcgcagcccctttgagtacccccagtactacctggccgagccctggcagttctccatgctggccgcctacatgttcctgctgattgtgctgggcttccccatcaacttcctgaccctgtatgtgacagtgcagcacaagaagctgcggacccccctgaactacatcctgctgaacctggccgtggccgacctcttcatggtgctgggcggcttcaccagcaccctgtacaccagcctgcacggctactttgtgtttggccccaccggctgcaacctggagggcttctttgccaccctgggcggggagatcgccctgtggagcctggtggtgctggccatcgagcgctacgtggtggtgtgcaagcccatgagcaacttccgctttggagagaaccacgccatcatgggcgtggccttcacctgggtgatggccctggcctgtgccgccccacccctggccggctggagccgctacatccctgagggcctgcagtgcagctgtggcatcgactactacaccctgaagccagaggtgaacaatgaaagctttgtgatctacatgtttgtggtgcacttcaccatccccatgatcatcatcttcttctgctacggccagctggtgttcaccgtgaaggaggccgccgcccagcagcaggagagcgccaccacccagaaggccgagaaggaggtgaccaggatggtgatcatcatggtgattgccttcctgatctgctgggtgccctatgcctctgtggccttctacatcttcacccaccagggcagcaactttggccccatcttcatgaccatcccagccttctttgccaagtctgctgccatctacaaccctgtgatctacatcatgatgaacaagcagttcaggaactgcatgctgaccaccatctgctgcggcaagaaccccctgggagatgatgaggccagcgccaccgtgtccaagacagagaccagccaggtggccccagcctag

SEQ ID NO: 3394 - DNA, 1257 bp, Artificial Sequence
  Description of Artificial Sequence: Synthetic coding sequence
atgcccagctctgtgtcctggggcatcctgctgctggccggcctgtgctgcctggtgcctgtgtccctggccgaggacccccagggagatgctgcccagaagacagacaccagccaccacgaccaggaccaccccaccttcaacaagatcacccccaacctggccgagtttgccttcagcctgtaccggcagctggcccaccagagcaacagcaccaacatcttcttcagccctgtgtccatcgccacagcctttgccatgctgagcctgggcaccaaggctgacacccatgatgagatcctggagggcctgaacttcaacctgacagagatccctgaggcccagatccacgagggcttccaggagctgctgcggaccctgaaccagcctgacagccagctgcagctgaccactggaaatggcctcttcctgtctgagggcctgaagctggtggacaagttcctggaggatgtgaagaagctgtaccacagcgaggccttcaccgtgaactttggagacacagaggaggccaagaagcagatcaatgactatgtggagaagggcacccagggcaagatcgtggacctggtgaaggagctggaccgggacacagtgtttgccctggtgaactacatcttcttcaagggcaagtgggagcggccctttgaggtgaaggacacagaggaggaggacttccacgtggaccaggtgaccaccgtgaaggtgcccatgatgaagaggctgggcatgttcaacatccagcactgcaagaagctgagctcctgggtgctgctgatgaagtacctgggcaatgccacagccatcttcttcctgcctgatgagggcaagctgcagcacctggagaatgagctgacccatgacatcatcaccaagttcctggagaatgaagatagaagaagtgccagcctgcacctgcccaagctgagcatcaccggcacctatgacctgaagtctgtgctgggccagctgggcatcaccaaggtgttcagcaatggagctgacctgtctggagtgacagaggaggcccccctgaagctgagcaaggctgtgcacaaggctgtgctgaccattgatgagaagggcacagaagctgctggggccatgttcctggaggccatccccatgagcatccccccagaggtgaagttcaacaagccctttgtgttcctgatgattgagcagaacaccaagagccccctcttcatgggcaaggtggtgaaccccacccagaagtag

SEQ ID NO: 3395 - DNA, 1257 bp, Artificial Sequence; identical to SEQ ID NO: 3394
  Description of Artificial Sequence: Synthetic coding sequence

SEQ ID NO: 3396 - DNA, 1257 bp, Artificial Sequence; identical to SEQ ID NO: 3394
  Description of Artificial Sequence: Synthetic coding sequence

SEQ ID NO: 3397 - DNA, 1080 bp, Artificial Sequence
  Description of Artificial Sequence: Synthetic coding sequence
atgcccagctctgtgtcctggggcatcctgctgctggccggcctgtgctgcctggtgcctgtgtccctggccgaggacccccagggagatgctgcccagaagacagacaccagccaccacgaccaggaccaccccaccttcaacaagatcacccccaacctggccgagtttgccttcagcctgtaccggcagctggcccaccagagcaacagcaccaacatcttcttcagccctgtgtccatcgccacagcctttgccatgctgagcctgggcaccaaggctgacacccatgatgagatcctggagggcctgaacttcaacctgacagagatccctgaggcccagatccacgagggcttccaggagctgctgcggaccctgaaccagcctgacagccagctgcagctgaccactggaaatggcctcttcctgtctgagggcctgaagctggtggacaagttcctggaggatgtgaagaagctgtaccacagcgaggccttcaccgtgaactttggagacacagaggaggccaagaagcagatcaatgactatgtggagaagggcacccagggcaagatcgtggacctggtgaaggagctggaccgggacacagtgtttgccctggtgaactacatcttcttcaagggcaagtgggagcggccctttgaggtgaaggacacagaggaggaggacttccacgtggaccaggtgaccaccgtgaaggtgcccatgatgaagaggctgggcatgttcaacatccagcactgcaagaagctgagctcctgggtgctgctgatgaagtacctgggcaatgccacagccatcttcttcctgcctgatgagggcaagctgcagcacctggagaatgagctgacccatgacatcatcaccaagttcctggagaatgaagatagaagaagtgccagcctgcacctgcccaagctgagcatcaccggcacctatgacctgaagtctgtgctgggccagctgggcatcaccaaggtgttcagcaatggagctgacctgtctggagtgacagaggaggcccccctgaagctgagcaaggtgcgcagcccctag

SEQ ID NO: 3398 - DNA, 1257 bp, Artificial Sequence; identical to SEQ ID NO: 3394
  Description of Artificial Sequence: Synthetic coding sequence

SEQ ID NO: 3399 - DNA, 1257 bp, Artificial Sequence; identical to SEQ ID NO: 3394
  Description of Artificial Sequence: Synthetic coding sequence

SEQ ID NO: 3400 - DNA, 1257 bp, Artificial Sequence; identical to SEQ ID NO: 3394
  Description of Artificial Sequence: Synthetic coding sequence

SEQ ID NO: 3401 - DNA, 1257 bp, Artificial Sequence; identical to SEQ ID NO: 3394
  Description of Artificial Sequence: Synthetic coding sequence

SEQ ID NO: 3402 - DNA, 1257 bp, Artificial Sequence; identical to SEQ ID NO: 3394
  Description of Artificial Sequence: Synthetic coding sequence

SEQ ID NO: 3403 - DNA, 279 bp, Artificial Sequence
  Description of Artificial Sequence: Synthetic coding sequence
atgcccagctctgtgtcctggggcatcctgctgctggccggcctgtgctgcctggtgcctgtgtccctggccgaggacccccagggagatgctgcccagaagacagacaccagccaccacgaccaggaccaccccaccttcaacaagatcacccccaacctggccgagtttgccttcagcctgtaccggcagctggcccaccagagcaacagcaccaacatcttcttcagccctgtgtccatcgccacagcctttgccatgctgagcctgggcacctag

SEQ ID NO: 3404 - DNA, 471 bp, Artificial Sequence
  Description of Artificial Sequence: Synthetic coding sequence
atgcccagctctgtgtcctggggcatcctgctgctggccggcctgtgctgcctggtgcctgtgtccctggccgaggacccccagggagatgctgcccagaagacagacaccagccaccacgaccaggaccaccccaccttcaacaagatcacccccaacctggccgagtttgccttcagcctgtaccggcagctggcccaccagagcaacagcaccaacatcttcttcagccctgtgtccatcgccacagcctttgccatgctgagcctgggcaccaaggctgacacccatgatgagatcctggagggcctgaacttcaacctgacagagatccctgaggcccagatccacgagggcttccaggagctgctgcggaccctgaaccagcctgacagccagctgcagctgaccactggaaatggcctcttcctgtctgagggcctgaagctggtggacaagttcctggagtag

SEQ ID NO: 3405 - DNA, 354 bp, Artificial Sequence
  Description of Artificial Sequence: Synthetic coding sequence
atgcccagctctgtgtcctggggcatcctgctgctggccggcctgtgctgcctggtgcctgtgtccctggccgaggacccccagggagatgctgcccagaagacagacaccagccaccacgaccaggaccaccccaccttcaacaagatcacccccaacctggccgagtttgccttcagcctgtaccggcagctggcccaccagagcaacagcaccaacatcttcttcagccctgtgtccatcgccacagcctttgccatgctgagcctgggcaccaaggctgacacccatgatgagatcctggagggcctgaacttcaacctgacagagatccctgaggcccagatccactag

SEQ ID NO: 3406 - DNA, 69 bp, Artificial Sequence
  Description of Artificial Sequence: Synthetic coding sequence
atgcccagctctgtgtcctggggcatcctgctgctggccggcctgtgctgcctggtgcctgtgtcctag

SEQ ID NO: 3407 - DNA, 435 bp, Artificial Sequence
  Description of Artificial Sequence: Synthetic coding sequence
atgcccagctctgtgtcctggggcatcctgctgctggccggcctgtgctgcctggtgcctgtgtccctggccgaggacccccagggagatgctgcccagaagacagacaccagccaccacgaccaggaccaccccaccttcaacaagatcacccccaacctggccgagtttgccttcagcctgtaccggcagctggcccaccagagcaacagcaccaacatcttcttcagccctgtgtccatcgccacagcctttgccatgctgagcctgggcaccaaggctgacacccatgatgagatcctggagggcctgaacttcaacctgacagagatccctgaggcccagatccacgagggcttccaggagctgctgcggaccctgaaccagcctgacagccagctgcagctgaccactggaaatggcctcttcctgtag

SEQ ID NO: 3408 - DNA, 780 bp, Artificial Sequence
  Description of Artificial Sequence: Synthetic coding sequence
atgtacagcaatgtcatcggcaccgtgaccagcggcaagaggaaggtgtacctgctgagcctgctgctgattggcttctgggactgtgtgacctgccacggcagccctgtggacatctgcacagccaagccccgggacatccccatgaaccccatgtgcatctaccgcagccctgagaagaaggccacagaagatgagggcagcgagcagaagatccctgaggccaccaacagaagagtgtgggagctgagcaaggccaacagcagatttgccaccaccttctaccagcacctggccgacagcaagaatgacaatgacaacatcttcctgagccccctgagcatcagcacagcctttgccatgaccaagctgggcgcctgcaatgacaccctgcagcagctgatggaggtgttcaagtttgacaccatcagcgagaagaccagtgaccagatccacttcttctttgccaagctgaactgccgcctgtacaggaaggccaacaagagcagcaagctggtgtctgccaaccggctgtttggagacaagagcctgaccttcaatgacctgtatgtgtctgatgccttccacaaggccttcctggaggtgaatgaggagggcagcgaggccgccgccagcacagctgtggtgattgctggccgcagcctgaaccccaacagagtgaccttcaaggccaaccggcccttcctggtgttcatccgggaggtgcccctgaacaccatcatcttcatgggccgggtggccaacccctgtgtgaagtag

SEQ ID NO: 3409 - DNA, 1395 bp, Artificial Sequence
  Description of Artificial Sequence: Synthetic coding sequence
atgtacagcaatgtcatcggcaccgtgaccagcggcaagaggaaggtgtacctgctgagcctgctgctgattggcttctgggactgtgtgacctgccacggcagccctgtggacatctgcacagccaagccccgggacatccccatgaaccccatgtgcatctaccgcagccctgagaagaaggccacagaagatgagggcagcgagcagaagatccctgaggccaccaacagaagagtgtgggagctgagcaaggccaacagcagatttgccaccaccttctaccagcacctggccgacagcaagaatgacaatgacaacatcttcctgagccccctgagcatcagcacagcctttgccatgaccaagctgggcgcctgcaatgacaccctgcagcagctgatggaggtgttcaagtttgacaccatcagcgagaagaccagtgaccagatccacttcttctttgccaagctgaactgccgcctgtacaggaaggccaacaagagcagcaagctggtgtctgccaaccggctgtttggagacaagagcctgaccttcaatgagacctaccaggacatcagcgagctggtgtatggagccaagctgcagcccctggacttcaaggaaaatgctgagcagagccgggccgccatcaacaagtgggtgagcaacaagacagagggccgcatcacagatgtgatccccagcgaggccatcaatgagctgactgtgctggtgctggtgaacaccatctacttcaagggcctgtggaagagcaagttcagccctgagaacaccaggaaggagctgttctacaaggcagatggagagagctgcagcgcctccatgatgtaccaggagggcaagttccgctacagaagagtggccgagggcacccaggtgctggagctgcccttcaagggagatgacatcaccatggtgctgatcctgcccaagccagagaagagcctggccaaggtggagaaggagctgaccccagaggtgctgcaggagtggctggatgagctggaggagatgatgctggtggtgcacatgccccgcttcagaattgaagatggcttcagcctgaaggagcagctgcaggacatgggcctggtggacctcttcagccctgagaagagcaagctgcccggcatcgtggccgagggcagagatgacctgtatgtgtctgatgccttccacaaggccttcctggaggtgaatgaggagggcagcgaggccgccgccagcacagctgtggtgattgctggccgcagcctgaaccccaacagagtgaccttcaaggccaaccggcccttcctggtgttcatccgggaggtgcccctgaacaccatcatcttcatgggccgggtggccaacccctgtgtgaagtag

SEQ ID NO: 3410 - DNA, 1476 bp, Artificial Sequence
  Description of Artificial Sequence: Synthetic coding sequence
atggccctgctgtggggcctgctggtgctgtcctggagctgcctgcagggcccctgcagcgtcttcagccctgtgtctgccatggagcccctgggccggcagctgaccagcggccccaaccaggagcaggtgagccccctgaccctgctgaagctgggcaaccaggagcccggcggccagacagccctgaagagccccccaggagtgtgcagccgggaccccaccccagagcagacccaccggctggcccgggccatgatggccttcaccgctgacctcttcagcctggtggcccagaccagcacctgccccaacctgatcctgagccccctgtctgtggccctggccctgagccacctggccctgggcgcccagaaccacaccctgcagaggctgcagcaggtgctgcacgccggcagcggcccctgcctgccccacctgctgagccggctgtgccaggacctgggccctggggccttccggctggccgccaggatgtacctgcagaagggcttccccatcaaggaggacttcctggagcagagcgagcagctgtttggagccaagcctgtgtccctgaccgggaagcaggaggatgacctggccaacatcaaccagtgggtgaaggaggccacagagggcaagatccaggagttcctgagcggcctgcctgaagatactgtgctgctgctgctgaatgccatccacttccagggcttctggaggaacaagtttgaccccagcctgacccagagggacagcttccacctggatgagcagttcaccgtgcctgtggagatgatgcaggcccggacctaccccctgcgctggttcctgctggagcagcctgagatccaggtggcccacttccccttcaagaacaacatgagctttgtggtgctggtgcccacccactttgagtggaatgtgtcccaggtgctggccaacctgtcctgggacaccctgcacccccccctggtgtgggagcggcccaccaaggtgcggctgcccaagctgtacctgaagcaccagatggacctggtggccaccctgagccagctgggcctgcaggagctgttccaggccccagacctgcggggcatcagcgagcagagcctggtggtgtctggagtgcagcaccagagcaccctggagctgtctgaggtgggcgtggaggccgctgctgccaccagcatcgccatgagcaggatgagcctgagcagcttctctgtgaaccggcccttcctgttcttcatctttgaggacaccaccggcctgcccctgtttgtgggctctgtgaggaaccccaaccccagcgccccccgggagctgaaggagcagcaggacagccctggcaacaaggacttcctgcagagcctgaagggcttccccaggggggacaagctgtttggaccagacctgaagctggtgccccccatggaggaggactacccccagtttggcagccccaagtag

SEQ ID NO: 3411 - DNA, 1476 bp, Artificial Sequence; identical to SEQ ID NO: 3410
  Description of Artificial Sequence: Synthetic coding sequence

SEQ ID NO: 3412 - DNA, 1284 bp, Artificial Sequence
  Description of Artificial Sequence: Synthetic coding sequence
atggccctgctgtggggcctgctggtgctgtcctggagctgcctgcagggcccctgcagcgtcttcagccctgtgtctgccatggagcccctgggccggcagctgaccagcggccccaaccaggagcaggtgagccccctgaccctgctgaagctgggcaaccaggtgcagcccggggcccagaaccacaccctgcagaggctgcagcaggtgctgcacgccggcagcggcccctgcctgccccacctgctgagccggctgtgccaggacctgggccctggggccttccggctggccgccaggatgtacctgcagaagggcttccccatcaaggaggacttcctggagcagagcgagcagctgtttggagccaagcctgtgtccctgaccgggaagcaggaggatgacctggccaacatcaaccagtgggtgaaggaggccacagagggcaagatccaggagttcctgagcggcctgcctgaagatactgtgctgctgctgctgaatgccatccacttccagggcttctggaggaacaagtttgaccccagcctgacccagagggacagcttccacctggatgagcagttcaccgtgcctgtggagatgatgcaggcccggacctaccccctgcgctggttcctgctggagcagcctgagatccaggtggcccacttccccttcaagaacaacatgagctttgtggtgctggtgcccacccactttgagtggaatgtgtcccaggtgctggccaacctgtcctgggacaccctgcacccccccctggtgtgggagcggcccaccaaggtgcggctgcccaagctgtacctgaagcaccagatggacctggtggccaccctgagccagctgggcctgcaggagctgttccaggccccagacctgcggggcatcagcgagcagagcctggtggtgtctggagtgcagcaccagagcaccctggagctgtctgaggtgggcgtggaggccgctgctgccaccagcatcgccatgagcaggatgagcctgagcagcttctctgtgaaccggcccttcctgttcttcatctttgaggacaccaccggcctgcccctgtttgtgggctctgtgaggaaccccaaccccagcgccccccgggagctgaaggagcagcaggacagccctggcaacaaggacttcctgcagagcctgaagggcttccccaggggggacaagctgtttggaccagacctgaagctggtgccccccatggaggaggactacccccagtttggcagccccaagtag

SEQ ID NO: 3413 - DNA, 768 bp, Artificial Sequence
  Description of Artificial Sequence: Synthetic coding sequence
atggccctgctgtggggcctgctggtgctgtcctggagctgcctgcagggcccctgcagcgtcttcagccctgtgtctgccatggagcccctgggccggcagctgaccagcggccccaaccaggagcaggtgagccccctgaccctgctgaagctgggcaaccaggagcccggcggccagacagccctgaagagccccccaggagtgtgcagccgggaccccaccccagagcagacccaccggctggcccgggccatgatggccttcaccgctgacctcttcagcctggtggcccagaccagcacctgccccaacctgatcctgagccccctgtctgtggccctggccctgagccacctggccctgggcgcccagaaccacaccctgcagaggctgcagcaggtgctgcacgccggcagcggcccctgcctgccccacctgctgagccggctgtgccaggacctgggccctggggccttccggctggccgccaggatgtacctgcagaagggcttccccatcaaggaggacttcctggagcagagcgagcagctgtttggagccaagcctgtgtccctgaccgggaagcaggaggatgacctggccaacatcaaccagtgggtgaaggaggccacagagggcaagatccaggagttcctgagcggcctgcctgaagatactgtgctgctgctgctgaatgccatccacttccagggcttctggaggaacaagtttgaccccagcctgacccagagggacagcttctag

SEQ ID NO: 3414 - DNA, 1503 bp, Artificial Sequence
  Description of Artificial Sequence: Synthetic coding sequence
atggccagccggctgaccctgctgaccctgctgctgctgctgctggccggggaccgggccagcagcaaccccaatgccaccagcagcagcagccaggaccctgagagcctgcaggacagaggagagggcaaggtggccaccaccgtcatcagcaagatgctgtttgtggagcccatcctggaggtgagcagcctgcccaccaccaacagcaccaccaacagcgccaccaagatcacagccaacaccacagatgagcccaccacccagcccaccacagagcccaccacccagcccaccatccagcccacccagcccaccacccagctgcccacagacagccccacccagcccaccaccggcagcttctgccccggccctgtgaccctgtgcagcgacctggagagccacagcacagaggccgtgctgggagatgccctggtggacttcagcctgaagctgtaccacgccttcagcgccatgaagaaggtggagaccaacatggccttcagccccttcagcatcgccagcctgctgacccaggtgctgctgggcgctggggagaacaccaagaccaacctggagagcatcctgagctaccccaaggacttcacctgtgtgcaccaggccctgaagggcttcaccaccaagggcgtgacctctgtgtcccagatcttccacagcccagacctggccatccgggacacctttgtgaatgccagcaggaccctgtacagcagcagcccccgggtgctgagcaacaacagtgatgccaacctggagctgatcaacacctgggtggccaagaacaccaacaacaagatcagccggctgctggacagcctgcccagcgacacccggctggtgctgctgaatgccatctacctgagcgccaagtggaagaccacctttgaccccaagaagaccaggatggagcccttccacttcaagaacagcgtcatcaaggtgcccatgatgaacagcaagaagtaccctgtggcccacttcatcgaccagaccctgaaggccaaggtgggccagctgcagctgagccacaacctgagcctggtgatcctggtgccccagaacctgaagcaccggctggaggacatggagcaggccctgagccccagcgtcttcaaggccatcatggagaagctggagatgagcaagttccagcccaccctgctgaccctgccccgcatcaaggtgaccaccagccaggacatgctgagcatcatggagaagctggagttctttgacttctcctatgacctgaacctgtgtggcctgacagaggaccctgacctgcaggtgtctgccatgcagcaccagacagtgctggagctgacagagaccggggtggaggccgccgccgccagcgccatctctgtggcccggaccctgctggtgtttgaggtgcagcagcccttcctgtttgtgctgtgggaccagcagcacaagtttcctgtgttcatgggccgggtgtatgacccccgggcctag

SEQ ID NO: 3415 - DNA, 1518 bp, Artificial Sequence
  Description of Artificial Sequence: Synthetic coding sequence
atggccagccggctgaccctgctgaccctgctgctgctgctgctggccggcttcctggagccccaggaccgggccagcagcaaccccaatgccaccagcagcagcagccaggaccctgagagcctgcaggacagaggagagggcaaggtggccaccaccgtcatcagcaagatgctgtttgtggagcccatcctggaggtgagcagcctgcccaccaccaacagcaccaccaacagcgccaccaagatcacagccaacaccacagatgagcccaccacccagcccaccacagagcccaccacccagcccaccatccagcccacccagcccaccacccagctgcccacagacagccccacccagcccaccaccggcagcttctgccccggccctgtgaccctgtgcagcgacctggagagccacagcacagaagctgtgctgggagatgccctggtggacttcagcctgaagctgtaccacgccttcagcgccatgaagaaggtggagaccaacatggccttcagccccttcagcatcgccagcctgctgacccaggtgctgctgggcgctggggagaacaccaagaccaacctggagagcatcctgagctaccccaaggacttcacctgtgtgcaccaggccctgaagggcttcaccaccaagggcgtgacctctgtgtcccagatcttccacagcccagacctggccatccgggacacctttgtgaatgccagcaggaccctgtacagcagcagcccccgggtgctgagcaacaacagtgatgccaacctggagctgatcaacacctgggtggccaagaacaccaacaacaagatcagccggctgctggacagcctgcccagcgacacccggctggtgctgctgaatgccatctacctgagcgccaagtggaagaccacctttgaccccaagaagaccaggatggagcccttccacttcaagaacagcgtcatcaaggtgcccatgatgaacagcaagaagtaccctgtggcccacttcatcgaccagaccctgaaggccaaggtgggccagctgcagctgagccacaacctgagcctggtgatcctggtgccccagaacctgaagcaccggctggaggacatggagcaggccctgagccccagcgtcttcaaggccatcatggagaagctggagatgagcaagttccagcccaccctgctgaccctgccccgcatcaaggtgaccaccagccaggacatgctgagcatcatggagaagctggagttctttgacttctcctatgacctgaacctgtgtggcctgacagaagatcctgacctgcaggtgtctgccatgcagcaccagacagtgctggagctgacagaaacaggagtggaggccgctgctgccagcgccatctctgtggcccggaccctgctggtgtttgaggtgcagcagcccttcctgtttgtgctgtgggaccagcagcacaagtttcctgtgttcatgggccgggtgtatgacccccgggcctag

SEQ ID NO: 3416 - DNA, 1347 bp, Artificial Sequence
  Description of Artificial Sequence: Synthetic coding sequence
atgctgtttgtggagcccatcctggaggtgagcagcctgcccaccaccaacagcaccaccaacagcgccaccaagatcacagccaacaccacagatgagcccaccacccagcccaccacagagcccaccacccagcccaccatccagcccacccagcccaccacccagctgcccacagacagccccacccagcccaccaccggcagcttctgccccggccctgtgaccctgtgcagcgacctggagagccacagcacagaggccgtgctgggagatgccctggtggacttcagcctgaagctgtaccacgccttcagcgccatgaagaaggtggagaccaacatggccttcagccccttcagcatcgccagcctgctgacccaggtgctgctgggcgctggggagaacaccaagaccaacctggagagcatcctgagctaccccaaggacttcacctgtgtgcaccaggccctgaagggcttcaccaccaagggcgtgacctctgtgtcccagatcttccacagcccagacctggccatccgggacacctttgtgaatgccagcaggaccctgtacagcagcagcccccgggtgctgagcaacaacagtgatgccaacctggagctgatcaacacctgggtggccaagaacaccaacaacaagatcagccggctgctggacagcctgcccagcgacacccggctggtgctgctgaatgccatctacctgagcgccaagtggaagaccacctttgaccccaagaagaccaggatggagcccttccacttcaagaacagcgtcatcaaggtgcccatgatgaacagcaagaagtaccctgtggcccacttcatcgaccagaccctgaaggccaaggtgggccagctgcagctgagccacaacctgagcctggtgatcctggtgccccagaacctgaagcaccggctggaggacatggagcaggccctgagccccagcgtcttcaaggccatcatggagaagctggagatgagcaagttccagcccaccctgctgaccctgccccgcatcaaggtgaccaccagccaggacatgctgagcatcatggagaagctggagttctttgacttctcctatgacctgaacctgtgtggcctgacagaggaccctgacctgcaggtgtctgccatgcagcaccagacagtgctggagctgacagagaccggggtggaggccgccgccgccagcgccatctctgtggcccggaccctgctggtgtttgaggtgcagcagcccttcctgtttgtgctgtgggaccagcagcacaagtttcctgtgttcatgggccgggtgtatgacccccgggcctag

SEQ ID NO: 3417 - DNA, 483 bp, Artificial Sequence
  Description of Artificial Sequence: Synthetic coding sequence
atggccagccggctgaccctgctgaccctgctgctgctgctgctggccggggaccgggccagcagcaaccccaatgccaccagcagcagcagccaggaccctgagagcctgcaggacagaggagagggcaaggtggccaccaccgtcatcagcaagatgctgtttgtggagcccatcctggaggtgagcagcctgcccaccaccaacagcaccaccaacagcgccaccaagatcacagccaacaccacagatgagcccaccacccagcccaccacagagcccaccacccagcccaccatccagcccacccagcccaccacccagctgcccacagacagccccacccagcccaccaccggcagcttctgccccggccctgtgaccctgtgcagcgacctggagagccacagcacagaggccgtgctgggagatgccctggtggacttcagcctgaagctgtaccacgccttcagcgccatgtag

SEQ ID NO: 3418 - DNA, 402 bp, Artificial Sequence
  Description of Artificial Sequence: Synthetic coding sequence
atggccagccggctgaccctgctgaccctgctgctgctgctgctggccggggaccgggccagcagcaaccccaatgccaccagcagcagcagccaggaccctgagagcctgcaggacagaggagagggcaaggtggccaccaccgtcatcagcaagatgctgtttgtggagcccatcctggaggtgagcagcctgcccaccaccaacagcaccaccaacagcgccaccaagatcacagccaacaccacagatgagcccaccacccagcccaccacagagcccaccacccagcccaccatccagcccacccagcccaccacccagctgcccacagacagccccacccagcccggctacgccctgaaccacggggagatcggcatcctgcgcttcttcctgtag

SEQ ID NO: 3419 - DNA, 3405 bp, Artificial Sequence
  Description of Artificial Sequence: Synthetic coding sequence
atgcctgtgttccacaccaggaccatcgagagcatcctggagcctgtggcccagcagatcagccacctggtgatcatgcatgaggagggggaggtggatggcaaggccatcccagacctgacagcccctgtggccgctgtgcaggccgctgtgagcaacctggtgcgggtgggcaaggagaccgtgcagaccacagaggaccagatcctgaagagggacatgcccccagccttcatcaaggtggagaatgcctgcaccaagctggtgcaggccgcccagatgctgcagagcgacccctacagcgtgcctgcccgggactacctgattgatggcagccggggcatcctgagcggcaccagtgacctgctgctgacctttgatgaagctgaggtgaggaagatcatccgggtgtgcaagggcatcctggagtacctgactgtggccgaggtggtggagaccatggaggacctggtgacctacaccaagaacctgggccctggcatgaccaagatggccaagatgattgatgagcggcagcaggagctgacccaccaggagcaccgggtgatgctggtgaacagcatgaacacagtgaaggagctgctgcctgtgctgatcagcgccatgaagatctttgtgaccaccaagaacagcaagaaccagggcatcgaggaggccctgaagaacagaaacttcaccgtggagaagatgtctgctgagatcaatgagatcatccgggtgctgcagctgacctcctgggatgaagatgcctgggccagcaaggacacagaggccatgaagagggccctggccagcattgacagcaagctgaaccaggccaagggctggctgcgggaccccagcgccagccctggagatgctggggagcaggccatccggcagatcctggatgaggccggcaaggtgggggagctgtgtgccggcaaggagcggcgggagatcctgggcacctgcaagatgctgggccagatgacagaccaggtggccgacctgcgggcccggggccagggcagcagccctgtggccatgcagaaggcccagcaggtgtcccagggcctggatgtgctgacagccaaggtggagaatgctgccaggaagctggaggccatgaccaacagcaagcagagcatcgccaagaagattgatgctgcccagaactggctggccgaccccaatggaggccctgagggggaggagcagatccggggggccctggccgaggccaggaagattgctgagctgtgtgatgaccccaaggagagagatgacatcctgcggagcctgggggagatcagcgccctgaccagcaagctggccgacctgcggcggcagggcaaaggagacagccctgaggcccgggccctggccaagcaggtggccacagccctgcagaacctgcagaccaagaccaacagagctgtggccaacagcaggcctgccaaggctgctgtgcacctggagggcaagattgagcaggcccagcgctggattgacaaccccaccgtggatgacagaggagtgggccaggccgccatccggggcctggtggccgagggccaccggctggccaacgtgatgatgggcccctaccggcaggacctgctggccaagtgtgacagagtggaccagctgacagcccagctggccgacctggccgcccggggggagggggagagcccccaggcccgggccctggccagccagctgcaggacagcctgaaggacctgaaggccaggatgcaggaggccatgacccaggaggtgtctgatgtgttcagtgacaccaccacccccatcaagctgctggccgtggccgccacagcccccccagatgcccccaaccgggaggaggtgtttgatgagcgggccgccaactttgagaaccacagcggcaagctgggcgccacagctgagaaggctgctgctgtgggcacagccaacaagagcacagtggagggcatccaggcctctgtgaagacagcccgggagctgaccccccaggtggtgtctgctgcccgcatcctgctgaggaaccctggcaaccaggccgcctatgagcactttgagaccatgaagaaccagtggattgacaacgtggagaagatgacaggcctggtggatgaggccatcgacaccaagagcctgctggatgccagcgaggaggccatcaagaaggacctggacaagtgcaaggtggccatggccaacatccagccccagatgctggtggccggggccaccagcatcgcccggcgggccaaccgcatcctgctggtggccaagcgggaggtggagaacagcgaggaccccaagttccgggaggccgtgaaggccgccagtgatgagctgagcaagaccatcagccccatggtgatggatgccaaggctgtggccggcaacatcagtgaccccggcctgcagaagagcttcctggacagcggctaccgcatcctgggcgctgtggccaaggtgcgggaggccttccagccccaggagccagacttccccccacctcctccagacctggagcagctgcggctgacagatgagctggccccacccaagccacccctgcctgagggggaggtgcccccacccaggcctcctcctcctgaggagaaggatgaggagttccctgagcagaaggccggggaggtgatcaaccagcccatgatgatggccgcccggcagctgcatgatgaggccaggaagtggagcagcaagccaggcatcccagctgctgaggtgggcattggagtggtggccgaggctgatgctgctgatgctgctggcttccctgtgcccccagacatggaggatgattatgagcctgagctgctgctgatgcccagcaaccagcctgtgaaccagcccatcctggccgccgcccagagcctgcaccgggaggccaccaagtggagcagcaaaggaaatgacatcatcgccgccgccaagaggatggccctgctgatggccgagatgagccggctggtgcggggcggcagcggcaccaagagggccctgatccagtgtgccaaggacatcgccaaggccagtgatgaggtgacccggctggccaaggaggtggccaagcagtgcacagacaagaggatccgcaccaacctgctgcaggtgtgtgagcgcatccccaccatcagcacccagctgaagatcctgagcacagtgaaggccaccatgctgggccgcaccaacatcagtgatgaggagagcgagcaggccacagagatgctggtgcacaatgcccagaacctgatgcagagcgtgaaggagaccgtgcgggaggccgaggccgccagcatcaagatcagaacagatgctggcttcaccctgcgctgggtgaggaagaccccctggtaccagtag

SEQ ID NO: 3420 - DNA, 1335 bp, Artificial Sequence
  Description of Artificial Sequence: Synthetic coding sequence
atgtgcctgtgcagcggcaggaagaccatcctggagatctacccaggccagttccagcccagcctgtgccacaagttcatcgccctgagtgacaaggagggcaagctgctgaggaactacacccagaacatcgacaccctggagcaggtggccggcatccagaggatcatccagtgccacggcagctttgccacagccagctgcctgatctgcaagtacaaggtggactgtgaggccgtgcggggggacatcttcaaccaggtggtgccccgctgcccccgctgcccagcagatgagcccctggccatcatgaagccagagatcgtgttctttggagagaacctgcctgagcagttccaccgggccatgaagtatgacaaggatgaggtggacctgctgattgtcatcggcagcagcctgaaggtgcggcctgtggccctgatccccagcagcatcccccatgaggtgccccagatcctgatcaaccgggagcccctgccccacctgcactttgatgtggagctgctgggggactgtgatgtgatcatcaatgagctgtgccaccggctgggcggggagtatgccaagctgtgctgcaaccctgtgaagctgtctgagatcacagagaagccacccaggacccagaaggagctggcctacctgtctgagctgccccccacccccctgcacgtgtctgaggacagcagcagccctgagaggaccagccccccagacagctctgtgattgtgaccctgctggaccaggccgccaagagcaatgatgacctggatgtgtctgagagcaagggctgcatggaggagaagccccaggaggtgcagaccagcagaaatgtggagagcattgctgagcagatggagaacccagacctgaagaatgtgggcagcagcactggagagaagaatgaaagaacatctgtggccggcaccgtgaggaagtgctggcccaacagagtggccaaggagcagatcagccggcggctggatggcaaccagtacctgttcctgccccccaaccgctacatcttccacggggctgaggtgtacagcgacagtgaagatgatgtgctgagcagcagcagctgtggcagcaacagcgacagcggcacctgccagagccccagcctggaggagcccatggaggatgagagcgagattgaggagttctacaacggcctggaggatgagccagatgtgcctgagagagctggaggagctggcttcggcacagatggagatgaccaggaggccatcaatgaggccatctctgtgaagcaggaggtgacagacatgaactaccccagcaacaagagctag

SEQ ID NO: 3421 - DNA, 1335 bp, Artificial Sequence; identical to SEQ ID NO: 3420
  Description of Artificial Sequence: Synthetic coding sequence

SEQ ID NO: 3422 - DNA, 1359 bp, Artificial Sequence
  Description of Artificial Sequence: Synthetic coding sequence
atgtttgacatcgagtacttcaggaaggacccccggcccttcttcaagtttgccaaggagatctacccaggccagttccagcccagcctgtgccacaagttcatcgccctgagtgacaaggagggcaagctgctgaggaactacacccagaacatcgacaccctggagcaggtggccggcatccagaggatcatccagtgccacggcagctttgccacagccagctgcctgatctgcaagtacaaggtggactgtgaggccgtgcggggggacatcttcaaccaggtggtgccccgctgcccccgctgcccagcagatgagcccctggccatcatgaagccagagatcgtgttctttggagagaacctgcctgagcagttccaccgggccatgaagtatgacaaggatgaggtggacctgctgattgtcatcggcagcagcctgaaggtgcggcctgtggccctgatccccagcagcatcccccatgaggtgccccagatcctgatcaaccgggagcccctgccccacctgcactttgatgtggagctgctgggggactgtgatgtgatcatcaatgagctgtgccaccggctgggcggggagtatgccaagctgtgctgcaaccctgtgaagctgtctgagatcacagagaagccacccaggacccagaaggagctggcctacctgtctgagctgccccccacccccctgcacgtgtctgaggacagcagcagccctgagaggaccagccccccagacagctctgtgattgtgaccctgctggaccaggccgccaagagcaatgatgacctggatgtgtctgagagcaagggctgcatggaggagaagccccaggaggtgcagaccagcagaaatgtggagagcattgctgagcagatggagaacccagacctgaagaatgtgggcagcagcactggagagaagaatgaaagaacatctgtggccggcaccgtgaggaagtgctggcccaacagagtggccaaggagcagatcagccggcggctggatggcaaccagtacctgttcctgccccccaaccgctacatcttccacggggctgaggtgtacagcgacagtgaagatgatgtgctgagcagcagcagctgtggcagcaacagcgacagcggcacctgccagagccccagcctggaggagcccatggaggatgagagcgagattgaggagttctacaacggcctggaggatgagccagatgtgcctgagagagctggaggagctggcttcggcacagatggagatgaccaggaggccatcaatgaggccatctctgtgaagcaggaggtgacagacatgaactaccccagcaacaagagctag

SEQ ID NO: 3423 - DNA, 987 bp, Artificial Sequence
  Description of Artificial Sequence: Synthetic coding sequence
atgtctgtgaactatgctgctggcctgagcccctatgctgacaagggcaaatgtggcctgcctgagatctttgaccccccagaggagctggagaggaaggtgtgggagctggcccggctggtgtggcagagcagctctgtggtgttccacactggagctggcatcagcacagccagcggcatcccagacttccggggcccccacggcgtgtggaccatggaggagcggggcctggcccccaagtttgacaccacctttgagagcgcccggcccacccagacccacatggccctggtgcagctggagcgggtgggcctgctgcgcttcctggtgtcccagaatgtggatggcctgcacgtgcgcagcggcttcccccgggacaagctggccgagctgcacggcaacatgtttgtggaggagtgtgccaagtgcaagacccagtatgtgcgggacacagtggtgggcaccatgggcctgaaggccaccggccgcctgtgcaccgtggccaaggcccggggcctgcgggcctgcagaaatgctgacctgagcatcaccctgggcaccagcctgcagatccggcccagcggcaacctgcccctggccaccaagaggcggggcggccgcctggtgattgtgaacctgcagcccaccaagcatgacagacatgctgacctgcgcatccacggctacgtggatgaggtgatgacccggctgatgaagcacctgggcctggagatcccagcctgggatggcccccgggtgctggagcgggccctgccccccctgcccaggcctcccacccccaagctggagcccaaggaggagagccccacccgcatcaatggcagcatcccagctggccccaagcaggagccctgtgcccagcacaatggaagtgagcccgccagccccaagcgggagcggcccaccagccctgccccccacaggcctcccaagagggtgaaggccaaggctgtgcccagctag

SEQ ID NO: 3424 - DNA, 1068 bp, Artificial Sequence
  Description of Artificial Sequence: Synthetic coding sequence
atgtctgtgaactatgctgctggcctgagcccctatgctgacaagggcaaatgtggcctgcctgagatctttgaccccccagaggagctggagaggaaggtgtgggagctggcccggctggtgtggcagagcagctctgtggtgttccacactggagctggcatcagcacagccagcggcatcccagacttccggggcccccacggcgtgtggaccatggaggagcggggcctggcccccaagtttgacaccacctttgagagcgcccggcccacccagacccacatggccctggtgcagctggagcgggtgggcctgctgcgcttcctggtgtcccagaatgtggatggcctgcacgtgcgcagcggcttcccccgggacaagctggccgagctgcacggcaacatgtttgtggaggagtgtgccaagtgcaagacccagtatgtgcgggacacagtggtgggcaccatgggcctgaaggccaccggccgcctgtgcaccgtggccaaggcccggggcctgcgggcctgccgcggggagctgcgggacaccatcctggactgggaggacagcctgcctgaccgggacctggccctggctgatgaggccagcagaaatgctgacctgagcatcaccctgggcaccagcctgcagatccggcccagcggcaacctgcccctggccaccaagagaagaggaggccgcctggtgattgtgaacctgcagcccaccaagcatgacagacatgctgacctgcgcatccacggctacgtggatgaggtgatgacccggctgatgaagcacctgggcctggagatcccagcctgggatggcccccgggtgctggagcgggccctgccccccctgccccggccccccacccccaagctggagcccaaggaggagagccccacccgcatcaatggcagcatcccagctggccccaagcaggagccctgtgcccagcacaacggcagcgagcccgccagccccaagcgggagcggcccaccagccctgccccccaccggccccccaagagggtgaaggccaaggctgtgcccagctag

SEQ ID NO: 3425 - DNA, 852 bp, Artificial Sequence
  Description of Artificial Sequence: Synthetic coding sequence
atggaggagcggggcctggcccccaagtttgacaccacctttgagagcgcccggcccacccagacccacatggccctggtgcagctggagcgggtgggcctgctgcgcttcctggtgtcccagaatgtggatggcctgcacgtgcgcagcggcttcccccgggacaagctggccgagctgcacggcaacatgtttgtggaggagtgtgccaagtgcaagacccagtatgtgcgggacacagtggtgggcaccatgggcctgaaggccaccggccgcctgtgcaccgtggccaaggcccggggcctgcgggcctgccgcggggagctgcgggacaccatcctggactgggaggacagcctgcctgaccgggacctggccctggctgatgaggccagcagaaatgctgacctgagcatcaccctgggcaccagcctgcagatccggcccagcggcaacctgcccctggccaccaagagaagaggaggccgcctggtgattgtgaacctgcagcccaccaagcatgacagacatgctgacctgcgcatccacggctacgtggatgaggtgatgacccggctgatgaagcacctgggcctggagatcccagcctgggatggcccccgggtgctggagcgggccctgccccccctgccccggccccccacccccaagctggagcccaaggaggagagccccacccgcatcaatggcagcatcccagctggccccaagcaggagccctgtgcccagcacaacggcagcgagcccgccagccccaagcgggagcggcccaccagccctgccccccaccggccccccaagagggtgaaggccaaggctgtgcccagctag

SEQ ID NO: 3426 - DNA, 1575 bp, Artificial Sequence
  Description of Artificial Sequence: Synthetic coding sequence
atgacagaggacaaggtgacaggcaccctggtgttcaccgtcatcacagctgtgctgggcagcttccagtttggctatgacatcggggtcatcaatgccccccagcaggtgatcatcagccactaccgccacgtgctgggcgtgcccctggatgacaggaaggccatcaacaactacgtgatcaacagcacagatgagctgcccaccatctcctacagcatgaaccccaagcccaccccctgggccgaggaggagaccgtggccgccgcccagctgatcaccatgctgtggagcctgtctgtgtcctcctttgctgtgggcggcatgacagccagcttcttcggcggctggctgggggacaccctgggccgcatcaaggccatgctggtggccaacatcctgagcctggtgggcgccctgctgatgggcttcagcaagctgggccccagccacatcctgatcatcgccggccgcagcatcagcggcctgtactgcggcctcatcagcggcctggtgcccatgtacatcggggagatcgcccccacagccctgcggggggccctgggcaccttccaccagctggccatcgtgacaggcatcctgatcagccagatcatcggcctggagttcatcctgggcaactatgacctgtggcacatcctgctgggcctgtctggagtgcgggccatcctgcagagcctgctgctcttcttctgcccagagagcccccgctacctgtacatcaagctggatgaggaggtgaaggccaagcagagcctgaagaggctgcggggctatgatgatgtgaccaaggacatcaatgagatgaggaaggagcgggaggaggccagcagcgagcagaaggtgtccatcatccagctgttcaccaacagcagctaccggcagcccatcctggtggccctgatgctgcacgtggcccagcagttcagcggcatcaatggcatcttctactacagcaccagcatcttccagacagctggcatcagcaagcctgtgtatgccaccatcggcgtgggcgctgtgaacatggtgttcaccgctgtgtctgtgttcctggtggagaaggccggcagaagaagcctcttcctgattggcatgagcggcatgtttgtgtgtgccatcttcatgtctgtgggcctggtgctgctgaacaagttctcctggatgtcctatgtgtccatgattgccatcttcctgtttgtgtccttctttgaaattggccctggccccatcccctggttcatggtggccgagttcttcagccagggccccaggcctgctgccctggccatcgccgccttcagcaactggacctgcaacttcatcgtggccctgtgcttccagtacatcgctgacttctgtggcccctacgtgttcttcctgtttgctggggtgctgctggccttcaccctcttcaccttcttcaaggtgcctgagaccaagggcaagagctttgaggagattgctgctgagttccagaagaagagcggcagcgcccaccggcccaaggctgctgtggagatgaagttcctgggcgccacagaaacagtgtag

SEQ ID NO: 3427 - DNA, 1218 bp, Artificial Sequence
  Description of Artificial Sequence: Synthetic coding sequence
atgcacctgaaccgcatcaaggccatgctggtggccaacatcctgagcctggtgggcgccctgctgatgggcttcagcaagctgggccccagccacatcctgatcatcgccggccgcagcatcagcggcctgtactgcggcctcatcagcggcctggtgcccatgtacatcggggagatcgcccccacagccctgcggggggccctgggcaccttccaccagctggccatcgtgacaggcatcctgatcagccagatcatcggcctggagttcatcctgggcaactatgacctgtggcacatcctgctgggcctgagcggcgtgcgggccatcctgcagagcctgctgctcttcttctgcccagagagcccccgctacctgtacatcaagctggatgaggaggtgaaggccaagcagagcctgaagaggctgcggggctatgatgatgtgaccaaggacatcaatgagatgaggaaggagcgggaggaggccagcagcgagcagaaggtgtccatcatccagctgttcaccaacagcagctaccggcagcccatcctggtggccctgatgctgcacgtggcccagcagttcagcggcatcaatggcatcttctactacagcaccagcatcttccagacagctggcatcagcaagcctgtgtatgccaccatcggcgtgggcgctgtgaacatggtgttcaccgctgtgtctgtgttcctggtggagaaggccggccgccgcagcctcttcctgattggcatgagcggcatgtttgtgtgtgccatcttcatgtctgtgggcctggtgctgctgaacaagttctcctggatgtcctatgtgtccatgattgccatcttcctgtttgtgtccttctttgagatcggccctggccccatcccctggttcatggtggccgagttcttcagccagggccccaggcctgctgccctggccatcgccgccttcagcaactggacctgcaacttcatcgtggccctgtgcttccagtacatcgctgacttctgtggcccctacgtgttcttcctgtttgctggggtgctgctggccttcaccctcttcaccttcttcaaggtgcctgagaccaagggcaagagctttgaggagattgctgctgagttccagaagaagagcggcagcgcccaccggcccaaggctgctgtggagatgaagttcctgggcgccacagagaccgtgtag

SEQ ID NO: 3428 - DNA, 1290 bp, Artificial Sequence
  Description of Artificial Sequence: Synthetic coding sequence
atggccgcccagggctacggctactacagaactgtcatcttcagcgccatgtttggaggctacagcctgtactacttcaacaggaagaccttctcctttgtgatgcccagcctggtggaggagatccccctggacaaggatgacctgggcttcatcaccagcagccagagcgctgcctatgccatcagcaagtttgtgtctggagtgctgagtgaccagatgtctgcccgctggctgttcagcagcggcctgctgctggtgggcctggtgaacatcttctttgcctggagcagcacagtgcctgtgtttgctgccctgtggttcctgaatggcctggcccagggcctgggctggccaccctgtgggaaggtgctgaggaagtggtttgagcccagccagtttggcacctggtgggccatcctgagcacctccatgaacctggccggcggcctgggccccatcctggccaccatcctggcccagagctacagctggaggagcaccctggccctgagcggggccctgtgtgtggtggtgtccttcctgtgcctgctgctgatccacaatgaaccagcagatgtgggcctgaggaacctggaccccatgcccagcgagggcaagaagggcagcctgaaggaggagagcaccctgcaggagctgctgctgagcccctacctgtgggtgctgagcacaggctacctggtggtgtttggagtgaagacctgctgcacagactggggccagttcttcctgatccaggagaagggccagagcgccctggtgggcagcagctacatgtctgccctggaggtgggcggcctggtgggcagcattgctgctggctacctgagtgaccgggccatggccaaggccggcctgagcaactacggcaaccccaggcatggcctgctgctcttcatgatggccggcatgacagtgtccatgtacctgttccgggtgacagtgaccagtgacagccccaagctgtggatcctggtgctgggcgctgtgtttggcttcagcagctatggccccatcgccctgtttggagtcatcgccaatgaaagtgccccacccaacctgtgtggcaccagccacgccatcgtgggcctgatggccaacgtgggcggcttcctggccggcctgcccttcagcaccatcgccaagcactacagctggagcacagccttctgggtggccgaggtgatctgtgccgccagcacagctgccttcttcctgctgaggaacatccgcaccaagatgggccgggtgtccaagaaggccgagtag

SEQ ID NO: 3429 - DNA, 1356 bp, Artificial Sequence
  Description of Artificial Sequence: Synthetic coding sequence
atggccgcccagggctacggctactacagaactgtcatcttcagcgccatgtttggaggctacagcctgtactacttcaacaggaagaccttctcctttgtgatgcccagcctggtggaggagatccccctggacaaggatgacctgggcttcatcaccagcagccagagcgctgcctatgccatcagcaagtttgtgtctggagtgctgagtgaccagatgtctgcccgctggctgttcagcagcggcctgctgctggtgggcctggtgaacatcttctttgcctggagcagcacagtgcctgtgtttgctgccctgtggttcctgaatggcctggcccagggcctgggctggccaccctgtgggaaggtgctgaggaagtggtttgagcccagccagtttggcacctggtgggccatcctgagcacctccatgaacctggccggcggcctgggccccatcctggccaccatcctggcccagagctacagctggaggagcaccctggccctgagcggggccctgtgtgtggtggtgtccttcctgtgcctgctgctgatccacaatgaaccagcagatgtgggcctgaggaacctggaccccatgcccagcgagggcaagaagggcagcctgaaggaggagagcaccctgcaggagctgctgctgagcccctacctgtgggtgctgagcacaggctacctggtggtgtttggagtgaagacctgctgcacagactggggccagttcttcctgatccaggagaagggccagagcgccctggtgggcagcagctacatgtctgccctggaggtgggcggcctggtgggcagcattgctgctggctacctgagtgaccgggccatggccaaggccggcctgagcaactacggcaaccccaggcatggcctgctgctcttcatgatggccggcatgacagtgtccatgtacctgttccgggtgacagtgaccagtgacagccccaaggatgtggccttctggaccctggccctgcaccccctggccgagctgaccggcttcacagaacatgagctgtggatcctggtgctgggcgctgtgtttggcttcagcagctatggccccatcgccctgtttggagtcatcgccaatgaaagtgccccacccaacctgtgtggcaccagccacgccatcgtgggcctgatggccaacgtgggcggcttcctggccggcctgcccttcagcaccatcgccaagcactacagctggagcacagccttctgggtggccgaggtgatctgtgccgccagcacagctgccttcttcctgctgaggaacatccgcaccaagatgggccgggtgtccaagaaggccgagtag

SEQ ID NO: 3430 - DNA, 1716 bp, Artificial Sequence
  Description of Artificial Sequence: Synthetic coding sequence
atgacccgggccggggaccacaaccggcagaggggctgctgcggcagcctggccgactacctgaccagcgccaagttcctgctgtacctgggccacagcctgagcacctggggagacaggatgtggcactttgctgtgtctgtgttcctggtggagctgtatggcaacagcctgctgctgacagctgtgtatggcctggtggtggccggctctgtgctggtgctgggcgccatcattggagactgggtggacaagaatgcccggctgaaggtggcccagaccagcctggtggtgcagaatgtgtctgtcatcctgtgtggcatcatcctgatgatggtgttcctgcacaagcatgagctgctgaccatgtaccacggctgggtgctgaccagctgctacatcctgatcatcaccatcgccaacatcgccaacctggccagcacagccacagccatcaccatccagagggactggatcgtggtggtggccggagaagatagaagcaagctggccaacatgaatgccaccatcagaagaattgaccagctgaccaacatcctggcccccatggctgtgggccagatcatgaccttcggcagccctgtgattggctgcggcttcatcagcggctggaacctggtgtccatgtgtgtggagtatgtgctgctgtggaaggtgtaccagaagaccccagccctggccgtgaaggccggcctgaaggaggaggagacagagctgaagcagctgaacctgcacaaggacacagagcccaagcccctggagggcacccacctgatgggcgtgaaggacagcaacatccacgagctggagcacgagcaggagcccacctgtgccagccagatggccgagcccttccgcaccttcagagatggctgggtgtcctactacaaccagcccgtcttcctggccggcatgggcctggccttcctgtacatgacagtgctgggctttgactgcatcaccaccggctacgcctacacccagggcctgagcggcagcatcctgagcatcctgatgggcgccagcgccatcaccggcatcatgggcaccgtggccttcacctggctgcggaggaaatgtggcctggtgaggacaggcctcatcagcggcctggcccagctgagctgcctgatcctgtgtgtgatcagcgtcttcatgcctggcagccccctggacctgtctgtgagcccctttgaggacatccgcagccgcttcatccagggcgagagcatcacccccaccaagatccctgagatcaccacagagatctacatgagcaatggcagcaacagcgccaacatcgtgcctgagaccagccctgagagcgtgcccatcatctctgtgtccctgctgtttgctggggtgattgctgccagaattggcctgtggagctttgacctgactgtgacccagctgctgcaggagaatgtgattgaaagtgagcggggcatcatcaatggagtgcagaacagcatgaactacctgctggacctgctgcacttcatcatggtgatcctggcccccaaccctgaggccttcggcctgctggtgctgatctctgtgtcctttgtggccatgggccacatcatgtacttccgctttgcccagaacaccctgggcaacaagctgtttgcctgtggcccagatgccaaggaggtgaggaaagaaaaccaggccaacacctctgtggtgtag

SEQ ID NO: 3431 - DNA, 603 bp, Artificial Sequence
  Description of Artificial Sequence: Synthetic coding sequence
atgacccgggccggggaccacaaccggcagaggggctgctgcggcagcctggccgactacctgaccagcgccaagttcctgctgtacctgggccacagcctgagcacctggggagacaggatgtggcactttgctgtgtctgtgttcctggtggagctgtatggcaacagcctgctgctgacagctgtgtatggcctggtggtggccggctctgtgctggtgctgggcgccatcattggagactgggtggacaagaatgcccggctgaaggtggcccagaccagcctggtggtgcagaatgtgtctgtcatcctgtgtggcatcatcctgatgatggtgttcctgcacaagcatgagctgctgaccatgtaccacggctgggtgctgaccagctgctacatcctgatcatcaccatcgccaacatcgccaacctggccagcacagccacagccatcaccatccagagggactggatcgtggtggtggccggagaagatagaagcaagctggccaacatgaatgccaccatcagaagaattgaccagctgaccaacatcctggcccccatggctgtgggccagatcatgaccttcggcagctag

SEQ ID NO: 3432 - DNA, 78 bp, Artificial Sequence
  Description of Artificial Sequence: Synthetic coding sequence
atgacccgggccggggaccacaaccggcagaggggctgctgcggcagcctggccgactacctgaccagcgccaagtag

SEQ ID NO: 3433 - DNA, 78 bp, Artificial Sequence; identical to SEQ ID NO: 3432
  Description of Artificial Sequence: Synthetic coding sequence

SEQ ID NO: 3434 - DNA, 168 bp, Artificial Sequence
  Description of Artificial Sequence: Synthetic coding sequence
atgacccgggccggggaccacaaccggcagaggggctgctgcggcagcctggccgactacctgaccagcgccaagttcctgctgtacctgggccacagcctgagcacctggggagacaggatgtggcactttgctgtgtctgtgttcctggtggagctgtatggatag

SEQ ID NO: 3435 - DNA, 300 bp, Artificial Sequence
  Description of Artificial Sequence: Synthetic coding sequence
atgagggccagcatccacaagaagctgaggaagagcagcggcatcgtgaccatcctgtacagcgcctttgtgctggtgtccaccagtgacatggccgaggagacagaagatgcctggccccgctgctacctgcagttcctggccctgctgctgaccagcaccagcgcccgggctgctgctgccatcgctgctgctgaggagcctgctggcagccccagcgtgatgacccgggccggggaccacaaccggcagaggggctgctgcggcagcctggccgactacctgaccagcgccaagtag

SEQ ID NO: 3436 - DNA, 504 bp, Artificial Sequence
  Description of Artificial Sequence: Synthetic coding sequence
atgggcgtgaaggacagcaacatccacgagctggagcacgagcaggagcccacctgtgccagccagatggccgagcccttccgcaccttcagagatggctgggtgtcctactacaaccagcctgtgttcctggccggcatgggcctggccttcctgtacatgacagtgctgggctttgactgcatcaccaccggctacgcctacacccagggcctgagcggcagcatcctgagcatcctgatgggcgccagcgccatcaccggcatcatgggcaccgtggccttcacctggctgcggaggaaatgtggcctggtgaggacaggcctcatcagcggcctggcccagctgagctgcctgatcctgtgtgtgatctctgtgttcatgcctggcagccccctggacctgtctgtgagcccctttgaggacatccgcagccgcttcatccagggcgagagcatcacccccaccaagatccctgagatcaccacagagatccacgtgtag

SEQ ID NO: 3437 - DNA, 2496 bp, Artificial Sequence
  Description of Artificial Sequence: Synthetic coding sequence
atggagcggccctggggcgctgctgatggcctgagccgctggccccacggcctgggcctgctgctgctgctgcagctgctgccccccagcaccctgagccaggaccggctggatgcccctcctcctcctgctgcccccctgccccgctggagcggccccatcggcgtgtcctggggcctgcgggctgctgctgctggaggagccttcccccggggcggccgctggaggagaagtgcccctggagaagatgaagaatgtggccgggtgcgggactttgtggccaagctggccaacaacacccaccagcacgtgtttgatgacctgcggggctctgtgtccctgtcctgggtgggggacagcactggagtcatcctggtgctgaccaccttccacgtgcccctggtgatcatgaccttcggccagagcaagctgtacagaagtgaggactatggcaagaacttcaaggacatcacagacctgatcaacaacaccttcatcagaacagaatttggcatggccatcggcccagaaaattctgggaaggtggtgctgacagctgaggtgtctgggggcagccggggcggccgcatcttccgcagcagtgactttgccaagaactttgtgcagacagacctgcccttccaccccctgacccagatgatgtacagcccccagaacagcgactacctgctggccctgagcacagaaaatggcctgtgggtgtccaagaactttggaggcaagtgggaggagatccacaaggctgtgtgcctggccaagtggggcagtgacaacaccatcttcttcaccacctacgccaacggcagctgcaaggctgacctgggcgccctggagctgtggaggaccagtgacctgggcaagagcttcaagaccatcggcgtgaagatctacagctttggcctgggcggccgcttcctgtttgcctctgtgatggctgacaaggacaccacccggcgcatccacgtgtccacagaccagggcgacacctggagcatggcccagctgcccagcgtgggccaggagcagttctacagcatcctggccgccaatgatgacatggtgttcatgcacgtggatgagcccggggacaccggcttcggcaccatcttcaccagtgatgaccggggcatcgtgtacagcaagagcctggacagacacctgtacaccaccaccggcggggagacagacttcaccaacgtgaccagcctgcggggcgtgtacatcacctctgtgctgtctgaggacaacagcatccagaccatgatcacctttgaccagggcggccgctggacccacctgaggaagccagagaacagtgaatgtgatgccacagccaagaacaagaatgaatgttccctgcacatccacgccagctacagcatcagccagaagctgaatgtgcccatggcccccctgtctgagcccaatgctgtgggcatcgtgattgcccacggctctgtgggagatgccatctctgtgatggtgcctgatgtgtacatcagtgatgatggcggctacagctggaccaagatgctggagggcccccactactacaccatcctggacagcggcggcatcatcgtggccatcgagcacagcagccggcccatcaacgtcatcaagttcagcacagatgagggccagtgctggcagacctacaccttcacccgggaccccatctacttcaccggcctggccagcgagcccggggcccgctccatgaacatcagcatctggggcttcacagagagcttcctgaccagccagtgggtgtcctacaccatcgacttcaaggacatcctggagaggaactgtgaggagaaggactacaccatctggctggcccacagcacagatcctgaggactatgaagatggctgcatcctgggctacaaggagcagttcctgcggctgaggaagagctctgtgtgccagaatggccgggactatgtggtgaccaagcagcccagcatctgcctgtgcagcctggaggacttcctgtgtgactttggctactacagaccagaaaatgacagcaaatgtgtggagcagcctgagctgaagggccatgacctggagttctgcctgtatggccgggaggagcacctgaccaccaacggctacaggaagatccctggggacaagtgccagggcggcgtgaaccctgtgcgggaggtgaaggacctgaagaagaagtgcaccagcaacttcctgagccctgagaagcagaacagcaagagcaacagcgtgcccatcatcctggccatcgtgggcctgatgctggtgacagtggtggccggcgtgctgattgtgaagaagtatgtgtgtggcggccgcttcctggtgcaccgctacagcgtgctgcagcagcacgccgaggccaacggggtggatggagtggatgccctggacacagccagccacaccaacaagagcggctaccatgatgacagtgatgaggacctgctggagtag

SEQ ID NO: 3438 - DNA, 2085 bp, Artificial Sequence
  Description of Artificial Sequence: Synthetic coding sequence
atgaccttcggccagagcaagctgtacagaagtgaggactatggcaagaacttcaaggacatcacagacctgatcaacaacaccttcatcagaacagaatttggcatggccatcggcccagaaaattctgggaaggtggtgctgacagctgaggtgtctgggggcagccggggcggccgcatcttccgcagcagtgactttgccaagaactttgtgcagacagacctgcccttccaccccctgacccagatgatgtacagcccccagaacagcgactacctgctggccctgagcacagaaaatggcctgtgggtgtccaagaactttggaggcaagtgggaggagatccacaaggctgtgtgcctggccaagtggggcagtgacaacaccatcttcttcaccacctacgccaacggcagctgcacagacctgggcgccctggagctgtggaggaccagtgacctgggcaagagcttcaagaccatcggcgtgaagatctacagctttggcctgggcggccgcttcctgtttgcctctgtgatggctgacaaggacaccacccggcgcatccacgtgtccacagaccagggcgacacctggagcatggcccagctgcccagcgtgggccaggagcagttctacagcatcctggccgccaatgatgacatggtgttcatgcacgtggatgagcccggggacaccggcttcggcaccatcttcaccagtgatgaccggggcatcgtgtacagcaagagcctggacagacacctgtacaccaccactggaggagaaacagacttcaccaacgtgaccagcctgcggggcgtgtacatcacctctgtgctgtctgaggacaacagcatccagaccatgatcacctttgaccagggcggccgctggacccacctgaggaagccagaaaattctgaatgtgatgccacagccaagaacaagaatgaatgttccctgcacatccacgccagctacagcatcagccagaagctgaatgtgcccatggcccccctgtctgagcccaatgctgtgggcatcgtcatcgcccacggctctgtgggagatgccatctctgtgatggtgcctgatgtgtacatcagtgatgatggcggctacagctggaccaagatgctggagggcccccactactacaccatcctggacagcggcggcatcatcgtggccatcgagcacagcagccggcccatcaacgtcatcaagttcagcacagatgagggccagtgctggcagacctacaccttcacccgggaccccatctacttcaccggcctggccagcgagcccggggcccgctccatgaacatcagcatctggggcttcacagagagcttcctgaccagccagtgggtgtcctacaccatcgacttcaaggacatcctggagaggaactgtgaggagaaggactacaccatctggctggcccacagcacagatcctgaagattatgaagatggctgcatcctgggctacaaggagcagttcctgcggctgaggaagagctctgtgtgccagaatggccgggactatgtggtgaccaagcagcccagcatctgcctgtgcagcctggaggacttcctgtgtgactttggctactacagaccagaaaatgacagcaaatgtgtggagcagcctgagctgaagggccatgacctggagttctgcctgtatggccgggaggagcacctgaccaccaacggctacaggaagatccctggggacaagtgccagggcggcgtgaaccctgtgcgggaggtgaaggacctgaagaagaagtgcaccagcaacttcctgagccctgagaagcagaacagcaagagcaacagcgtgcccatcatcctggccatcgtgggcctgatgctggtgacagtggtggccggcgtgctgattgtgaagaagtatgtgtgtggcggccgcttcctggtgcaccgctacagcgtgctgcagcagcacgccgaggccaatggagtggatggagtggatgccctggacacagccagccacaccaacaagagcggctaccatgatgacagtgatgaggacctgctggagtag

SEQ ID NO: 3439 - DNA, 1446 bp, Artificial Sequence
  Description of Artificial Sequence: Synthetic coding sequence
atgaaggtgctgtctgagggccagctgaagctgtgtgtggtgcagcctgtgcacctgacctcctggctgctgatcttcttcatcctgaagagcatcagctgcctgaagccagcccggctgcccatctaccagaggaagcccttcatcgccgcctggaatgcccccacagaccagtgcctgatcaagtacaacctgcggctgaacctgaagatgtttcctgtgattggcagccccctggccaaggcccggggccagaatgtgaccatcttctacgtgaaccggctgggctactacccctggtacaccagccagggcgtgcccatcaatggaggcctgccccagaacatcagcctgcaggtgcacctggagaaggctgaccaggacatcaactactacatcccagctgaggacttcagcggcctggccgtcatcgactgggagtactggaggccccagtgggccaggaactggaacagcaaggatgtgtaccggcagaagagcaggaagctgatcagtgacatgggcaagaatgtgtctgccacagacatcgagtacctggccaaggtgacctttgaggagagcgccaaggccttcatgaaggagaccatcaagctgggcatcaagagccggcccaagggcctgtggggctactacctgtacccagactgccacaactacaacgtgtatgcccccaactacagcggcagctgcccagaagatgaggtgctgaggaacaatgagctgtcctggctgtggaacagcagcgctgccctgtaccccagcattggagtgtggaagagcctgggggacagcgagaacatcctgcgcttcagcaagttccgggtgcatgagagcatgaggatcagcaccatgaccagccatgactatgccctgcctgtgtttgtgtacacccggctgggctacagagatgagcccctcttcttcctgagcaagcaggacctggtgtccaccatcggggagagcgctgccctgggcgccgccggcatcgtcatctggggagacatgaacctgacagccagcaaggccaactgcaccaaggtgaagcagtttgtgtccagtgacctgggcagctacatcgccaacgtgaccagggctgctgaggtgtgcagcctgcacctgtgcaggaacaacggccgctgcatcaggaagatgtggaatgcccccagctacctgcacctgaacccagccagctaccacatcgaggcctctgaagatggagagttcaccgtgaagggcaaggccagtgacacagacctggccgtgatggctgacaccttcagctgccactgctaccagggctatgaaggagctgactgccgggagatcaagacagcagatggctgcagcggcgtgagccccagccctggcagcctgatgaccctgtgcctgctgctgctggccagctaccgcagcatccagctgtag

SEQ ID NO: 3440 - DNA, 1536 bp, Artificial Sequence
  Description of Artificial Sequence: Synthetic coding sequence
atgggcgtgctgaagttcaagcacatcttcttccgcagctttgtgaagagcagcggcgtgtcccagatcgtgttcaccttcctgctgatcccctgctgcctgaccctgaacttccgggcccctcctgtgatccccaacgtgcccttcctgtgggcctggaatgcccccagcgagttctgcctgggcaagtttgatgagcccctggacatgagcctcttctccttcatcggcagcccccgcatcaatgccaccggccagggcgtgaccatcttctacgtggaccggctgggctactacccctacatcgacagcatcaccggggtgacagtgaatggaggcatcccccagaagatcagcctgcaggaccacctggacaaggccaagaaggacatcaccttctacatgcctgtggacaacctgggcatggctgtgattgactgggaggagtggaggcccacctgggccaggaactggaagcccaaggatgtgtacaagaacagaagcattgagctggtgcagcagcagaatgtgcagctgagcctgacagaggccacagagaaggccaagcaggagtttgagaaggccggcaaggacttcctggtggagaccatcaagctgggcaagctgctgcggcccaaccacctgtggggctactacctgttcccagactgctacaaccaccactacaagaagccaggctacaacggcagctgcttcaacgtggagatcaagagaaatgatgacctgtcctggctgtggaatgaaagcacagccctgtaccccagcatctacctgaacacccagcagagccctgtggccgccaccctgtatgtgaggaacagagtgcgggaggccatccgggtgtccaagatcccagatgccaagagccccctgcctgtgtttgcctacacccgcatcgtgttcacagaccaggtgctgaagttcctgagccaggatgagctggtgtacacctttggagagaccgtggccctgggcgccagcggcatcgtcatctggggcaccctgagcatcatgaggtccatgaagagctgcctgctgctggacaactacatggagaccatcctgaacccctacatcatcaacgtgaccctggccgccaagatgtgcagccaggtgctgtgccaggagcagggcgtgtgcatcaggaagaactggaacagcagtgactacctgcacctgaacccagacaactttgccatccagctggagaagggcggcaagttcaccgtgcggggcaagcccaccctggaggacctggagcagttcagcgagaagttctactgcagctgctacagcaccctgagctgcaaggagaaggcagatgtgaaggacacagatgctgtggatgtgtgcatcgcagatggagtgtgcattgatgccttcctgaagccacccatggagacagaggagccccagatcttctacaatgccagccccagcaccctgagcgccaccatgttcatctggaggctggaggtgtgggaccagggcatcagccgcatcggcttcttctag

SEQ ID NO: 3441 - DNA, 1530 bp, Artificial Sequence
  Description of Artificial Sequence: Synthetic coding sequence
atgggcgtgctgaagttcaagcacatcttcttccgcagctttgtgaagagcagcggcgtgtcccagatcgtgttcaccttcctgctgatcccctgctgcctgaccctgaacttccgggcccctcctgtgatccccaacgtgcccttcctgtgggcctggaatgcccccagcgagttctgcctgggcaagtttgatgagcccctggacatgagcctcttctccttcatcggcagcccccgcatcaatgccaccggccagggcgtgaccatcttctacgtggaccggctgggctactacccctacatcgacagcatcaccggggtgacagtgaatggaggcatcccccagaagatcagcctgcaggaccacctggacaaggccaagaaggacatcaccttctacatgcctgtggacaacctgggcatggctgtgattgactgggaggagtggaggcccacctgggccaggaactggaagcccaaggatgtgtacaagaacagaagcattgagctggtgcagcagcagaatgtgcagctgagcctgacagaggccacagagaaggccaagcaggagtttgagaaggccggcaaggacttcctggtggagaccatcaagctgggcaagctgctgcggcccaaccacctgtggggctactacctgttcccagactgctacaaccaccactacaagaagccaggctacaacggcagctgcttcaacgtggagatcaagagaaatgatgacctgtcctggctgtggaatgaaagcacagccctgtaccccagcatctacctgaacacccagcagagccctgtggccgccaccctgtatgtgaggaacagagtgcgggaggccatccgggtgtccaagatcccagatgccaagagccccctgcctgtgtttgcctacacccgcatcgtgttcacagaccaggtgctgaagttcctgagccaggatgagctggtgtacacctttggagagaccgtggccctgggcgccagcggcatcgtcatctggggcaccctgagcatcatgaggtccatgaagagctgcctgctgctggacaactacatggagaccatcctgaacccctacatcatcaacgtgaccctggccgccaagatgtgcagccaggtgctgtgccaggagcagggcgtgtgcatcaggaagaactggaacagcagtgactacctgcacctgaacccagacaactttgccatccagctggagaagggcggcaagttcaccgtgcggggcaagcccaccctggaggacctggagcagttcagcgagaagttctactgcagctgctacagcaccctgagctgcaaggagaaggcagatgtgaaggacacagatgctgtggatgtgtgcatcgcagatggagtgtgcattgatgccttcctgaagccacccatggagacagaggagccccagatcttctacaatgccagccccagcaccctgagcgccaccatgtttattgtgtccatcctcttcctgatcatcagctctgtggccagcctgtag

SEQ ID NO: 3442 - DNA, 243 bp, Artificial Sequence
  Description of Artificial Sequence: Synthetic coding sequence
atgggcgtgctgaagttcaagcacatcttcttccgcagctttgtgaagagcagcggcgtgtcccagatcgtgttcaccttcctgctgatcccctgctgcctgaccctgaacttccgggcccctcctgtgatccccaacgtgcccttcctgtgggcctggaatgcccccagcgagttctgcctgggcaagtttgatgagcccctggacatgagcctcttctccttcatcggcagccccaggtag

SEQ ID NO: 3443 - DNA, 1530 bp, Artificial Sequence; identical to SEQ ID NO: 3441
  Description of Artificial Sequence: Synthetic coding sequence

SEQ ID NO: 3444 - DNA, 1530 bp, Artificial Sequence; identical to SEQ ID NO: 3441
  Description of Artificial Sequence: Synthetic coding sequence

SEQ ID NO: 3445 - DNA, 1764 bp, Artificial Sequence
  Description of Artificial Sequence: Synthetic coding sequence
atgccccgctacggggccagcctgcggcagagctgccccaggagcggccgggagcagggccaggacggcacagctggggcccctggcctgctgtggatgggcctggtgctggccctggccctggccctggccctggccctggccctgagtgacagccgggtgctgtgggccccagctgaggcccaccccctgagcccccagggccacccagcccggctgcaccgcatcgtgccccggctgagagatgtgtttggctggggcaacctgacctgccccatctgcaagggcctcttcaccgccatcaacctgggcctgaagaaggagcccaacgtggcccgggtgggctctgtggccatcaagctgtgcaacctgctgaagatcgcccctcctgctgtgtgccagagcatcgtgcacctgtttgaagatgacatggtggaggtgtggaggagatctgtgctgagccccagcgaggcctgtggcctgctgctgggcagcacctgtggccactgggacatcttcagctcctggaacatcagcctgcccaccgtgcccaagcccccacccaagccacccagccccccagcccctggggcccctgtgagccgcatcctcttcctgacagacctgcactgggaccatgactacctggagggcacagatcctgactgtgccgaccccctgtgctgccggcggggcagcggcctgcccccagccagcaggcctggagctggctactggggcgagtacagcaaatgtgacctgcccctgcggaccctggagagcctgctgagcggcctgggccctgctggcccctttgacatggtgtactggacaggagacatcccagcccatgatgtgtggcaccagacccggcaggaccagctgcgggccctgaccaccgtgacagccctggtgaggaagttcctgggccctgtgcctgtgtacccagctgtgggcaaccacgagagcacccctgtgaacagcttccccccacccttcatcgagggcaaccacagcagccgctggctgtatgaggccatggccaaggcctgggagccctggctgcctgctgaggccctgcggaccctgcgctacctgagctctgtggagacccaggagggcaagaggaaggtgcacatcatcggccacatccccccaggccactgcctgaagtcctggagctggaactactaccgcatcgtggcccgctatgagaacaccctggccgcccagttcttcggccacacccacgtggatgaatttgaggtgttctatgatgaggagaccctgagccggcccctggccgtggccttcctggcccccagcgccaccacctacatcggcctgaaccctggctacagagtgtaccagattgatggcaactacagcggcagcagccacgtggtgctggaccacgagacctacatcctgaacctgacccaggccaacatccctggggccatcccccactggcagctgctgtaccgggcccgggagacctacggcctgcccaacaccctgcccacagcctggcacaacctggtgtacaggatgagaggagacatgcagctgttccagaccttctggttcctgtaccacaagggccaccccccatctgagccctgtggcaccccctgccgcctggccaccctgtgtgcccagctgagcgcccgggctgacagccctgccctgtgccgccacctgatgccagatggcagcctgcctgaggcccagagcctgtggccccggcccctcttctgctag

SEQ ID NO: 3446 - DNA, 1896 bp, Artificial Sequence
  Description of Artificial Sequence: Synthetic coding sequence
atgccccgctacggggccagcctgcggcagagctgccccaggagcggccgggagcagggccaggacggcacagctggggcccctggcctgctgtggatgggcctggtgctggccctggccctggccctggccctggccctggccctgagtgacagccgggtgctgtgggccccagctgaggcccaccccctgagcccccagggccacccagcccggctgcaccgcatcgtgccccggctgagagatgtgtttggctggggcaacctgacctgccccatctgcaagggcctcttcaccgccatcaacctgggcctgaagaaggagcccaacgtggcccgggtgggctctgtggccatcaagctgtgcaacctgctgaagatcgcccctcctgctgtgtgccagagcatcgtgcacctgtttgaagatgacatggtggaggtgtggaggagatctgtgctgagccccagcgaggcctgtggcctgctgctgggcagcacctgtggccactgggacatcttcagctcctggaacatcagcctgcccaccgtgcccaagcccccacccaagccacccagccccccagcccctggggcccctgtgagccgcatcctcttcctgacagacctgcactgggaccatgactacctggagggcacagatcctgactgtgccgaccccctgtgctgccggcggggcagcggcctgcccccagccagcaggcctggagctggctactggggcgagtacagcaaatgtgacctgcccctgcggaccctggagagcctgctgagcggcctgggccctgctggcccctttgacatggtgtactggacaggagacatcccagcccatgatgtgtggcaccagacccggcaggaccagctgcgggccctgaccaccgtgacagccctggtgaggaagttcctgggccctgtgcctgtgtacccagctgtgggcaaccacgagagcacccctgtgaacagcttccccccacccttcatcgagggcaaccacagcagccgctggctgtatgaggccatggccaaggcctgggagccctggctgcctgctgaggccctgcggaccctgagaattggaggcttctacgccctgagcccctacccaggcctgcggctcatcagcctgaacatgaacttctgcagccgggagaacttctggctgctgatcaacagcacagatcctgctggccagctgcagtggctggtgggggagctgcaggccgctgaggacagaggagacaaggtgcacatcatcggccacatccccccaggccactgcctgaagtcctggagctggaactactaccgcatcgtggcccgctatgagaacaccctggccgcccagttcttcggccacacccacgtggatgaatttgaggtgttctatgatgaggagaccctgagccggcccctggccgtggccttcctggcccccagcgccaccacctacatcggcctgaaccctggctacagagtgtaccagattgatggcaactacagcggcagcagccacgtggtgctggaccacgagacctacatcctgaacctgacccaggccaacatccctggggccatcccccactggcagctgctgtaccgggcccgggagacctacggcctgcccaacaccctgcccacagcctggcacaacctggtgtacaggatgagaggagacatgcagctgttccagaccttctggttcctgtaccacaagggccaccccccatctgagccctgtggcaccccctgccgcctggccaccctgtgtgcccagctgagcgcccgggctgacagccctgccctgtgccgccacctgatgccagatggcagcctgcctgaggcccagagcctgtggccccggcccctcttctgctag

SEQ ID NO: 3447 - DNA, 1728 bp, Artificial Sequence
  Description of Artificial Sequence: Synthetic coding sequence
atgccccgctacggggccagcctgcggcagagctgccccaggagcggccgggagcagggccaggacggcacagctggggcccctggcctgctgtggatgggcctggtgctggccctggccctggccctggccctggccctggccctgagtgacagccgggtgctgtgggccccagctgaggcccaccccctgagcccccagggccacccagcccggctgcaccgcatcgtgccccggctgagagatgtgtttggctggggcaacctgacctgccccatctgcaagggcctcttcaccgccatcaacctgggcctgaagaaggagcccaacgtggcccgggtgggctctgtggccatcaagctgtgcaacctgctgaagatcgcccctcctgctgtgtgccagagcatcgtgcacctgtttgaagatgacatggtggaggtgtggaggagatctgtgctgagccccagcgaggcctgtggcctgctgctgggcagcacctgtggccactgggacatcttcagctcctggaacatcagcctgcccaccgtgcccaagcccccacccaagccacccagccccccagcccctggggcccctgtgagccgcatcctcttcctgacagacctgcactgggaccatgactacctggagggcacagatcctgactgtgccgaccccctgtgctgccggcggggcagcggcctgcccccagccagcaggcctggagctggctactggggcgagtacagcaaatgtgacctgcccctgcggaccctggagagcctgctgagcggcctgggccctgctggcccctttgacatggtgtactggacaggagacatcccagcccatgatgtgtggcaccagacccggcaggaccagctgcgggccctgaccaccgtgacagccctggtgaggaagttcctgggccctgtgcctgtgtacccagctgtgggcaaccacgagagcacccctgtgaacagcttccccccacccttcatcgagggcaaccacagcagccgctggctgtatgaggccatggccaaggcctgggagccctggctgcctgctgaggccctgcggaccctgaggaaggtgcacatcatcggccacatccccccaggccactgcctgaagtcctggagctggaactactaccgcatcgtggcccgctatgagaacaccctggccgcccagttcttcggccacacccacgtggatgaatttgaggtgttctatgatgaggagaccctgagccggcccctggccgtggccttcctggcccccagcgccaccacctacatcggcctgaaccctggctacagagtgtaccagattgatggcaactacagcggcagcagccacgtggtgctggaccacgagacctacatcctgaacctgacccaggccaacatccctggggccatcccccactggcagctgctgtaccgggcccgggagacctacggcctgcccaacaccctgcccacagcctggcacaacctggtgtacaggatgagaggagacatgcagctgttccagaccttctggttcctgtaccacaagggccaccccccatctgagccctgtggcaccccctgccgcctggccaccctgtgtgcccagctgagcgcccgggctgacagccctgccctgtgccgccacctgatgccagatggcagcctgcctgaggcccagagcctgtggccccggcccctcttctgctag

SEQ ID NO: 3448 - DNA, 1893 bp, Artificial Sequence
  Description of Artificial Sequence: Synthetic coding sequence
atgccccgctacggggccagcctgcggcagagctgccccaggagcggccgggagcagggccaggacggcacagctggggcccctggcctgctgtggatgggcctggtgctggccctggccctggccctggccctggccctggccctgagtgacagccgggtgctgtgggccccagctgaggcccaccccctgagcccccagggccacccagcccggctgcaccgcatcgtgccccggctgagagatgtgtttggctggggcaacctgacctgccccatctgcaagggcctcttcaccgccatcaacctgggcctgaaggagcccaacgtggcccgggtgggctctgtggccatcaagctgtgcaacctgctgaagatcgcccccccagctgtgtgccagagcatcgtgcacctgtttgaagatgacatggtggaggtgtggaggagatctgtgctgagccccagcgaggcctgtggcctgctgctgggcagcacctgtggccactgggacatcttcagctcctggaacatcagcctgcccaccgtgcccaagcccccacccaagccacccagccccccagcccctggggcccctgtgagccgcatcctcttcctgacagacctgcactgggaccatgactacctggagggcacagatcctgactgtgccgaccccctgtgctgcagaagaggcagcggcctgcccccagccagcaggcctggggccggctactggggcgagtacagcaaatgtgacctgcccctgcggaccctggagagcctgctgagcggcctgggccctgctggcccctttgacatggtgtactggacaggagacatcccagcccatgatgtgtggcaccagacccggcaggaccagctgcgggccctgaccaccgtgacagccctggtgaggaagttcctgggccctgtgcctgtgtacccagctgtgggcaaccacgagagcacccctgtgaacagcttccccccacccttcatcgagggcaaccacagcagccgctggctgtatgaggccatggccaaggcctgggagccctggctgcctgctgaggccctgcggaccctgcgcatcggcggcttctacgccctgagcccctacccaggcctgcggctcatcagcctgaacatgaacttctgcagccgggagaacttctggctgctgatcaacagcacagatcctgctggccagctgcagtggctggtgggggagctgcaggccgcagaagatagaggagacaaggtgcacatcatcggccacatccccccaggccactgcctgaagtcctggagctggaactactacagaattgtggcccgctatgagaacaccctggccgcccagttcttcggccacacccacgtggatgaatttgaggtgttctatgatgaggagaccctgagccggcccctggccgtggccttcctggcccccagcgccaccacctacatcggcctgaaccctggctacagagtgtaccagattgatggcaactacagcggcagcagccacgtggtgctggaccacgagacctacatcctgaacctgacccaggccaacatccctggggccatcccccactggcagctgctgtaccgggcccgggagacctacggcctgcccaacaccctgcccacagcctggcacaacctggtgtacaggatgagaggagacatgcagctgttccagaccttctggttcctgtaccacaagggccacccccccagcgagccctgtggcaccccctgccgcctggccaccctgtgtgcccagctgagcgcccgggctgacagccctgccctgtgccgccacctgatgccagatggcagcctgcctgaggcccagagcctgtggccccggcccctcttctgctag

SEQ ID NO: 3449 - DNA, 1101 bp, Artificial Sequence
  Description of Artificial Sequence: Synthetic coding sequence
atgccccgctacggggccagcctgcggcagagctgccccaggagcggccgggagcagggccaggacggcacagctggggcccctggcctgctgtggatgggcctggtgctggccctggccctggccctggccctggccctggccctgagtgacagccgggtgctgtgggccccagctgaggcccaccccctgagcccccagggccacccagcccggctgcaccgcatcgtgccccggctgagagatgtgtttggctggggcaacctgacctgccccatctgcaagggcctcttcaccgccatcaacctgggcctgaagaaggagcccaacgtggcccgggtgggctctgtggccatcaagctgtgcaacctgctgaagatcgcccctcctgctgtgtgccagagcatcgtgcacctgtttgaagatgacatggtggaggtgtggaggagatctgtgctgagccccagcgaggcctgtggcctgctgctgggcagcacctgtggccactgggacatcttcagctcctggaacatcagcctgcccaccgtgcccaagcccccacccaagccacccagccccccagcccctggggcccctgtgagccgcatcctcttcctgacagacctgcactgggaccatgactacctggagggcacagatcctgactgtgccgaccccctgtgctgccggcggggcagcggcctgcccccagccagcaggcctggagctggctactggggcgagtacagcaaatgtgacctgcccctgcggaccctggagagcctgctgagcggcctgggccctgctggcccctttgacatggtgtactggacaggagacatcccagcccatgatgtgtggcaccagacccggcaggaccagctgcgggccctgaccaccgtgacagccctggtgaggaagttcctgggccctgtgcctgtgtacccagctgtgggcaaccacgagagcacccctgtgaacagcttccccccacccttcatcgagggcaaccacagcagccgctggctgtatgaggccatggccaaggcctgggagccctggctgcctgctgaggccctgcggaccctgcgctgcatctag

SEQ ID NO: 3450 - DNA, 1209 bp, Artificial Sequence
  Description of Artificial Sequence: Synthetic coding sequence
atgccccgctacggggccagcctgcggcagagctgccccaggagcggccgggagcagggccaggacggcacagctggggcccctggcctgctgtggatgggcctggtgctggccctggccctggccctggccctggccctggccctgagtgacagccgggtgctgtgggccccagctgaggcccaccccctgagcccccagggccacccagcccggctgcaccgcatcgtgccccggctgagagatgtgtttggctggggcaacctgacctgccccatctgcaagggcctcttcaccgccatcaacctgggcctgaagaaggagcccaacgtggcccgggtgggctctgtggccatcaagctgtgcaacctgctgaagatcgcccctcctgctgtgtgccagagcatcgtgcacctgtttgaagatgacatggtggaggtgtggaggagatctgtgctgagccccagcgaggcctgtggcctgctgctgggcagcacctgtggccactgggacatcttcagctcctggaacatcagcctgcccaccgtgcccaagcccccacccaagccacccagccccccagcccctggggcccctgtgagccgcatcctcttcctgacagacctgcactgggaccatgactacctggagggcacagatcctgactgtgccgaccccctgtgctgccggcggggcagcggcctgcccccagccagcaggcctggagctggctactggggcgagtacagcaaatgtgacctgcccctgcggaccctggagagcctgctgagcggcctgggccctgctggcccctttgacatggtgtactggacaggagacatcccagcccatgatgtgtggcaccagacccggcaggaccagctgcgggccctgaccaccgtgacagccctggtgaggaagttcctgggccctgtgcctgtgtacccagctgtgggcaaccacgagagcacccctgtgaacagcttccccccacccttcatcgagggcaaccacagcagccgctggctgtatgaggccatggccaaggcctgggagccctggctgcctgctgaggccctgcggaccctgcgctacctgagctctgtggagacccaggagggcaagaggaagaactggggcgtgctgtgcagcttccccatccccaggagccccccccacctgagccagtatgagttcctgttcccctag

SEQ ID NO: 3451 - DNA, 954 bp, Artificial Sequence
  Description of Artificial Sequence: Synthetic coding sequence
atgtacaacatgatggagacagagctgaagcccccaggcccccagcagaccagcggcggcggcggcggcaacagcacagctgctgctgctgggggcaaccagaagaacagcccagacagagtgaagaggcccatgaatgccttcatggtgtggagccggggccagaggaggaagatggcccaggagaaccccaagatgcacaacagcgagatcagcaagaggctgggcgctgagtggaagctgctgtctgaaacagagaagaggcccttcattgatgaggccaagaggctgcgggccctgcacatgaaggagcacccagactacaagtaccggcccaggaggaagaccaagaccctgatgaagaaggacaagtacaccctgcccggcggcctgctggcccctgggggcaacagcatggccagcggcgtgggcgtgggcgccggcctgggcgccggcgtgaaccagaggatggacagctatgcccacatgaatggctggagcaatggcagctacagcatgatgcaggaccagctgggctacccccagcaccctggcctgaatgcccatggagctgcccagatgcagcccatgcacagatatgatgtgtctgccctgcagtacaacagcatgaccagcagccagacctacatgaatggcagccccacctacagcatgagctacagccagcagggcaccccaggcatggccctgggctccatgggctctgtggtgaagtctgaggccagcagcagcccccctgtggtgaccagcagcagccacagccgggccccctgccaggccggggacctgcgggacatgatctccatgtacctgcctggagctgaggtgcctgagcctgctgcccccagccggctgcacatgagccagcactaccagagcggccctgtgcccggcacagccatcaatggcaccctgcccctgagccacatgtag

SEQ ID NO: 3452 - DNA, 954 bp, Artificial Sequence; identical to SEQ ID NO: 3451
  Description of Artificial Sequence: Synthetic coding sequence

SEQ ID NO: 3453 - DNA, 1182 bp, Artificial Sequence
  Description of Artificial Sequence: Synthetic coding sequence
atgcaccaggccggctacccaggctgccgcggggccatggccgagagccacctgctgcagtggctgctgctgctgctgcccaccctgtgtggccctggaacagctgcctggaccaccagcagcctggcctgtgcccagggccctgagttctggtgccagagcctggagcaggccctgcagtgccgggccctgggccactgcctgcaggaggtgtggggccacgtgggcgcagatgacctgtgccaggagtgtgaagatattgtgcacatcctgaacaagatggccaaggaggccatcttccaggacaccatgaggaagttcctggagcaggagtgcaatgtgctgcccctgaagctgctgatgccccagtgcaaccaggtgctggatgactacttccccctggtgattgactacttccagaaccagacagacagcaatggcatctgcatgcacctgggcctgtgcaagagccggcagcctgagcctgagcaggagcccggcatgtctgaccccctgcccaagcccctgcgggaccccctgcctgaccccctgctggacaagctggtgctgcctgtgctgcccggggccctgcaggcccggcccggcccccacacccaggacctgtctgagcagcagttccccatccccctgccctactgctggctgtgccgggccctgatcaagaggatccaggccatgatccccaagggggccctggccgtggccgtggcccaggtgtgccgggtggtgcccctggtggccggcggcatctgccagtgcctggccgagcgctacagcgtcatcctgctggacaccctgctgggccgcatgctgccccagctggtgtgccgcctggtgctgcgctgcagcatggatgacagcgctggccccaggagccccactggagagtggctgccccgggacagcgagtgccacctgtgcatgtctgtgaccacccaggccggcaacagcagcgagcaggccatcccccaggccatgctgcaggcctgtgtgggctcctggctggaccgggagaagtgcaagcagtttgtggagcagcacaccccccagctgctgaccctggtgccccggggctgggatgcccacaccacctgccaggccctgggcgtgtgtggcaccatgagcagccccctgcagtgcatccacagcccagacctgtag

SEQ ID NO: 3454 - DNA, 1182 bp, Artificial Sequence; identical to SEQ ID NO: 3453
  Description of Artificial Sequence: Synthetic coding sequence

SEQ ID NO: 3455 - DNA, 1050 bp, Artificial Sequence
  Description of Artificial Sequence: Synthetic coding sequence
atggccgagagccacctgctgcagtggctgctgctgctgctgcccaccctgtgtggccctggaacagctgcctggaccaccagcagcctggcctgtgcccagggccctgagttctggtgccagagcctggagcaggccctgcagtgccgggccctgggccactgcctgcaggacaccatgaggaagttcctggagcaggagtgcaatgtgctgcccctgaagctgctgatgccccagtgcaaccaggtgctggatgactacttccccctggtgattgactacttccagaaccagacagacagcaatggcatctgcatgcacctgggcctgtgcaagagccggcagcctgagcctgagcaggagcccggcatgtctgaccccctgcccaagcccctgcgggaccccctgcctgaccccctgctggacaagctggtgctgcctgtgctgcccggggccctgcaggcccggcccggcccccacacccaggacctgtctgagcagcagttccccatccccctgccctactgctggctgtgccgggccctgatcaagaggatccaggccatgatccccaagggggccctggccgtggccgtggcccaggtgtgccgggtggtgcccctggtggccggcggcatctgccagtgcctggccgagcgctacagcgtcatcctgctggacaccctgctgggccgcatgctgccccagctggtgtgccgcctggtgctgcgctgcagcatggatgacagcgctggccccaggagccccactggagagtggctgccccgggacagcgagtgccacctgtgcatgtctgtgaccacccaggccggcaacagcagcgagcaggccatcccccaggccatgctgcaggcctgtgtgggctcctggctggaccgggagaagtgcaagcagtttgtggagcagcacaccccccagctgctgaccctggtgccccggggctgggatgcccacaccacctgccaggccctgggcgtgtgtggcaccatgagcagccccctgcagtgcatccacagcccagacctgtag

SEQ ID NO: 3456 - DNA, 1152 bp, Artificial Sequence
  Description of Artificial Sequence: Synthetic coding sequence
ggggccatggccgagagccacctgctgcagtggctgctgctgctgctgcccaccctgtgtggccctggaacagctgcctggaccaccagcagcctggcctgtgcccagggccctgagttctggtgccagagcctggagcaggccctgcagtgccgggccctgggccactgcctgcaggaggtgtggggccacgtgggcgcagatgacctgtgccaggagtgtgaagatattgtgcacatcctgaacaagatggccaaggaggccatcttccaggacaccatgaggaagttcctggagcaggagtgcaatgtgctgcccctgaagctgctgatgccccagtgcaaccaggtgctggatgactacttccccctggtgattgactacttccagaaccagacagacagcaatggcatctgcatgcacctgggcctgtgcaagagccggcagcctgagcctgagcaggagcccggcatgtctgaccccctgcccaagcccctgcgggaccccctgcctgaccccctgctggacaagctggtgctgcctgtgctgcccggggccctgcaggcccggcccggcccccacacccaggacctgtctgagcagcagttccccatccccctgccctactgctggctgtgccgggccctgatcaagaggatccaggccatgatccccaagggggccctggccgtggccgtggcccaggtgtgccgggtggtgcccctggtggccggcggcatctgccagtgcctggccgagcgctacagcgtcatcctgctggacaccctgctgggccgcatgctgccccagctggtgtgccgcctggtgctgcgctgcagcatggatgacagcgctggccccaggagccccactggagagtggctgccccgggacagcgagtgccacctgtgcatgtctgtgaccacccaggccggcaacagcagcgagcaggccatcccccaggccatgctgcaggcctgtgtgggctcctggctggaccgggagaagtgcaagcagtttgtggagcagcacaccccccagctgctgaccctggtgccccggggctgggatgcccacaccacctgccaggccctgggcgtgtgtggcaccatgagcagccccctgcagtgcatccacagcccagacctgtag

SEQ ID NO: 3457 - DNA, 1728 bp, Artificial Sequence
  Description of Artificial Sequence: Synthetic coding sequence
atgctgggcgtgctggtgctgggcgccctggccctggccggcctgggcttccctgccccagctgagccccagcccggcggcagccagtgtgtggagcatgactgctttgccctgtacccaggccctgccaccttcctgaatgccagccagatctgtgatggcctgcggggccacctgatgacagtgcgcagctctgtggccgcagatgtgatcagcctgctgctgaatggagatggcggcgtgggcagaagaaggctgtggattggcctgcagctgcccccaggctgtggggaccccaagaggctgggccccctgcggggcttccagtgggtgactggagacaacaacaccagctacagccgctgggcccggctggacctgaatggagcccccctgtgtggccccctgtgtgtggccgtgtctgctgctgaggccaccgtgcccagcgagcccatctgggaggagcagcagtgtgaggtgaaggcagatggcttcctgtgtgagttccacttccctgccacctgccggcccctggccgtggagcccggggctgctgctgctgctgtgtccatcacctacggcaccccatttgctgcccggggagctgacttccaggccctgcctgtgggcagcagcgctgctgtggcccccctgggcctgcagctgatgtgcacagcccctcctggagctgtgcagggccactgggcccgggaggcccctggggcctgggactgcagcgtggagaatggaggctgtgagcacgcctgcaatgccatccctggggccccccgctgccagtgcccagctggagctgccctgcaggctgatggccgcagctgcacagccagcgccacccagagctgcaatgacctgtgtgagcacttctgtgtgcccaacccagaccagcccggcagctacagctgcatgtgtgagaccggctaccgcctggccgctgaccagcaccgctgtgaagatgtggatgactgcatcctggagcccagcccctgcccccagagatgtgtgaacacccagggcggctttgagtgccactgctaccccaactatgacctggtggatggagaatgtgtggagcctgtggacccctgcttccgggccaactgtgagtaccagtgccagcccctgaaccagaccagctacctgtgtgtgtgtgccgagggctttgcccccatcccccatgagccccaccgctgccagatgttctgcaaccagacagcctgcccagctgactgtgaccccaacacccaggccagctgtgagtgcccagagggctacatcctggatgatggcttcatctgcacagacattgatgaatgtgaaaatggaggcttctgcagcggcgtgtgccacaacctgcccggcacctttgagtgcatctgtggccctgacagcgccctggcccggcacatcggcacagactgtgacagcggcaaggtggatggaggagacagcggcagcggggagcccccacccagccccaccccaggcagcaccctgaccccacctgctgtgggcctggtgcacagcggcctgctgattggcatcagcatcgccagcctgtgcctggtggtggccctgctggccctgctgtgccacctgaggaagaagcagggcgccgcccgggccaagatggagtacaagtgtgccgcccccagcaaggaggtggtgctgcagcacgtgaggacagagaggaccccccagaggctgtag

SEQ ID NO: 3458 - DNA, 1674 bp, Artificial Sequence
  Description of Artificial Sequence: Synthetic coding sequence
atgtctgaggccgccagccagggcctgcgggccgccgcccggtctgtgtgggccggcacagaccggcggggctgccgccaccggcggcctgtgcccctgtgcagcggcacagccctgagccagtgcccccgcttcccccggcggctgcatgctgcccggctgggcaacatgctgggcgtgctggtgctgggcgccctggccctggccggcctgggcttccctgcccctggctgtggggaccccaagaggctgggccccctgcggggcttccagtgggtgactggagacaacaacaccagctacagccgctgggcccggctggacctgaatggagcccccctgtgtggccccctgtgtgtggccgtgtctgctgctgaggccaccgtgcccagcgagcccatctgggaggagcagcagtgtgaggtgaaggcagatggcttcctgtgtgagttccacttccctgccacctgccggcccctggccgtggagcccggggctgctgctgctgctgtgtccatcacctacggcaccccatttgctgcccggggagctgacttccaggccctgcctgtgggcagcagcgctgctgtggcccccctgggcctgcagctgatgtgcacagcccctcctggagctgtgcagggccactgggcccgggaggcccctggggcctgggactgcagcgtggagaatggaggctgtgagcacgcctgcaatgccatccctggggccccccgctgccagtgcccagctggagctgccctgcaggctgatggccgcagctgcacagccagcgccacccagagctgcaatgacctgtgtgagcacttctgtgtgcccaacccagaccagcccggcagctacagctgcatgtgtgagaccggctaccgcctggccgctgaccagcaccgctgtgaagatgtggatgactgcatcctggagcccagcccctgcccccagagatgtgtgaacacccagggcggctttgagtgccactgctaccccaactatgacctggtggatggagaatgtgtggagcctgtggacccctgcttccgggccaactgtgagtaccagtgccagcccctgaaccagaccagctacctgtgtgtgtgtgccgagggctttgcccccatcccccatgagccccaccgctgccagatgttctgcaaccagacagcctgcccagctgactgtgaccccaacacccaggccagctgtgagtgcccagagggctacatcctggatgatggcttcatctgcacagacattgatgaatgtgaaaatggaggcttctgcagcggcgtgtgccacaacctgcccggcacctttgagtgcatctgtggccctgacagcgccctggcccggcacatcggcacagactgtgacagcggcaaggtggatggaggagacagcggcagcggggagcccccacccagccccaccccaggcagcaccctgaccccacctgctgtgggcctggtgcacagcggcctgctgattggcatcagcatcgccagcctgtgcctggtggtggccctgctggccctgctgtgccacctgaggaagaagcagggcgccgcccgggccaagatggagtacaagtgtgccgcccccagcaaggaggtggtgctgcagcacgtgaggacagagaggaccccccagaggctgtag

SEQ ID NO: 3459 - DNA, 1062 bp, Artificial Sequence
  Description of Artificial Sequence: Synthetic coding sequence
atggagctgacagagctgctgctggtggtgatgctgctgctgacagcccggctgaccctgagcagccctgcccccccagcctgtgacctgcgggtgctgagcaagctgctgcgggacagccacgtgctgcacagccggctgagccagtgcccagaggtgcaccccctgcccacccctgtgctgctgcctgctgtggacttcagcctgggggagtggaagacccagatggaggagaccaaggcccaggacatcctgggcgctgtgaccctgctgctggagggcgtgatggccgcccggggccagctgggccccacctgcctgagcagcctgctgggccagctgagcggccaggtgcggctgctgctgggcgccctgcagagcctgctgggcacccagctgcccccccagggccgcaccacagcccacaaggaccccaatgccatcttcctgtccttccagcacctgctgcggggcaaggtgcgcttcctgatgctggtgggcggcagcaccctgtgtgtgcggcgggccccacccaccacagctgtgcccagcaggaccagcctggtgctgaccctgaatgagctgcccaacagaaccagcggcctgctggagaccaacttcaccgccagcgcccggaccaccggcagcggcctgctgaagtggcagcagggcttccgggccaagatccctggcctgctgaaccagaccagccgcagcctggaccagatccctggctacctgaaccgcatccacgagctgctgaatggcacccggggcctcttccctggccccagcaggaggaccctgggcgccccagacatcagcagcggcaccagtgacaccggcagcctgccccccaacctgcagcccggctacagccccagccccacccaccccccaacaggccagtacaccctcttccccctgccccccaccctgcccacccctgtggtgcagctgcaccccctgctgcctgaccccagcgcccccacccccacccccaccagccccctgctgaacaccagctacacccacagccagaacctgagccaggagggctag

SEQ ID NO: 3460 - DNA, 945 bp, Artificial Sequence
  Description of Artificial Sequence: Synthetic coding sequence
atggagctgacagagctgctgctggtggtgatgctgctgctgacagcccggctgaccctgagcagccctgcccccccagcctgtgacctgcgggtgctgagcaagctgctgcgggacagccacgtgctgcacagccggctgagccagtgcccagaggtgcaccccctgcccacccctgtgctgctgcctgctgtggacttcagcctgggggagtggaagacccagatggaggagaccaaggcccaggacatcctgggcgctgtgaccctgctgctggagggcgtgatggccgcccggggccagctgggccccacctgcctgagcagcctgctgggccagctgagcggccaggtgcggctgctgctgggcgccctgcagagcctgctgggcacccagctgcccccccagggccgcaccacagcccacaaggaccccaatgccatcttcctgtccttccagcacctgctgcggggcaagaccagcggcctgctggagaccaacttcaccgccagcgcccggaccactggaagtggcctgctgaagtggcagcagggcttccgggccaagatccctggcctgctgaaccagaccagccgcagcctggaccagatccctggctacctgaaccgcatccacgagctgctgaatggcacccggggcctcttccctggccccagcaggaggaccctgggcgccccagacatcagcagcggcaccagtgacaccggcagcctgccccccaacctgcagcccggctacagccccagccccacccacccccccaccggccagtacaccctcttccccctgccccccaccctgcccacccctgtggtgcagctgcaccccctgctgcctgaccccagcgcccccacccccacccccaccagccccctgctgaacaccagctacacccacagccagaacctgagccaggagggctag

SEQ ID NO: 3461 - DNA, 861 bp, Artificial Sequence
  Description of Artificial Sequence: Synthetic coding sequence
atggagctgacagagctgctgctggtggtgatgctgctgctgacagcccggctgaccctgagcagccctgcccccccagcctgtgacctgcgggtgctgagcaagctgctgcgggacagccacgtgctgcacagccggctgagccagtgcccagaggtgcaccccctgcccacccctgtgctgctgcctgctgtggacttcagcctgggggagtggaagacccagatggaggagaccaaggcccaggacatcctgggcgctgtgaccctgctgctggagggcgtgatggccgcccggggccagctgggccccacctgcctgagcagcctgctgggccagctgagcggccaggtgcggctgctgctgggcgccctgcagagcctgctgggcacccagctgcccccccagggccgcaccacagcccacaaggaccccaatgccatcttcctgtccttccagcacctgctgcggggcaaggacttctggatcgtgggggacaagctgcactgcctgagccagaactactggctgtgggccagcgaggtggccgccggcatccagagccaggacagctggagcgctgagcccaacctgcaggtgcccggccccaacccccgcatccctgagcaggacaccaggaccctggagtggaacagctggaccctgtcctggaccctgacccaggaccccaggagccctggccacttcctgaggaacatccgccaccggctgcctgccacccagcccccagcctggatcttctccttccccaaccccagcagctactggacagtgtatgccctgcccagcagcacccacctggcccacccctgtggccctgcccctcctccagccagctag

SEQ ID NO: 3462 - DNA, 1050 bp, Artificial Sequence
  Description of Artificial Sequence: Synthetic coding sequence
atggagctgacagagctgctgctggtggtgatgctgctgctgacagcccggctgaccctgagcagccctgcccccccagcctgtgacctgcgggtgctgagcaagctgctgcgggacagccacgtgctgcacagccggctgagccagtgcccagaggtgcaccccctgcccacccctgtgctgctgcctgctgtggacttcagcctgggggagtggaagacccagatggaggagaccaaggcccaggacatcctgggcgctgtgaccctgctgctggagggcgtgatggccgcccggggccagctgggccccacctgcctgagcagcctgctgggccagctgagcggccaggtgcggctgctgctgggcgccctgcagagcctgctgggcacccagggccgcaccacagcccacaaggaccccaatgccatcttcctgtccttccagcacctgctgcggggcaaggtgcgcttcctgatgctggtgggcggcagcaccctgtgtgtgcggcgggccccacccaccacagctgtgcccagcaggaccagcctggtgctgaccctgaatgagctgcccaacagaaccagcggcctgctggagaccaacttcaccgccagcgcccggaccaccggcagcggcctgctgaagtggcagcagggcttccgggccaagatccctggcctgctgaaccagaccagccgcagcctggaccagatccctggctacctgaaccgcatccacgagctgctgaatggcacccggggcctcttccctggccccagcaggaggaccctgggcgccccagacatcagcagcggcaccagtgacaccggcagcctgccccccaacctgcagcccggctacagccccagccccacccaccccccaacaggccagtacaccctcttccccctgccccccaccctgcccacccctgtggtgcagctgcaccccctgctgcctgaccccagcgcccccacccccacccccaccagccccctgctgaacaccagctacacccacagccagaacctgagccaggagggctag

SEQ ID NO: 3463 - DNA, 963 bp, Artificial Sequence
  Description of Artificial Sequence: Synthetic coding sequence
atgcccatgtaccaggtgaagccctaccacggcggcggggcccccctgcgggtggagctgcccacctgcatgtaccgcctgcccaacgtgcacggccgctcctatggccctgcccctggagctggccacgtgcaggaggagagcaacctgagcctgcaggccctggagagccggcaggatgacatcctgaagaggctgtatgagctgaaggctgctgtggatggcctgagcaagatgatccagaccccagatgctgacctggatgtgaccaacatcatccaggctgatgagcccaccaccctgaccaccaatgccctggacctgaacagcgtgctgggcaaggactatggagccctgaaggacatcgtcatcaatgccaacccagccagcccccccctgagcctgctggtgctgcaccggctgctgtgtgagcacttccgggtgctgagcacagtgcacacccacagctctgtgaagtctgtgcctgagaacctgctgaagtgctttggagagcagaacaagaagcagccccggcaggactaccagctgggcttcaccctcatctggaagaatgtgcccaagacccagatgaagttcagcatccagaccatgtgccccattgaaggagagggcaacatcgcccgcttcctgttcagcctgtttggccagaagcacaatgctgtgaatgccaccctgattgacagctgggtggacatcgccatcttccagctgaaggagggcagcagcaaggagaaggctgctgtgttccgctccatgaacagcgccctgggcaagagcccctggctggccggaaatgagctgactgtggctgatgtggtgctgtggagcgtgctgcagcagatcggcggctgcagcgtgacagtgcctgccaacgtgcagcgctggatgaggagctgtgagaacctggcccccttcaacacagccctgaagctgctgaagtag

SEQ ID NO: 3464 - DNA, 1068 bp, Artificial Sequence
  Description of Artificial Sequence: Synthetic coding sequence
atggagcggctgtggggcctcttccagagggcccagcagctgagccccaggagcagccagacagtgtaccagagggtggagggccccaggaagggccacctggaggaggaggaggaggatggagaggagggcgctgagaccctggcccacttctgccccatggagctgcggggccctgagcccctgggcagccggccccggcagcccaacctgatcccctgggccgctgctggaagaagagctgccccctacctggtgctgacagccctgctgatcttcaccggggccttcctgctgggctacgtggccttccggggcagctgccaggcctgtggggacagcgtgctggtggtgtctgaagatgtgaactatgagccagacctggacttccaccagggccgcctgtactggagcgacctgcaggccatgttcctgcagttcctgggggagggccgcctggaggacaccatccggcagaccagcctgcgggagcgggtggccggcagcgctggcatggccgccctgacccaggacatccgggccgccctgagccggcagaagctggaccacgtgtggacagacacccactacgtgggcctgcagttcccagaccctgcccaccccaacaccctgcactgggtggatgaagctgggaaggtgggggagcagctgcccctggaggaccctgatgtgtactgcccctacagcgccatcggaaatgtgactggagagctggtgtatgcccactacggccggcctgaggacctgcaggacctgcgggcccggggcgtggaccctgtgggccgcctgctgctggtgcgggtgggcgtcatcagctttgcccagaaggaggcccagaggccctgtggcccccccaggatggccggggagcccccccggctgcccctgagccctggcccccgggccaccacagctgccagcggccagcagagccaggacctgcacccccaccagcagcacctgcggctgcaccggcggcccctgcgggcccggagcctgcgctgccaccggggccctgagggctgcatgggccccaggagcagctag

SEQ ID NO: 3465 - DNA, 2406 bp, Artificial Sequence
  Description of Artificial Sequence: Synthetic coding sequence
atggagcggctgtggggcctcttccagagggcccagcagctgagccccaggagcagccagacagtgtaccagagggtggagggccccaggaagggccacctggaggaggaggaggaggatggagaggagggcgctgagaccctggcccacttctgccccatggagctgcggggccctgagcccctgggcagccggccccggcagcccaacctgatcccctgggccgctgctggaagaagagctgccccctacctggtgctgacagccctgctgatcttcaccggggccttcctgctgggctacgtggccttccggggcagctgccaggcctgtggggacagcgtgctggtggtgtctgaagatgtgaactatgagccagacctggacttccaccagggccgcctgtactggagcgacctgcaggccatgttcctgcagttcctgggggagggccgcctggaggacaccatccggcagaccagcctgcgggagcgggtggccggcagcgctggcatggccgccctgacccaggacatccgggccgccctgagccggcagaagctggaccacgtgtggacagacacccactacgtgggcctgcagttcccagaccctgcccaccccaacaccctgcactgggtggatgaagctgggaaggtgggggagcagctgcccctggaggaccctgatgtgtactgcccctacagcgccatcggaaatgtgactggagagctggtgtatgcccactacggccggcctgaggacctgcaggacctgcgggcccggggcgtggaccctgtgggccgcctgctgctggtgcgggtgggcgtcatcagctttgcccagaaggtgaccaatgcccaggactttggagcccagggcgtgctgatctacccagagcctgctgacttcagccaggacccccccaagcccagcctgagcagccagcaggccgtgtatggccacgtgcacctgggcactggagacccctacaccccaggcttccccagcttcaaccagacccagttcccccctgtggccagcagcggcctgcccagcatcccagcccagcccatctctgctgacatcgccagccggctgctgaggaagctgaagggccctgtggccccccaggagtggcagggcagcctgctgggcagcccctaccacctgggccctggcccccggctgcggctggtggtgaacaaccacaggaccagcacccccatcaacaacatcttcggctgcatcgagggccgctctgagccagaccactacgtggtgattggagcccagagagatgcctggggccctggggccgccaagtctgctgtgggcacagccatcctgctggagctggtgaggaccttcagctccatggtgtccaatggcttccggccccggcgcagcctgctcttcatctcctgggatggaggagactttggatctgtgggcagcacagagtggctggagggctacctgtctgtgctgcacctgaaggctgtggtgtatgtgtccctggacaatgctgtgctgggagatgacaagttccacgccaagaccagccccctgctgaccagcctgattgaatctgtgctgaagcaggtggacagccccaaccacagcggccagaccctgtatgagcaggtggtgttcaccaaccccagctgggatgctgaggtgatccggcccctgcccatggacagcagcgcctacagcttcaccgcctttgtgggcgtgcctgctgtggagttctccttcatggaggatgaccaggcctaccccttcctgcacaccaaggaggacacctatgagaacctgcacaaggtgctgcagggccgcctgcctgctgtggcccaggccgtggcccagctggccggccagctgctgatccggctgagccatgaccggctgctgcccctggactttggccgctatggagatgtggtgctgcggcacatcggcaacctgaatgagttcagcggggacctgaaggcccggggcctgaccctgcagtgggtgtacagcgcccggggggactacatccgggctgctgagaagctgcggcaggagatctacagcagcgaggagagagatgagcggctgaccaggatgtacaacgtgcgcatcatgagggtggagttctacttcctgagccagtatgtgtccccagctgacagccccttccgccacatcttcatgggccgcggggaccacaccctgggcgccctgctggaccacctgcggctgctgcggagcaacagcagcggcacccctggggccaccagcagcacaggcttccaggagagccgcttccggcggcagctggccctgctgacctggaccctgcagggcgccgccaatgccctgtctggagatgtgtggaacatcgacaacaacttctag

SEQ ID NO: 3466 - DNA, 1029 bp, Artificial Sequence
  Description of Artificial Sequence: Synthetic coding sequence
atggtgtccaatggcttccggcccaggaggagcctgctcttcatctcctgggatggaggagactttggatctgtgggcagcacagagtggctggagggctacctgtctgtgctgcacctgaaggctgtggtgtatgtgtccctggacaatgctgtgctgggagatgacaagttccacgccaagaccagccccctgctgaccagcctcatcgagagcgtgctgaagcaggtggacagccccaaccacagcggccagaccctgtatgagcaggtggtgttcaccaaccccagctgggatgctgaggtgatccggcccctgcccatggacagcagcgcctacagcttcaccgcctttgtgggcgtgcctgctgtggagttctccttcatggaggatgaccaggcctaccccttcctgcacaccaaggaggacacctatgagaacctgcacaaggtgctgcagggccgcctgcctgctgtggcccaggccgtggcccagctggccggccagctgctgatccggctgagccatgaccggctgctgcccctggactttggccgctatggagatgtggtgctgcggcacatcggcaacctgaatgagttcagcggggacctgaaggcccggggcctgaccctgcagtgggtgtacagcgcccggggggactacatccgggctgctgagaagctgcggcaggagatctacagcagcgaggagagagatgagcggctgaccaggatgtacaacgtgcgcatcatgagggtggagttctacttcctgagccagtatgtgtccccagctgacagccccttccgccacatcttcatgggccgcggggaccacaccctgggcgccctgctggaccacctgcggctgctgcggagcaacagcagcggcacccctggggccaccagcagcacaggcttccaggagagccgcttccggcggcagctggccctgctgacctggaccctgcagggcgccgccaatgccctgtctggagatgtgtggaacatcgacaacaacttctag

SEQ ID NO: 3467 - DNA, 1596 bp, Artificial Sequence
  Description of Artificial Sequence: Synthetic coding sequence
atggccgccaccctggacctgaagagcaaggaggagaaggatgctgagctggacaagagaattgaggccctgcggaggaagaatgaggccctgatccgccgctaccaggagattgaggaggacaggaagaaggccgagctggagggcgtggccgtgacagcccccaggaagggccgctctgtggagaaggaaaatgtggccgtggagagcgagaagaacctgggccccagccgccgcagccctggcaccccccggcccccaggggccagcaaaggaggccgcaccccaccccagcagggcggccgggccggcatgggccgggccagccgctcctgggagggcagccctggagagcagccccggggcggcggggccggcggccggggccggcggggccggggccggggcagcccccacctgtctggagctggggacaccagcatcagtgacaggaagagcaaggagtgggaggagcggcggcggcagaacatcgagaagatgaatgaggagatggagaagattgctgaatatgaaagaaaccagcgggagggcgtgctggagcccaaccctgtgaggaacttcctggatgacccccggcggcgcagcggccccctggaggagagcgagcgggaccggcgggaggagagcagaagacatggaagaaactggggcggccctgactttgagcgggtgcgctgtggcctggagcacgagcggcagggccggcgggccggcctgggcagcgctggggacatgaccctgtccatgacaggccgggagaggtctgagtacctgcgctggaagcaggagcgggagaagattgaccaggagcggctgcagaggcacaggaagcccaccggccagtggaggcgggagtgggatgctgagaagacagatggcatgttcaaggatggccctgtgcctgcccacgagcccagccacagatatgatgaccaggcctgggcccggccccccaagccacccaccttcggggagttcctgagccagcacaaggccgaggccagcagcagaagaagaaggaagagcagccggccccaggccaaggccgccccccgggcctacagcgaccatgatgaccgctgggagaccaaggagggcgccgccagccctgcccctgagaccccccagcccaccagccctgagaccagccccaaggagacccccatgcagcccccagagatcccagccccagcccaccggcccccagaagatgaaggagaagaaaatgaaggagaggaggatgaggagtgggaggacatcagtgaagatgaggaggaggaggagattgaggtggaggagggagatgaggaggagcccgcccaggaccaccaggcccctgaggccgcccccaccggcatcccctgcagcgagcaggcccatggagtgcccttcagccctgaggagcccctgctggagccccaggcccctggcacccccagcagccccttcagcccccccagcggccaccagcctgtgtctgactggggcgaggaggtggagctgaacagccccaggaccacccacctggccggggccctgagccctggagaggcctggccctttgagagcgtgtag

SEQ ID NO: 3468 - DNA, 1329 bp, Artificial Sequence
  Description of Artificial Sequence: Synthetic coding sequence
atgcactactgtgtgctgagcgccttcctgatcctgcacctggtgacagtggccctgagcctgagcacctgcagcaccctggacatggaccagttcatgaggaagagaattgaggccatccggggccagatcctgagcaagctgaagctgaccagccccccagaggactacccagagcctgaggaggtgcccccagaggtgatcagcatctacaacagcacccgggacctgctgcaggagaaggccagccggcgggctgctgcctgtgagcgggagaggagtgatgaggagtactatgccaaggaggtgtacaagattgacatgccacccttcttccccagcgagaccgtgtgccctgtggtgaccaccccatctggctctgtgggcagcctgtgcagccggcagagccaggtgctgtgtggctacctggatgccatcccccccaccttctaccggccctacttcagaattgtgcgctttgatgtgtctgccatggagaagaatgccagcaacctggtgaaggccgagttccgggtcttccggctgcagaaccccaaggcccgggtgcctgagcagagaattgagctgtaccagatcctgaagagcaaggacctgaccagccccacccagcgctacatcgacagcaaggtggtgaagaccagggctgagggggagtggctgagctttgatgtgacagatgctgtgcatgagtggctgcaccacaaggacaggaacctgggcttcaagatcagcctgcactgcccctgctgcacctttgtgcccagcaacaactacatcatccccaacaagtctgaggagctggaggccaggtttgctggcattgatggcaccagcacctacaccagcggggaccagaagaccatcaagagcaccaggaagaagaacagcggcaagaccccccacctgctgctgatgctgctgcccagctaccgcctggagagccagcagaccaacagaaggaagaagagggccctggatgctgcctactgcttcagaaatgtgcaggacaactgctgcctgcggcccctgtacatcgacttcaagagggacctgggctggaagtggatccacgagcccaagggctacaatgccaacttctgtgccggggcctgcccctacctgtggagcagtgacacccagcacagccgggtgctgagcctgtacaacaccatcaaccctgaggccagcgccagcccctgctgcgtgtcccaggacctggagcccctgaccatcctgtactacatcggcaagacccccaagattgagcagctgagcaacatgattgtgaagagctgcaagtgcagctag

SEQ ID NO: 3469 - DNA, 1245 bp, Artificial Sequence
  Description of Artificial Sequence: Synthetic coding sequence
atgcactactgtgtgctgagcgccttcctgatcctgcacctggtgacagtggccctgagcctgagcacctgcagcaccctggacatggaccagttcatgaggaagagaattgaggccatccggggccagatcctgagcaagctgaagctgaccagccccccagaggactacccagagcctgaggaggtgcccccagaggtgatcagcatctacaacagcacccgggacctgctgcaggagaaggccagccggcgggctgctgcctgtgagcgggagaggagtgatgaggagtactatgccaaggaggtgtacaagattgacatgccacccttcttccccagtgaaaatgccatcccccccaccttctaccggccctacttcagaattgtgcgctttgatgtgtctgccatggagaagaatgccagcaacctggtgaaggccgagttccgggtcttccggctgcagaaccccaaggcccgggtgcctgagcagagaattgagctgtaccagatcctgaagagcaaggacctgaccagccccacccagcgctacatcgacagcaaggtggtgaagaccagggctgagggggagtggctgagctttgatgtgacagatgctgtgcatgagtggctgcaccacaaggacaggaacctgggcttcaagatcagcctgcactgcccctgctgcacctttgtgcccagcaacaactacatcatccccaacaagtctgaggagctggaggccaggtttgctggcattgatggcaccagcacctacaccagcggggaccagaagaccatcaagagcaccaggaagaagaacagcggcaagaccccccacctgctgctgatgctgctgcccagctaccgcctggagagccagcagaccaacagaaggaagaagagggccctggatgctgcctactgcttcagaaatgtgcaggacaactgctgcctgcggcccctgtacatcgacttcaagagggacctgggctggaagtggatccacgagcccaagggctacaatgccaacttctgtgccggggcctgcccctacctgtggagcagtgacacccagcacagccgggtgctgagcctgtacaacaccatcaaccctgaggccagcgccagcccctgctgcgtgtcccaggacctggagcccctgaccatcctgtactacatcggcaagacccccaagattgagcagctgagcaacatgattgtgaagagctgcaagtgcagctag

SEQ ID NO: 3470 - DNA, 1239 bp, Artificial Sequence
  Description of Artificial Sequence: Synthetic coding sequence
atgaagatgcacctgcagagggccctggtggtgctggccctgctgaactttgccaccgtgtccctgagcctgagcacctgcaccaccctggactttggccacatcaagaagaagagggtggaggccatccggggccagatcctgagcaagctgcggctgaccagccccccagagcccaccgtgatgacccacgtgccctaccaggtgctggccctgtacaacagcacccgggagctgctggaggagatgcacggggagcgggaggagggctgcacccaggagaacacagagagcgagtactatgccaaggagatccacaagtttgacatgatccagggcctggccgagcacaatgagctggccgtgtgccccaagggcatcaccagcaaggtgttccgcttcaacgtgtcctctgtggagaagaacagaaccaacctcttccgggcagagttccgggtgctgcgggtgcccaaccccagcagcaagagaaatgagcagagaattgagctgttccagatcctgcggccagatgagcacatcgccaagcagcgctacatcggcggcaagaacctgcccacccggggcacagctgagtggctgagctttgatgtgacagacacagtgcgggagtggctgctgcggcgggagagcaacctgggcctggagatcagcatccactgcccctgccacaccttccagcccaatggagacatcctggagaacatccacgaggtgatggagatcaagttcaagggcgtggacaatgaagatgaccacggccgcggggacctgggccgcctgaagaagcagaaggaccaccacaacccccacctgatcctgatgatgatccccccccaccggctggacaaccctggccagggcggccagaggaagaagagggccctggacaccaactactgcttcaggaacctggaggagaactgctgcgtgcggcccctgtacatcgacttccggcaggacctgggctggaagtgggtgcatgagcccaagggctactatgccaacttctgcagcggcccctgcccctacctgcggtctgctgacaccacccacagcacagtgctgggcctgtacaacaccctgaaccctgaggccagcgccagcccctgctgcgtgccccaggacctggagcccctgaccatcctgtactacgtgggccgcacccccaaggtggagcagctgagcaacatggtggtgaagagctgcaagtgcagctag

SEQ ID NO: 3471 - DNA, 930 bp, Artificial Sequence
  Description of Artificial Sequence: Synthetic coding sequence
atgaagatgcacctgcagagggccctggtggtgctggccctgctgaactttgccaccgtgtccctgagcctgagcacctgcaccaccctggactttggccacatcaagaagaagagggtggaggccatccggggccagatcctgagcaagctgcggctgaccagccccccagagcccaccgtgatgacccacgtgccctaccaggtgctggccctgtacaacagcacccgggagctgctggaggagatgcacggggagcgggaggagggctgcacccaggagaacacagagagcgagtactatgccaaggagatccacaagtttgacatgatccagggcctggccgagcacaatgagctggccgtgtgccccaagggcatcaccagcaaggtgttccgcttcaacgtgtcctctgtggagaagaacagaaccaacctcttccgggcagagttccgggtgctgcgggtgcccaaccccagcagcaagagaaatgagcagagaattgagctgttccagatcctgcggccagatgagcacatcgccaagcagcgctacatcggcggcaagaacctgcccacccggggcacagctgagtggctgagctttgatgtgacagacacagtgcgggagtggctgctgcggcgggagagcaacctgggcctggagatcagcatccactgcccctgccacaccttccagcccaatggagacatcctggagaacatccacgaggtgatggagatcaagttcaagggcgtggacaatgaagatgaccacggccgcggggacctgggccgcctgaagaagcagaaggaccaccacaacccccacctgatcctgatgatgatccccccccaccggctggacaaccctggccagggcggccagaggaagaagagggccctggacaccaactactgcttcagatag

SEQ ID NO: 3472 - DNA, 444 bp, Artificial Sequence
  Description of Artificial Sequence: Synthetic coding sequence
atggccagccaccggctgctgctgctgtgcctggccggcctggtgtttgtgtctgaggccggccccactggaactggagagagcaaatgtcccctgatggtgaaggtgctggatgctgtgcggggcagccctgccatcaacgtggccgtgcacgtgttcaggaaggctgctgatgacacctgggagccctttgccagcggcaagaccagcgagagcggggagctgcacggcctgaccacagaggaggagtttgtggagggcatctacaaggtggagattgacaccaagagctactggaaggccctgggcatcagccccttccacgagcacgccgaggtggtgttcaccgccaatgacagcggcccccggcgctacaccatcgccgccctgctgagcccctacagctacagcaccacagctgtggtgaccaaccccaaggagtag

SEQ ID NO: 3473 - DNA, 555 bp, Artificial Sequence
  Description of Artificial Sequence: Synthetic coding sequence
atggccagccaccggctgctgctgctgtgcctggccggcctggtgtttgtgtctgaggccggccccactggaactggagagagcaaatgtcccctgatggtgaaggtgctggatgctgtgcggggcagccctgccatcaacgtggccgtgcacgtgttcaggaaggctgctgatgacacctgggagccctttgccagcggcaagaccagcgagagcggggagctgcacggcctgaccacagaggaggagtttgtggagggcatctacaaggtggagattgacaccaagagctactggaaggccctgggcatcagccccttccacgagcacgccgaggtgtccatccagacctttgaggccttccaggagatcctgtacaagaagaagttcaccaccctgtggcactggaccagcggcggccagagcttcttccgggccctggtggaggtggtgttcaccgccaatgattctggcccccggcgctacaccatcgccgccctgctgagcccctacagctacagcaccacagctgtggtgaccaaccccaaggagtag

SEQ ID NO: 3474 - DNA, 420 bp, Artificial Sequence
  Description of Artificial Sequence: Synthetic coding sequence
atggccagccaccggctgctgctgctgtgcctggccggcctggtgtttgtgtctgaggccggccccactggaactggagagagcaaatgtcccctgatggtgaaggtgctggatgctgtgcggggcagccctgccatcaacgtggccgtgcacgtgttcaggaaggctgctgatgacacctgggagccctttgccagcggcaagaccagcgagagcggggagctgcacggcctgaccacagaggaggagtttgtggagggcatctacaaggtggagattgacaccaagagctactggaaggccctgggcatcagccccttccacgagcacgccgaggtggtgttcaccgccaatgacagcggcccccggcgctactacagctacagcaccacagctgtggtgaccaaccccaaggagtag

SEQ ID NO: 3475 - DNA, 996 bp, Artificial Sequence
  Description of Artificial Sequence: Synthetic coding sequence
atgaatggcaccaggaactggtgcaccctggtggatgtgcaccctgaggaccaggccgctgtgtacctgaagggccgcagcggggacaagatgattcatgagaagaacatcaaccagctgaagtctgaggtgcagtacatccaggaggccaggaactgcctgcagaagctgcgggaggacatcagcagcaagctggacaggaacctgggggacagcctgcaccggcaggagatccaggtggtgctggagaagcccaacggcttcagccagagccccacagccctgtacagcagccccccagaggtggacacctgcatcaatgaagatgtggagagcctgaggaagacagtgcaggacctgctggccaagctgcaggaggccaagaggcagcaccagagcgactgtgtggcctttgaggtgaccctgagccgctaccagcgggaggccgagcagagcaatgtggccctgcagcgggaggaggacagagtggagcagaaggaggccgaggtgggggagctgcagaggcggctgctgggcatggagacagagcaccaggccctgctggccaaggtgcgggagggggaggtggccctggaggagctgcggagcaacaatgctgactgccaggccgagcgggagaaggccgccaccctggagaaggaggtggccggcctgcgggagaagatccaccacctggatgacatgctgaagagccagcagaggaaggtgcggcagatgattgagcagctgcagaacagcaaggctgtgatccagagcaaggatgccaccatccaggagctgaaggagaagatcgcctacctggaggccgagaacctggagatgcatgacaggatggagcacctgattgagaagcagatcagccacggcaacttcagcacccaggcccgggccaagacagaaaatcctggcagcatccgcatcagcaagccacccagccccaagcccatgcctgtgatccgggtggtggagacctag

SEQ ID NO: 3476 - DNA, 1098 bp, Artificial Sequence
  Description of Artificial Sequence: Synthetic coding sequence
atgaatggcaccaggaactggtgcaccctggtggatgtgcaccctgaggaccaggccgctgctggcaggaagacctacgccatggtgagcagccacagcgctggccacagcctggccagcgagctggtggagagccatgatggccacgaggagatcatcaaggtgtacctgaagggccgcagcggggacaagatgattcatgagaagaacatcaaccagctgaagtctgaggtgcagtacatccaggaggccaggaactgcctgcagaagctgcgggaggacatcagcagcaagctggacaggaacctgggggacagcctgcaccggcaggagatccaggtggtgctggagaagcccaacggcttcagccagagccccacagccctgtacagcagccccccagaggtggacacctgcatcaatgaagatgtggagagcctgaggaagacagtgcaggacctgctggccaagctgcaggaggccaagaggcagcaccagagcgactgtgtggcctttgaggtgaccctgagccgctaccagcgggaggccgagcagagcaatgtggccctgcagcgggaggaggacagagtggagcagaaggaggccgaggtgggggagctgcagaggcggctgctgggcatggagacagagcaccaggccctgctggccaaggtgcgggagggggaggtggccctggaggagctgcggagcaacaatgctgactgccaggccgagcgggagaaggccgccaccctggagaaggaggtggccggcctgcgggagaagatccaccacctggatgacatgctgaagagccagcagaggaaggtgcggcagatgattgagcagctgcagaacagcaaggctgtgatccagagcaaggatgccaccatccaggagctgaaggagaagatcgcctacctggaggccgagaacctggagatgcatgacaggatggagcacctgattgagaagcagatcagccacggcaacttcagcacccaggcccgggccaagacagaaaatcctggcagcatccgcatcagcaagccacccagccccaagcccatgcctgtgatccgggtggtggagacctag

SEQ ID NO: 3477 - DNA, 1173 bp, Artificial Sequence
  Description of Artificial Sequence: Synthetic coding sequence
atgaatggcaccaggaactggtgcaccctggtggatgtgcaccctgaggaccaggccgccggctctgtggacatcctgcggctgaccctgcagggcgagctgactggagatgagctggagcacatcgcccagaaggccggcaggaagacctacgccatggtgagcagccacagcgctggccacagcctggccagcgagctggtggagagccatgatggccacgaggagatcatcaaggtgtacctgaagggccgcagcggggacaagatgatccacgagaagaacatcaaccagctgaagtctgaggtgcagtacatccaggaggccaggaactgcctgcagaagctgcgggaggacatcagcagcaagctggacaggaacctgggggacagcctgcaccggcaggagatccaggtggtgctggagaagcccaacggcttcagccagagccccacagccctgtacagcagccccccagaggtggacacctgcatcaatgaagatgtggagagcctgaggaagacagtgcaggacctgctggccaagctgcaggaggccaagaggcagcaccagagcgactgtgtggcctttgaggtgaccctgagccgctaccagcgggaggccgagcagagcaatgtggccctgcagcgggaggaggacagagtggagcagaaggaggccgaggtgggggagctgcagaggcggctgctgggcatggagacagagcaccaggccctgctggccaaggtgcgggagggggaggtggccctggaggagctgcggagcaacaatgctgactgccaggccgagcgggagaaggccgccaccctggagaaggaggtggccggcctgcgggagaagatccaccacctggatgacatgctgaagagccagcagaggaaggtgcggcagatgattgagcagctgcagaacagcaaggccgtcatccagagcaaggatgccaccatccaggagctgaaggagaagatcgcctacctggaggccgagaacctggagatgcatgacaggatggagcacctgattgagaagcagatcagccacggcaacttcagcacccaggcccgggccaagacagagaaccctggcagcatccgcatcagcaagccacccagccccaagcccatgcctgtgatccgggtggtggagacctag

SEQ ID NO: 3478 - DNA, 600 bp, Artificial Sequence
  Description of Artificial Sequence: Synthetic coding sequence
atgaatggcaccaggaactggtgcaccctggtggatgtgcaccctgaggaccaggccgctgctggcaggaagacctacgccatggtgagcagccacagcgctggccacagcctggccagcgagctggtggagagccatgatggccacgaggagatcatcaaggtgtacctgaagggccgcagcggggacaagatgattcatgagaagaacatcaaccagctgaagtctgaggtgcagtacatccaggaggccaggaactgcctgcagaagctgcgggaggacatcagcagcaagctggacaggaacctgggggacagcctgcaccggcaggagatccaggtggtgctggagaagcccaacggcttcagccagagccccacagccctgtacagcagccccccagaggtggacacctgcatcaatgaagatgtggagagcctgaggaagacagtgcaggacctgctggccaagctgcaggaggccaagaggcagcaccagagcgactgtgtggcctttgaggtgaccctgagccgctaccagcgggaggccgagcagagcaatgtggccctgcagcgggaggaggaccgctgcccagagtag

SEQ ID NO: 3479 - DNA, 1230 bp, Artificial Sequence
  Description of Artificial Sequence: Synthetic coding sequence
atgagcagccctggcatgaccagcctgcagctggagaaggaggagtgcatgcagtgtgtgccctgcagccccaggaccagggtggccctgctggagctgtaccgggccatgtgccagggctctgtggacatcctgcggctgaccctgcagggcgagctgactggagatgagctggagcacatcgcccagaaggccggcaggaagacctacgccatggtgagcagccacagcgctggccacagcctggccagcgagctggtggagagccatgatggccacgaggagatcatcaaggtgtacctgaagggccgcagcggggacaagatgattcatgagaagaacatcaaccagctgaagtctgaggtgcagtacatccaggaggccaggaactgcctgcagaagctgcgggaggacatcagcagcaagctggacaggaacctgggggacagcctgcaccggcaggagatccaggtggtgctggagaagcccaacggcttcagccagagccccacagccctgtacagcagccccccagaggtggacacctgcatcaatgaagatgtggagagcctgaggaagacagtgcaggacctgctggccaagctgcaggaggccaagaggcagcaccagagcgactgtgtggcctttgaggtgaccctgagccgctaccagcgggaggccgagcagagcaatgtggccctgcagcgggaggaggacagagtggagcagaaggaggccgaggtgggggagctgcagaggcggctgctgggcatggagacagagcaccaggccctgctggccaaggtgcgggagggggaggtggccctggaggagctgcggagcaacaatgctgactgccaggccgagcgggagaaggccgccaccctggagaaggaggtggccggcctgcgggagaagatccaccacctggatgacatgctgaagagccagcagaggaaggtgcggcagatgattgagcagctgcagaacagcaaggctgtgatccagagcaaggatgccaccatccaggagctgaaggagaagatcgcctacctggaggccgagaacctggagatgcatgacaggatggagcacctgattgagaagcagatcagccacggcaacttcagcacccaggcccgggccaagacagaaaatcctggcagcatccgcatcagcaagccacccagccccaagcccatgcctgtgatccgggtggtggagacctag

SEQ ID NO: 3480 - DNA, 543 bp, Artificial Sequence
  Description of Artificial Sequence: Synthetic coding sequence
atgaatggcaccaggaactggtgcaccctggtggatgtgcaccctgaggaccaggccgctgctggcaggaagacctacgccatggtgagcagccacagcgctggccacagcctggccagcgagctggtggagagccatgatggccacgaggagatcatcaaggtgtacctgaagggccgcagcggggacaagatgattcatgagaagaacatcaaccagctgaagtctgaggtgcagtacatccaggaggccaggaactgcctgcagaagctgcgggaggacatcagcagcaagctggacaggaacctgggggacagcctgcaccggcaggagatccaggtggtgctggagaagcccaacggcttcagccagagccccacagccctgaaggccggggacacagatgtgcagagcgactggaggatgtcctggggcaatgaggtgcccagcaccaacacagcccagttcctggccaccaactgcctcttcttctacctgctgcacctgcagcccaccctgccctggcccccagctgacagatag

SEQ ID NO: 3481 - DNA, 1182 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagcagcggcaacctgctgggcagaaattcctttgaggtgcgggtgtgtgcctgccccggccgggacagaagaacagaggaggagaacctgaggaagaagggggagccccaccacgagctgcccccaggcagcaccaagagggccctgcccaacaacaccagcagcagcccccagcccaagaagaagcccctggatggagagtacttcaccctgcagatccggggccgggagagatttgagatgttccgggagctgaatgaggccctggagctgaaggatgcccaggccggcaaggagcccggcggcagccgggcccacagcagccacctgaagagcaagaagggccagagcaccagccgccacaagaagctgatgttcaagacagagggccctgacagcgactag

SEQ ID NO: 3482 - DNA, 1032 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagcagcggcaacctgctgggcagaaattcctttgaggtgcgggtgtgtgcctgccccggccgggacagaagaacagaggaggagaacctgaggaagaagggggagccccaccacgagctgcccccaggcagcaccaagagggccctgcccaacaacaccagcagcagcccccagcccaagaagaagcccctggatggagagtacttcaccctgcagaagaccttccctgcccggcacggcggcagccacctgtag

SEQ ID NO: 3483 - DNA, 1149 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgacctgcacctacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagcagcggcaacctgctgggcaggaacagctttgaggtgcgggtgtgtgcctgccccggccgggacagaagaacagaggaggagaacctgaggaagaagggggagccccaccacgagctgcccccaggcagcaccaagagggccctgcccaacaacaccagcagcagcccccagcccaagaagaagcccctggatggagagtacttcaccctgcagatccggggccgggagagatttgagatgttccgggagctgaatgaggccctggagctgaaggatgcccaggccggcaaggagcccggcggcagccgggcccacagcagccacctgaagagcaagaagggccagagcaccagccgccacaagaagctgatgttcaagacagagggccctgacagcgactag

SEQ ID NO: 3484 - DNA, 858 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagccggccccggcaggtggaccacctgcggtctggagtgcaggacagcctggccaacatcgccaagagccacctgtactag

SEQ ID NO: 3485 - DNA, 273 bp, Artificial Sequence
  Description of Artificial Sequence: Synthetic coding sequence
atgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtgtctggccggcggggctag

SEQ ID NO: 3486 - DNA, 135 bp, Artificial Sequence
  Description of Artificial Sequence: Synthetic coding sequence
cccctgcccagccagaggaggaaccactggatggagaacatcagccccttcagccacctgaagagcaagaagggccagagcaccagccgccacaagaagctgatgttcaagacagagggccctgacagcgactag

SEQ ID NO: 3487 - DNA, 1026 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagcagcggcaacctgctgggcagaaattcctttgaggtgcgggtgtgtgcctgccccggccgggacagaagaacagaggaggagaacctgaggaagaagggggagccccaccacgagctgcccccaggcagcaccaagagggccctgcccaacaacaccagcagcagcccccagcccaagaagaagcccctggatggagagtacttcaccctgcaggaccagaccagcttccagaaggagaactgctag

SEQ ID NO: 3488 - DNA, 1182 bp, Artificial Sequence; identical to SEQ ID NO: 3481
  Description of Artificial Sequence: Synthetic coding sequence

SEQ ID NO: 3489 - DNA, 1041 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagcagcggcaacctgctgggcagaaattcctttgaggtgcgggtgtgtgcctgccccggccgggacagaagaacagaggaggagaacctgaggaagaagggggagccccaccacgagctgcccccaggcagcaccaagagggccctgcccaacaacaccagcagcagcccccagcccaagaagaagcccctggatggagagtacttcaccctgcagatgctgctggacctgcgctggtgctacttcctgatcaacagcagctag

SEQ ID NO: 3490 - DNA, 387 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagcccctag

SEQ ID NO: 3491 - DNA, 498 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgagccccctgcccagccaggccatggatgacctgatgctgagcccagatgacatcgagcagtggttcacagaggaccccggcccagatgaggcccccaggatgcctgaggccgcccctcctgtggccccagccccagctgcccccaccccagctgccccagccccagcccccagctggcccctgagcagctctgtgcccagccagaagacctaccagggcagctatggcttccggctgggcttcctgcacagcggcacagccaagtctgtgacctgcacctacagccctgccctgaacaagatgttctgccagctggccaagacctgccctgtgcagctgtgggtggacagcaccccacctcctggcaccagggtgcgggccatggccatctacaagcagtag

SEQ ID NO: 3492 - DNA, 600 bp, Artificial Sequence
  Description of Artificial Sequence: Synthetic coding sequence
atgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagaagacccatcctgaccatcatcaccctggaggacagcagcggcaacctgctgggcagaaattcctttgaggtgcgggtgtgtgcctgccccggccgggacagaagaacagaggaggagaacctgaggaagaagggggagccccaccacgagctgcccccaggcagcaccaagagggccctgcccaacaacaccagcagcagcccccagcccaagaagaagcccctggatggagagtacttcaccctgcagtag

SEQ ID NO: 3493 - DNA, 468 bp, Artificial Sequence
  Description of Artificial Sequence: Synthetic coding sequence
atggaggagccccagagcgaccccagcgtggagccccccctgagccaggagaccttcagtgacctgtggaagctgctgcctgagaacaacgtgctgtacagccctgccctgaacaagatgttctgccagctggccaagacctgccctgtgcagctgtgggtggacagcaccccacctcctggcaccagggtgcgggccatggccatctacaagcagagccagcacatgacagaggtggtgcggcgctgcccccaccacgagcgctgcagcgacagtgatggcctggccccaccccagcacctgatccgggtggagggcaacctgcgggtggagtacctggatgacaggaacaccttccgccacagcgtggtggtgccctatgagcccccagaggtgggcagtgactgcaccaccatccactacaactacatgtgcaacagcagctgcatgggcggcatgaacagatag

SEQ ID NO: 3494 - DNA, 468 bp, Artificial Sequence; identical to SEQ ID NO: 3493
  Description of Artificial Sequence: Synthetic coding sequence

SEQ ID NO: 3495 - DNA, 1590 bp, Artificial Sequence
  Description of Artificial Sequence: Synthetic coding sequence
atgctgctggccgtgctgtactgcctgctgtggagcttccagaccagcgctggccacttcccccgggcctgtgtgagcagcaagaacctgatggagaaggagtgctgccccccctggagcggggacaggagcccctgtggccagctgagcggccggggcagctgccagaacatcctgctgagcaatgcccccctgggcccccagttccccttcaccggggtggatgaccgggagagctggcccagcgtcttctacaacagaacctgccagtgcagcggcaacttcatgggcttcaactgtggcaactgcaagtttggcttctggggccccaactgcacagaaagaaggctgctggtgagaagaaacatctttgacctgagcgcccctgagaaggacaagttctttgcctacctgaccctggccaagcacaccatcagcagtgactatgtgatccccatcggcacctacggccagatgaagaatggcagcacccccatgtttaatgacatcaacatctatgacctgtttgtgtggatgcactactacgtgtccatggatgccctgctgggcggcagcgagatctggagggacatcgactttgcccacgaggccccagccttcctgccctggcacaggctcttcctgctgcgctgggagcaggagatccagaagctgactggagatgagaacttcaccatcccctactgggactggagagatgctgagaagtgtgacatctgcacagatgagtacatgggcggccagcaccccaccaaccccaacctgctgagccctgccagcttcttcagctcctggcagatcgtgtgcagccggctggaggagtacaacagccaccagagcctgtgcaatggcaccccagagggccccctgcggagaaatcctggcaaccacgacaagagcaggaccccccggctgcccagcagcgcagatgtggagttctgcctgagcctgacccagtatgaaagtggctccatggacaaggccgccaacttctccttcaggaacaccctggagggctttgccagccccctgaccggcattgctgatgccagccagagctccatgcacaatgccctgcacatctacatgaatggcaccatgagccaggtgcagggcagcgccaatgaccccatcttcctgctgcaccacgcctttgtggacagcatctttgagcagtggctgcggcggcaccggcccctgcaggaggtgtacccagaggccaatgcccccatcggccacaaccgggagagctacatggtgcccttcatccccctgtacagaaatggagacttcttcatcagcagcaaggacctgggctatgactacagctacctgcaggacagcgaccctgacagcttccaggactacatcaagagctacctggagcaggccagccgcatctggagctggctgctgggcgccgccatggtgggcgctgtgctgacagccctgctggccggcctggtgtccctgctgtgccgccacaagaggaagcagctgcctgaggagaagcagcccctgctgatggagaaggaggactaccacagcctgtaccagagccacctgtag

SEQ ID NO: 3496 - DNA, 1365 bp, Artificial Sequence
  Description of Artificial Sequence: Synthetic coding sequence
atggacccctacatgatccagatgagcagcaaaggaaacctgcccagcatcctggatgtgcacgtgaatgtgggcggccgcagctctgtgcctgggaagatgaagggcaggaaggcccgctggagcgtgcggcccagcgacatggccaagaagaccttcaaccccatccgggccatcgtggacaacatgaaggtgaagcccaaccccaacaagaccatgatcagcctgagcatcggggaccccaccgtgtttggaaacctgcccacagatcctgaggtgacccaggccatgaaggatgccctggacagcggcaagtacaacggctacgcccccagcatcggcttcctgagcagccgggaggagatcgccagctactaccactgcccagaggcccccctggaggccaaggatgtgatcctgaccagcggctgcagccaggccatcgacctgtgcctggccgtgctggccaaccctggccagaacatcctggtgcccaggcctggcttcagcctgtacaagaccctggccgagagcatgggcatcgaggtgaagctgtacaacctgctgcctgagaagtcctgggagattgacctgaagcagctggagtacctgattgatgagaagacagcctgcctgattgtgaacaaccccagcaacccctgtggctctgtgttcagcaagaggcacctgcagaagatcctggccgtggccgcccggcagtgtgtgcccatcctggctgatgagatctacggggacatggtgttcagtgactgcaagtatgagcccctggccaccctgagcacagatgtgcccatcctgagctgtggcggcctggccaagcgctggctggtgcccggctggaggctgggctggatcctgattcatgacagaagagacatctttggaaatgagatcagagatggcctggtgaagctgagccagaggatcctgggcccctgcaccatcgtgcagggcgccctgaagagcatcctgtgcaggaccccaggagagttctaccacaacaccctgtccttcctgaagagcaatgctgacctgtgctacggggccctggccgccatccctggcctgcggcctgtgcggcccagcggggccatgtacctgatggtgggcatcgagatggagcacttccctgagtttgaaaatgatgtggagttcacagagcggctggtggccgagcagagcgtgcactgcctgcctgccacctgctttgagtaccccaacttcatccgggtggtgatcaccgtgcctgaggtgatgatgctggaggcctgcagccgcatccaggagttctgtgagcagcactaccactgtgccgagggcagccaggaggagtgtgacaagtag

SEQ ID NO: 3497 - DNA, 1602 bp, Artificial Sequence
  Description of Artificial Sequence: Synthetic coding sequence
atggctgtggagagccagggcggccggcccctggtgctgggcctgctgctgtgtgtgctgggccctgtggtgtcccatgctgggaagatcctgctgatccctgtggatggcagccactggctgtccatgctgggcgccatccagcagctgcagcagaggggccatgaaattgtggtgctggccccagatgccagcctgtacatcagagatggagccttctacaccctgaagacctaccctgtgcccttccagcgggaggatgtgaaggagagctttgtgtccctgggccacaacgtgtttgaaaatgacagcttcctgcagagggtcatcaagacctacaagaagatcaagaaggacagcgccatgctgctgagcggctgcagccacctgctgcacaacaaggagctgatggccagcctggccgagagcagctttgatgtgatgctgacagaccccttcctgccctgcagccccatcgtggcccagtacctgagcctgcccaccgtcttcttcctgcacgccctgccctgcagcctggagtttgaggccacccagtgccccaaccccttctcctatgtgccccggcccctgagcagccacagcgaccacatgaccttcctgcagagggtgaagaacatgctgattgccttcagccagaacttcctgtgtgatgtggtgtacagcccctatgccaccctggccagcgagttcctgcagcgggaggtgacagtgcaggacctgctgagcagcgcctctgtgtggctgttcagaagtgactttgtgaaggactacccccggcccatcatgcccaacatggtgtttgtgggcggcatcaactgcctgcaccagaaccccctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccatgctggcagccacggcgtgtatgagagcatctgcaatggagtgcccatggtgatgatgcccctgtttggagaccagatggacaatgccaagaggatggagaccaagggagctggggtgaccctgaatgtgctggagatgaccagcgaggacctggagaatgccctgaaggctgtgatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 3498 - DNA, 1335 bp, Artificial Sequence
  Description of Artificial Sequence: Synthetic coding sequence
atggctgtggagagccagggcggccggcccctggtgctgggcctgctgctgtgtgtgctgggccctgtggtgtcccatgctgggaagatcctgctgatccctgtggatggcagccactggctgtccatgctgggcgccatccagcagctgcagcagaggggccatgaaattgtggtgctggccccagatgccagcctgtacatcagagatggagccttctacaccctgaagacctaccctgtgcccttccagcgggaggatgtgaaggagagctttgtgtccctgggccacaacgtgtttgaaaatgacagcttcctgcagagggtcatcaagacctacaagaagatcaagaaggacagcgccatgctgctgagcggctgcagccacctgctgcacaacaaggagctgatggccagcctggccgagagcagctttgatgtgatgctgacagaccccttcctgccctgcagccccatcgtggcccagtacctgagcctgcccaccgtcttcttcctgcacgccctgccctgcagcctggagtttgaggccacccagtgccccaaccccttctcctatgtgccccggcccctgagcagccacagcgaccacatgaccttcctgcagagggtgaagaacatgctgattgccttcagccagaacttcctgtgtgatgtggtgtacagcccctatgccaccctggccagcgagttcctgcagcgggaggtgacagtgcaggacctgctgagcagcgcctctgtgtggctgttcagaagtgactttgtgaaggactacccccggcccatcatgcccaacatggtgtttgtgggcggcatcaactgcctgcaccagaaccccctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccatgctggcagccacggcgtgtatgagagcatctgcaatggagtgcccatggtgatgatgcccctgtttggagaccagatggacaatgccaagaggatggagaccaagggagctggggtgaccctgaatgtgctggagatgaccagcgaggacctggagaatgccctgaaggctgtgatcaatgacaagaggaagaagcagcagagcggccggcagatgtag

SEQ ID NO: 3499 - DNA, 1593 bp, Artificial Sequence
  Description of Artificial Sequence: Synthetic coding sequence
atggcccgggccggctggaccagccctgtgcccctgtgtgtgtgcctgctgctgacctgtggctttgctgaggccggcaagctgctggtggtgcccatggatggcagccactggttcaccatgcagagcgtggtggagaagctgatcctgcggggccacgaggtggtggtggtgatgcctgaggtgtcctggcagctggagaggagcctgaactgcaccgtgaagacctacagcaccagctacaccctggaggaccagaaccgggagttcatggtgtttgcccacgcccagtggaaggcccaggcccagagcatcttcagcctgctgatgagcagcagcagcggcttcctggacctcttcttcagccactgccgcagcctcttcaatgacaggaagctggtggagtacctgaaggagagcagctttgatgctgtgttcctggacccctttgacacctgtggcctcatcgtggccaagtacttcagcctgcccagcgtggtgttcacccggggcatcttctgccaccacctggaggagggcgcccagtgcccagcccccctgtcctatgtgcccaatgacctgctgggcttcagtgatgccatgaccttcaaggagcgggtgtggaaccacatcgtgcacctggaggaccacctgttctgccagtacctgttcagaaatgccctggagatcgccagcgagatcctgcagacccctgtgacagcctatgacctgtacagccacaccagcatctggctgctgaggacagactttgtgctggactaccccaagcctgtgatgcccaacatgatcttcatcggcggcatcaactgccaccagggcaagcccctgcccatggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 3500 - DNA, 1605 bp, Artificial Sequence
  Description of Artificial Sequence: Synthetic coding sequence
atggccaccggcctgcaggtgcccctgccctggctggccaccggcctgctgctgctgctgtctgtgcagccctgggccgagagcggcaaggtgctggtggtgcccattgatggcagccactggctgtccatgagggaggtgctgcgggagctgcacgcccggggccaccaggccgtggtgctgaccccagaggtgaacatgcacatcaaggaggagaacttcttcaccctgaccacctacgccatctcctggacccaggatgaatttgacagacatgtgctgggccacacccagctgtactttgaaacagagcacttcctgaagaagttcttccgctccatggccatgctgaacaacatgagcctggtgtaccacaggagctgtgtggagctgctgcacaatgaggccctgatccgccacctgaatgccaccagctttgatgtggtgctgacagatcctgtgaacctgtgtgccgctgtgctggccaagtacctgagcatccccaccgtcttcttcctgaggaacatcccctgtgacctggacttcaagggcacccagtgccccaaccccagcagctacatcccccggctgctgaccaccaacagcgaccacatgaccttcatgcagagggtgaagaacatgctgtaccccctggccctgagctacatctgccacgccttcagcgccccctatgccagcctggccagcgagctgttccagcgggaggtgtctgtggtggacatcctgagccacgcctctgtgtggctgttccggggggactttgtgatggactacccccggcccatcatgcccaacatggtgttcatcggcggcatcaactgtgccaacaggaagcccctgagccaggagtttgaggcctacatcaatgccagcggggagcacggcatcgtggtgttcagcctgggctccatggtgtctgagatccctgagaagaaggccatggccatcgcagatgccctgggcaagatcccccagacagtgctgtggagatacacaggcacccggcccagcaacctggccaacaacaccatcctggtgaagtggctgccccagaatgacctgctgggccaccccatgacccgggccttcatcacccacgccggcagccatggagtgtatgagagcatctgcaatggagtgcccatggtgatgatgcccctgtttggagaccagatggacaatgccaagaggatggagaccaagggggccggcgtgaccctgaatgtgctggagatgaccagcgaggacctggagaatgccctgaaggccgtcatcaatgacaagagctacaaggagaacatcatgaggctgagcagcctgcacaaggacaggcctgtggagcccctggacctggccgtgttctgggtggagtttgtgatgaggcacaagggggccccccacctgcggcctgctgcccatgacctgacctggtaccagtaccacagcctggatgtgattggcttcctgctggccgtggtgctgactgtggccttcatcaccttcaagtgctgtgcctacggctacaggaagtgcctgggcaagaagggccgggtgaagaaggcccacaagagcaagacccactag

SEQ ID NO: 3501 - DNA, 1470 bp, Artificial Sequence
  Description of Artificial Sequence: Synthetic coding sequence
atggccggccagagggtgctgctgctggtgggcttcctgctgcccggggtgctgctgtctgaggccgccaagatcctgaccatcagcacagtggacttcaagaaggaggagaagagctaccaggtgatctcctggctggcccctgaggaccaccagcgggagttcaagaagagctttgacttcttcctggaggagaccctgggcggccggggcaagtttgagaacctgctgaatgtgctggagtacctggccctgcagtgcagccacttcctgaacaggaaggacatcatggacagcctgaagaatgaaaattttgacatggtgattgtggagacctttgactactgccccttcctgattgctgagaagctgggcaagccctttgtggccatcctgagcaccagctttggcagcctggagtttggcctgcccatccccctgtcctatgtgcctgtgttccgcagcctgctgacagaccacatggacttctggggccgggtgaagaacttcctgatgttcttctccttctgccggcggcagcagcacatgcagagcacctttgacaacaccatcaaggagcacttcacagagggcagcaggcctgtgctgagccacctgctgctgaaggccgagctgtggttcatcaacagcgactttgcctttgattttgcccggcccctgctgcccaacacagtgtatgtgggcggcctgatggagaagcccatcaagcctgtgccccaggacctggagaacttcatcgccaagtttggagacagcggctttgtgctggtgaccctgggctccatggtgaacacctgccagaaccctgagatcttcaaggagatgaacaatgcctttgcccacctgccccagggcgtcatctggaagtgccagtgcagccactggcccaaggatgtgcacctggccgccaacgtgaagatcgtggactggctgccccagagcgacctgctggcccaccccagcatccggctgtttgtgacccatggaggccagaacagcatcatggaggccatccagcacggcgtgcccatggtgggcatccccctgtttggagaccagcctgagaacatggtgcgggtggaggccaagaagtttggagtgtccatccagctgaagaagctgaaggccgagaccctggccctgaagatgaagcagatcatggaggacaagcgctacaagtctgctgctgtggccgccagcgtcatcctgcggagccaccccctgagccccacccagaggctggtgggctggattgaccacgtgctgcagacaggaggagccacccacctgaagccctacgtgttccagcagccctggcatgagcagtacctgctggatgtgtttgtgttcctgctgggcctgaccctgggcaccctgtggctgtgtgggaagctgctgggcatggctgtgtggtggctgcggggggccaggaaggtgaaggagacctag

SEQ ID NO: 3502 - DNA, 1572 bp, Artificial Sequence
  Description of Artificial Sequence: Synthetic coding sequence
atggccggccagagggtgctgctgctggtgggcttcctgctgcccggggtgctgctgtctgaggccgccaagatcctgaccatcagcacagtgggcggcagccactacctgctgatggacagagtgtcccagatcctgcaggaccacggccacaacgtgaccatgctgaaccacaagaggggccccttcatgccagacttcaagaaggaggagaagagctaccaggtgatctcctggctggcccctgaggaccaccagcgggagttcaagaagagctttgacttcttcctggaggagaccctgggcggccggggcaagtttgagaacctgctgaatgtgctggagtacctggccctgcagtgcagccacttcctgaacaggaaggacatcatggacagcctgaagaatgaaaattttgacatggtgattgtggagacctttgactactgccccttcctgattgctgagaagctgggcaagccctttgtggccatcctgagcaccagctttggcagcctggagtttggcctgcccatccccctgtcctatgtgcctgtgttccgcagcctgctgacagaccacatggacttctggggccgggtgaagaacttcctgatgttcttctccttctgccggcggcagcagcacatgcagagcacctttgacaacaccatcaaggagcacttcacagagggcagcaggcctgtgctgagccacctgctgctgaaggccgagctgtggttcatcaacagcgactttgcctttgattttgcccggcccctgctgcccaacacagtgtatgtgggcggcctgatggagaagcccatcaagcctgtgccccaggacctggagaacttcatcgccaagtttggagacagcggctttgtgctggtgaccctgggctccatggtgaacacctgccagaaccctgagatcttcaaggagatgaacaatgcctttgcccacctgccccagggcgtcatctggaagtgccagtgcagccactggcccaaggatgtgcacctggccgccaacgtgaagatcgtggactggctgccccagagcgacctgctggcccaccccagcatccggctgtttgtgacccatggaggccagaacagcatcatggaggccatccagcacggcgtgcccatggtgggcatccccctgtttggagaccagcctgagaacatggtgcgggtggaggccaagaagtttggagtgtccatccagctgaagaagctgaaggccgagaccctggccctgaagatgaagcagatcatggaggacaagcgctacaagtctgctgctgtggccgccagcgtcatcctgcggagccaccccctgagccccacccagaggctggtgggctggattgaccacgtgctgcagacaggaggagccacccacctgaagccctacgtgttccagcagccctggcatgagcagtacctgctggatgtgtttgtgttcctgctgggcctgaccctgggcaccctgtggctgtgtgggaagctgctgggcatggctgtgtggtggctgcggggggccaggaaggtgaaggagacctag

SEQ ID NO: 3503 - DNA, 417 bp, Artificial Sequence
  Description of Artificial Sequence: Synthetic coding sequence
atggccggccagagggtgctgctgctggtgggcttcctgctgcccggggtgctgctgtctgaggccgccaagatcctgaccatcagcacagtgggcggcagccactacctgctgatggacagagtgtcccagatcctgcaggaccacggccacaacgtgaccatgctgaaccacaagaggggccccttcatgccagacttcaagaaggaggagaagagctaccaggtgatctcctggctggcccctgaggaccaccagcgggagttcaagaagagctttgacttcttcctggaggagaccctgggcggccggggcaagtttgagaacctgctgaatgtgctggagtacctggccctgcagtgcagccacttcctgaacaggaaggacatcatggacagcctgaagaatgaaaattag

SEQ ID NO: 3504 - DNA, 666 bp, Artificial Sequence
  Description of Artificial Sequence: Synthetic coding sequence
atggtgaacacctgccagaaccctgagatcttcaaggagatgaacaatgcctttgcccacctgccccagggcgtcatctggaagtgccagtgcagccactggcccaaggatgtgcacctggccgccaacgtgaagatcgtggactggctgccccagagcgacctgctggcccaccccagcatccggctgtttgtgacccatggaggccagaacagcatcatggaggccatccagcacggcgtgcccatggtgggcatccccctgtttggagaccagcctgagaacatggtgcgggtggaggccaagaagtttggagtgtccatccagctgaagaagctgaaggccgagaccctggccctgaagatgaagcagatcatggaggacaagcgctacaagtctgctgctgtggccgccagcgtcatcctgcggagccaccccctgagccccacccagaggctggtgggctggattgaccacgtgctgcagacaggaggagccacccacctgaagccctacgtgttccagcagccctggcatgagcagtacctgctggatgtgtttgtgttcctgctgggcctgaccctgggcaccctgtggctgtgtgggaagctgctgggcatggctgtgtggtggctgcggggggccaggaaggtgaaggagacctag

SEQ ID NO: 3505 - DNA, 1086 bp, Artificial Sequence
  Description of Artificial Sequence: Synthetic coding sequence
atggccatgaactacaatgccaaggatgaggtggatggcggccccccctgtgcccctgggggcacagccaagacccggcggccagacaacacagccttcaagcagcagaggctgcctgcctggcagcccatcctgacagctggcaccgtgctgcccatcttcttcatcatcggcctcatcttcatccccatcggcatcggcatctttgtgaccagcaacaacatccgggagattgaaattgactacacaggaacagagcccagcagcccctgcaacaagtgcctgagcccagatgtgaccccctgcttctgcaccatcaacttcaccctggagaagagctttgagggcaatgtgttcatgtactacggcctgagcaacttctaccagaaccaccggcgctacgtgaagagcagagatgacagccagctgaatggagacagcagcgccctgctgaaccccagcaaagaatgtgagccctacagaagaaatgaagacaagcccatcgccccctgtggggccatcgccaacagcatgtttaatgacaccctggagctgttcctgattggaaatgacagctaccccatccccatcgccctgaagaagaagggcatcgcctggtggacagacaagaatgtgaagttcagaaatcctcctggaggagacaacctggaggagcgcttcaagggcaccaccaagcctgtgaactggctgaagcctgtgtacatgctggacagcgaccctgacaacaacggcttcatcaatgaagacttcatcgtgtggatgaggacagctgccctgcccaccttcaggaagctgtaccgcctcatcgagaggaagagtgacctgcaccccaccctgcctgctggccgctacagcctgaatgtgacctacaactaccctgtgcactactttgatggcaggaagaggatgatcctgagcaccatctcctggatgggcggcaagaaccccttcctgggcatcgcctacatcgctgtgggcagcatctccttcctgctgggcgtggtgctgctggtgatcaaccacaagtacagaaacagcagcaacacagctgacatcaccatctag

SEQ ID NO: 3506 - DNA, 954 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcgctgtgacaagcccaggaggtag

SEQ ID NO: 3507 - DNA, 1239 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccgctacaagtcctggagcgtgtatgtgggcgcccgctgctgcctgatgccctggagcctgcccggcccccacccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3508 - DNA, 984 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagtgtgacaagcccaggaggtag

SEQ ID NO: 3509 - DNA, 1116 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3510 - DNA, 444 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagtgtgacaagcccaggaggtag

SEQ ID NO: 3511 - DNA, 1170 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccggccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3512 - DNA, 1065 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaagatgtag

SEQ ID NO: 3513 - DNA, 1188 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccgctacaagtcctggagcgtgccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3514 - DNA, 414 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcgctgtgacaagcccaggaggtag

SEQ ID NO: 3515 - DNA, 1116 bp, Artificial Sequence
  Description of Artificial Sequence: Synthetic coding sequence
ctgacagaccggcagacagacacagcccccagccccagctaccacctgctgcccggcagaagaagaacagtggatgctgctgccagccggggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaaggcccggcagctggagctgaatgaaagaacctgccgcagcctgaccaggaaggactag

SEQ ID NO: 3516 - DNA, 630 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccggccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3517 - DNA, 576 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaaggcccggcagctggagctgaatgaaagaacctgccgcagcctgaccaggaaggactag

SEQ ID NO: 3518 - DNA, 972 bp, Artificial Sequence
  Description of Artificial Sequence: Synthetic coding sequence
tgaagaggccagggccctgagcccgcccctgggggcggcgtggagggcgtgggcgcccggggcgtggccctgaagctgtttgtgcagctgctgggctgcagcagatttggaggagctgtggtgcgggccggggaggccgagcccagcggggccgcccggagcgccagcagcggccgggaggagccccagcctgaggagggggaggaggaggaggagaaggaggaggagcggggcccccagtggaggctgggcgccaggaagccaggctcctggacaggagaggccgctgtgtgtgccgacagcgccccagctgcccgggccccccaggccctggcccgggccagcggccggggcggccgggtggccaggagaggagctgaggagagcggccccccccacagccccagcagaagaggcagcgccagccgggccggccctggccgggccagcgagaccatgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccgctacaagtcctggagcgtgtgtgacaagcccaggaggtag

SEQ ID NO: 3519 - DNA, 648 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccgctacaagtcctggagcgtgccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3520 - DNA, 525 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaagatgtag

SEQ ID NO: 3521 - DNA, 699 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaagaagtctgtgcggggcaagggcaagggccagaagaggaagaggaagaagagccgctacaagtcctggagcgtgtatgtgggcgcccgctgctgcctgatgccctggagcctgcccggcccccacccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3522 - DNA, 576 bp, Artificial Sequence
  Description of Artificial Sequence: Synthetic coding sequence
atgaacttcctgctgtcctgggtgcactggagcctggccctgctgctgtacctgcaccacgccaagtggagccaggccgcccccatggccgagggcggcggccagaaccaccacgaggtggtgaagttcatggatgtgtaccagaggagctactgccaccccatcgagaccctggtggacatcttccaggagtacccagatgaaattgagtacatcttcaagcccagctgtgtgcccctgatgagatgtggcggctgctgcaatgatgagggcctggagtgtgtgcccacagaggagagcaacatcaccatgcagatcatgaggatcaagccccaccagggccagcacatcggggagatgtccttcctgcagcacaacaagtgtgaatgtcggcccaagaaggaccgggcccggcaggagaacccctgtggcccctgcagcgagaggaggaagcacctgtttgtgcaggacccccagacctgcaagtgcagctgcaagaacacagacagccgctgcaaggcccggcagctggagctgaatgaaagaacctgccgctgtgacaagcccaggaggtag

SEQ ID NO: 3523 - DNA, 1263 bp, Artificial Sequence
  Description of Artificial Sequence: Synthetic coding sequence
atgcacctgctgggcttcttctctgtggcctgcagcctgctggccgccgccctgctgcccggcccccgggaggccccagctgctgctgctgcctttgagagcggcctggacctgagtgatgctgagccagatgctggggaggccacagcctatgccagcaaggacctggaggagcagctgcggtctgtgtcctctgtggatgagctgatgacagtgctgtacccagagtactggaagatgtacaagtgccagctgaggaaaggaggctggcagcacaaccgggagcaggccaacctgaacagcaggacagaggagaccatcaagtttgctgctgcccactacaacacagagatcctgaagagcattgacaatgagtggaggaagacccagtgcatgccccgggaggtgtgcattgatgtgggcaaggagtttggagtggccaccaacaccttcttcaagccaccctgtgtgtctgtgtaccgctgtggcggctgctgcaacagcgagggcctgcagtgcatgaacaccagcaccagctacctgagcaagaccctgtttgagatcaccgtgcccctgagccagggccccaagcctgtgaccatcagctttgccaaccacaccagctgccgctgcatgagcaagctggatgtgtaccggcaggtgcacagcatcatccgccgcagcctgcctgccaccctgccccagtgccaggccgccaacaagacctgccccaccaactacatgtggaacaaccacatctgccgctgcctggcccaggaggacttcatgttcagcagtgatgctggagatgacagcacagatggcttccatgacatctgtggccccaacaaggagctggatgaggagacctgccagtgtgtgtgcagagctggcctgcggcctgccagctgtggcccccacaaggagctggacaggaacagctgccagtgtgtgtgcaagaacaagctgttccccagccagtgtggggccaaccgggagtttgatgagaacacctgccagtgtgtgtgcaagaggacctgccccaggaaccagcccctgaaccctggaaaatgtgcctgtgaatgtacagagagcccccagaagtgcctgctgaagggcaagaagttccaccaccagacctgcagctgctacagaagaccctgcaccaaccggcagaaggcctgtgagcccggcttctcctacagcgaggaggtgtgccgctgtgtgcccagctactggaagaggccccagatgatgtcctag

SEQ ID NO: 3524 - DNA, 510 bp, Artificial Sequence
  Description of Artificial Sequence: Synthetic coding sequence
atggacaccaggaacaaggcccagctgctggtgctgctgaccctgctgtctgtgctcttcagccagaccagcgcctggcccctgtaccgggcccccagcgccctgcggctgggggaccgcatcccctttgaaggagccaatgaaccagaccaggtgtccctgaaggaggacatcgacatgctgcagaatgccctggctgaaaatgacaccccctactatgatgtgtccagaaatgcccggcatgctgatggagtcttcaccagtgacttcagcaagctgctgggccagctgagcgccaagaagtacctggagagcctgatgggcaagagggtgagcaacatcagcgaggaccctgtgcctgtgaagaggcacagtgatgctgtgttcacagacaactacacccggctgaggaagcagatggctgtgaagaagtacctgaacagcatcctgaatggcaagaggagcagcgagggggagagcccagacttccctgaggagctggagaagtag

SEQ ID NO: 3525 - DNA, 513 bp, Artificial Sequence
  Description of Artificial Sequence: Synthetic coding sequence
atggacaccaggaacaaggcccagctgctggtgctgctgaccctgctgtctgtgctcttcagccagaccagcgcctggcccctgtaccgggcccccagcgccctgcggctgggggaccgcatcccctttgaaggagccaatgaaccagaccaggtgtccctgaaggaggacatcgacatgctgcagaatgccctggctgaaaatgacaccccctactatgatgtgtccagaaatgcccggcatgctgatggagtcttcaccagtgacttcagcaagctgctgggccagctgagcgccaagaagtacctggagagcctgatgggcaagagggtgagcagcaacatcagtgaagatcctgtgcctgtgaagaggcacagtgatgctgtgttcacagacaactacacccggctgaggaagcagatggctgtgaagaagtacctgaacagcatcctgaatggcaagaggagcagcgagggggagagcccagacttccctgaggagctggagaagtag

SEQ ID NO: 3526 - DNA, 360 bp, Artificial Sequence
  Description of Artificial Sequence: Synthetic coding sequence
tgagtgtccctgaaggaggacatcgacatgctgcagaatgccctggctgaaaatgacaccccctactatgatgtgtccagaaatgcccggcatgctgatggagtcttcaccagtgacttcagcaagctgctgggccagctgagcgccaagaagtacctggagagcctgatgggcaagagggtgagcagcaacatcagtgaagatcctgtgcctgtgaagaggcacagtgatgctgtgttcacagacaactacacccggctgaggaagcagatggctgtgaagaagtacctgaacagcatcctgaatggcaagaggtctgagggggagagcccagacttccctgaggagctggagaagtag

SEQ ID NO: 3527 - DNA, 774 bp, Artificial Sequence
  Description of Artificial Sequence: Synthetic coding sequence
atgcccctgaatgtgtccttcaccaacagaaattatgacctggactatgacagcgtgcagccctacttctactgtgatgaggaggagaacttctaccagcagcagcagcagagcgagctgcagcccccagcccccagcgaggacatctggaagaagtttgagctgctgcccaccccacccctgagccccagcagaagaagtggcctgtgcagccccagctatgtggccgtgacccccttcagcctgcggggggacaatgatggcggcggcggcagcttcagcacagctgaccagctggagatggtgacagagctgctgggcggggacatggtgaaccagagcttcatctgtgaccctgatgatgagaccttcatcaagaacatcatcatccaggactgcatgtggagcggcttctctgctgctgccaagctggtgtctgagaagctggccagctaccaggccgccaggaaggacagcggcagccccaacccagcccggggccacagcgtgtgcagcaccagcagcctgtacctgcaggacctgtctgctgctgcctctgaatgtattgaccccagcgtggtgttcccctaccccctgaatgacagcagcagccccaagagctgtgccagccaggacagcagcgccttcagccccagcagtgacagcctgctgagcagcacagagagcagcccccagggcagccctgagcccctggtgctgcacgaggagaccccacccaccaccagcagtgacagcggcggcaccaggaggtag

SEQ ID NO: 3528 - DNA, 1365 bp, Artificial Sequence
  Description of Artificial Sequence: Synthetic coding sequence
ctggacttcttccgggtggtggagaaccagcagcccccagccaccatgcccctgaatgtgtccttcaccaacagaaattatgacctggactatgattctgtgcagccctacttctactgtgatgaggaggagaacttctaccagcagcagcagcagagcgagctgcagcccccagcccccagcgaggacatctggaagaagtttgagctgctgcccaccccacccctgagccccagccgccgcagcggcctgtgcagccccagctatgtggccgtgacccccttcagcctgcggggggacaatgatggcggcggcggcagcttcagcacagctgaccagctggagatggtgacagagctgctgggcggggacatggtgaaccagagcttcatctgtgaccctgatgatgagaccttcatcaagaacatcatcatccaggactgcatgtggagcggcttctctgctgctgccaagctggtgtctgagaagctggccagctaccaggccgccaggaaggacagcggcagccccaacccagcccggggccacagcgtgtgcagcaccagcagcctgtacctgcaggacctgtctgctgctgccagcgagtgcatcgaccccagcgtggtgttcccctaccccctgaatgacagcagcagccccaagagctgtgccagccaggacagcagcgccttcagccccagcagtgacagcctgctgagcagcacagagagcagcccccagggcagccctgagcccctggtgctgcacgaggagaccccacccaccaccagcagtgacagcgaggaggagcaggaggatgaggaggagattgatgtggtgtctgtggagaagaggcaggcccctgggaagaggtctgagagcggcagccccagcgctgggggccacagcaagccaccccacagccccctggtgctgaagcgctgccacgtgtccacccaccagcacaactatgctgccccacccagcaccaggaaggactacccagctgccaagagggtgaagctggacagcgtgcgggtgctgcggcagatcagcaacaacaggaagtgcaccagccccaggagcagtgacacagaagaaaatgtgaagaggaggacccacaacgtgctggagcggcagaggagaaatgagctgaagaggagcttctttgccctgcgggaccagatccctgagctggagaacaatgagaaggcccccaaggtggtgatcctgaagaaggccacagcctacatcctgtctgtgcaggccgaggagcagaagctgatcagcgaggaggacctgctgaggaagaggcgggagcagctgaagcacaagctggagcagctgaggaacagctgtgcctag

SEQ ID NO: 3529 - DNA, 1263 bp, Artificial Sequence
  Description of Artificial Sequence: Synthetic coding sequence
atgcccctgaatgtgtccttcaccaacagaaattatgacctggactatgacagcgtgcagccctacttctactgtgatgaggaggacatctggaagaagtttgagctgctgcccaccccacccctgagccccagccgccgcagcggcctgtgcagccccagctatgtggccgtgacccccttcagcctgcggggggacaatgatggcggcggcggcagcttcagcacagctgaccagctggagatggtgacagagctgctgggcggggacatggtgaaccagagcttcatctgtgaccctgatgatgagaccttcatcaagaacatcatcatccaggactgcatgtggagcggcttctctgctgctgccaagctggtgtctgagaagctggccagctaccaggccgccaggaaggacagcggcagccccaacccagcccggggccacagcgtgtgcagcaccagcagcctgtacctgcaggacctgtctgctgctgccagcgagtgcatcgaccccagcgtggtgttcccctaccccctgaatgacagcagcagccccaagagctgtgccagccaggacagcagcgccttcagccccagcagtgacagcctgctgagcagcacagagagcagcccccagggcagccctgagcccctggtgctgcacgaggagaccccacccaccaccagcagtgacagcgaggaggagcaggaggatgaggaggagattgatgtggtgtctgtggagaagaggcaggcccctgggaagaggtctgagagcggcagccccagcgctgggggccacagcaagccaccccacagccccctggtgctgaagcgctgccacgtgtccacccaccagcacaactatgctgccccacccagcaccaggaaggactacccagctgccaagagggtgaagctggacagcgtgcgggtgctgcggcagatcagcaacaacaggaagtgcaccagccccaggagcagtgacacagaagaaaatgtgaagaggaggacccacaacgtgctggagcggcagaggagaaatgagctgaagaggagcttctttgccctgcgggaccagatccctgagctggagaacaatgagaaggcccccaaggtggtgatcctgaagaaggccacagcctacatcctgtctgtgcaggccgaggagcagaagctgatcagcgaggaggacctgctgaggaagaggcgggagcagctgaagcacaagctggagcagctgaggaacagctgtgcctag

SEQ ID NO: 3530 - DNA, 1362 bp, Artificial Sequence
  Description of Artificial Sequence: Synthetic coding sequence
ctggacttcttccgggtggtggagaaccagcccccagccaccatgcccctgaatgtgtccttcaccaacagaaattatgacctggactatgacagcgtgcagccctacttctactgtgatgaggaggagaacttctaccagcagcagcagcagagcgagctgcagcccccagcccccagcgaggacatctggaagaagtttgagctgctgcccaccccacccctgagccccagcagaagaagtggcctgtgcagccccagctatgtggccgtgacccccttcagcctgcggggggacaatgatggcggcggcggcagcttcagcacagctgaccagctggagatggtgacagagctgctgggcggggacatggtgaaccagagcttcatctgtgaccctgatgatgagaccttcatcaagaacatcatcatccaggactgcatgtggagcggcttctctgctgctgccaagctggtgtctgagaagctggccagctaccaggccgccaggaaggacagcggcagccccaacccagcccggggccacagcgtgtgcagcaccagcagcctgtacctgcaggacctgtctgctgctgcctctgaatgtattgaccccagcgtggtgttcccctaccccctgaatgacagcagcagccccaagagctgtgccagccaggacagcagcgccttcagccccagcagtgacagcctgctgagcagcacagagagcagcccccagggcagccctgagcccctggtgctgcacgaggagaccccacccaccaccagcagtgacagcgaggaggagcaggaggatgaggaggagattgatgtggtgtctgtggagaagaggcaggcccctgggaagaggtctgagagcggcagccccagcgctgggggccacagcaagccaccccacagccccctggtgctgaagcgctgccacgtgtccacccaccagcacaactatgctgccccacccagcaccaggaaggactacccagctgccaagagggtgaagctggacagcgtgcgggtgctgcggcagatcagcaacaacaggaagtgcaccagccccaggagcagtgacacagaggagaatgtgaagaggaggacccacaacgtgctggagcggcagaggagaaatgagctgaagaggagcttctttgccctgcgggaccagatccctgagctggagaacaatgagaaggcccccaaggtggtgatcctgaagaaggccacagcctacatcctgtctgtgcaggccgaggagcagaagctgatcagcgaggaggacctgctgaggaagagaagagagcagctgaagcacaagctggagcagctgaggaacagctgtgcctag

SEQ ID NO: 3531 - DNA, 8442 bp, Artificial Sequence
  Description of Artificial Sequence: Synthetic coding sequence
atgatcccagccaggtttgctggggtgctgctggccctggccctgatcctgcccggcaccctgtgtgccgagggcacccggggccgcagcagcacagcccgctgcagcctgtttggaagtgactttgtgaacacctttgatggctccatgtacagctttgctggctactgcagctacctgctggccggcggctgccagaagaggagcttcagcatcattggagacttccagaatggcaagagggtgtccctgtctgtgtacctgggggagttctttgacatccacctgtttgtgaatggaacagtgacccagggcgaccagagggtgtccatgccctatgccagcaagggcctgtacctggagacagaggccggctactacaagctgagcggggaggcctacggctttgtggccagaattgatggcagcggcaacttccaggtgctgctgagtgaccgctacttcaacaagacctgtggcctgtgtggcaacttcaacatctttgctgaagatgacttcatgacccaggagggcaccctgaccagtgacccctatgactttgccaacagctgggccctgagcagtggagagcagtggtgtgagcgggccagcccccccagcagcagctgcaacatcagcagcggggagatgcagaagggcctgtgggagcagtgccagctgctgaagagcacctctgtgtttgcccgctgccaccccctggtggaccctgagccctttgtggccctgtgtgagaagaccctgtgtgaatgtgccggcggcctggagtgtgcctgcccagccctgctggagtatgcccggacctgtgcccaggagggcatggtgctgtatggctggacagaccacagcgcctgcagccctgtgtgcccagctggcatggagtaccggcagtgtgtgagcccctgtgcccggacctgccagagcctgcacatcaatgagatgtgccaggagcgctgtgtggatggctgcagctgcccagagggccagctgctggatgagggcctgtgtgtggagagcacagaatgtccctgtgtgcacagcggcaagcgctacccacctggcaccagcctgagccgggactgcaacacctgcatctgcaggaacagccagtggatctgcagcaatgaagaatgtcctggagaatgtctggtgacaggccagagccacttcaagagctttgacaaccgctacttcaccttcagcggcatctgccagtacctgctggcccgggactgccaggaccacagcttcagcatcgtgattgaaacagtgcagtgtgctgatgacagagatgctgtgtgcaccaggtctgtgacagtgcggctgcccggcctgcacaacagcctggtgaagctgaagcacggggccggcgtggccatggatggccaggatgtgcagctgcccctgctgaagggggacctgcgcatccagcacacagtgacagcctctgtgcggctgtcctatggagaggacctgcagatggactgggatggccggggccgcctgctggtgaagctgagccctgtgtatgccggcaagacctgtggcctgtgtggcaactacaacggcaaccagggagatgacttcctgaccccatctggcctggccgagccccgggtggaggactttggaaatgcctggaagctgcacggggactgccaggacctgcagaagcagcacagcgacccctgtgccctgaaccccaggatgacccgcttcagcgaggaggcctgtgctgtgctgaccagccccacctttgaggcctgccacagagctgtgagccccctgccctacctgaggaactgccgctatgatgtgtgcagctgcagtgatggccgggagtgcctgtgtggggccctggccagctatgctgctgcctgtgccggccggggcgtgcgggtggcctggagggagcccggccgctgtgagctgaactgccccaagggccaggtgtacctgcagtgtggcaccccctgcaacctgacctgccgcagcctgagctacccagatgaggagtgcaatgaggcctgcctggagggctgcttctgccccccaggcctgtacatggatgagcggggggactgtgtgcccaaggcccagtgcccctgctactatgatggagagatcttccagcctgaggacatcttcagtgaccaccacaccatgtgctactgtgaagatggcttcatgcactgcaccatgtctggagtgcccggcagcctgctgcctgatgctgtgctgagcagccccctgagccacaggagcaagaggagcctgagctgcaggcctcccatggtgaagctggtgtgcccagctgacaacctgcgggcagagggcctggagtgcaccaagacctgccagaactatgacctggagtgcatgtccatgggctgtgtgtctggctgcctgtgccccccaggcatggtgagacatgagaacagatgtgtggccctggagcgctgcccctgcttccaccagggcaaggagtatgcccctggagaaacagtgaagattggctgcaacacctgtgtgtgccaggacaggaagtggaactgcacagaccacgtgtgtgatgccacctgcagcaccatcggcatggcccactacctgacctttgatggcctgaagtacctgtttcctggagagtgccagtatgtgctggtgcaggactactgcggcagcaaccctggcaccttccgcatcctggtgggcaacaagggctgcagccaccccagcgtgaagtgcaagaagagggtgaccatcctggtggagggcggggagattgagctgtttgatggagaggtgaatgtgaagaggcccatgaaggatgagacccactttgaggtggtggagagcggccgctacatcatcctgctgctgggcaaggccctgtctgtggtgtgggacagacacctgagcatctctgtggtgctgaagcagacctaccaggagaaggtgtgtggcctgtgtggcaactttgatggcatccagaacaatgacctgaccagcagcaacctgcaggtggaggaggaccctgtggactttggaaacagctggaaggtgagcagccagtgtgccgacaccaggaaggtgcccctggacagcagccctgccacctgccacaacaacatcatgaagcagaccatggtggacagcagctgccgcatcctgaccagtgatgtgttccaggactgcaacaagctggtggaccctgagccctacctggatgtgtgcatctatgacacctgcagctgtgagagcatcggggactgtgcctgcttctgtgacaccatcgccgcctatgcccacgtgtgtgcccagcacggcaaggtggtgacctggaggacagccaccctgtgcccccagagctgtgaggagaggaacctgagagaaaatggctatgaatgtgagtggagatacaacagctgtgccccagcctgccaggtgacctgccagcaccctgagcccctggcctgccctgtgcagtgtgtggagggctgccacgcccactgccccccaggcaagatcctggatgagctgctgcagacctgtgtggaccctgaggactgccctgtgtgtgaggtggccggccgccgctttgccagcggcaagaaggtgaccctgaaccccagcgaccctgagcactgccagatctgccactgtgatgtggtgaacctgacctgtgaggcctgccaggagcccggcggcctggtggtgcccccaacagatgcccctgtgagccccaccaccctgtatgtggaggacatcagcgagccccccctgcatgacttctactgcagccggctgctggacctggtgttcctgctggatggcagcagccggctgtctgaggccgagtttgaggtgctgaaggcctttgtggtggacatgatggagcggctgcgcatcagccagaagtgggtgcgggtggccgtggtggagtaccatgatggcagccacgcctacatcggcctgaaggacaggaagaggcccagcgagctgcggagaattgccagccaggtgaagtatgccggcagccaggtggccagcaccagcgaggtgctgaagtacaccctcttccagatcttcagcaagattgacaggcctgaggccagccgcatcaccctgctgctgatggccagccaggagccccagaggatgagcaggaactttgtgcgctacgtgcagggcctgaagaagaagaaggtgattgtcatccctgtgggcatcggcccccacgccaacctgaagcagatccgcctcatcgagaagcaggcccctgagaacaaggcctttgtgctgagctctgtggatgagctggagcagcagagagatgaaattgtgtcctacctgtgtgacctggcccctgaggcccccccacccaccctgcccccagacatggcccaggtgacagtgggccctggcctgctgggcgtgtccaccctgggccccaagaggaacagcatggtgctggatgtggcctttgtgctggagggcagtgacaagattggagaggccgacttcaacagaagcaaggagttcatggaggaggtgatccagaggatggatgtgggccaggacagcatccacgtgacagtgctgcagtacagctacatggtgacagtggagtaccccttcagcgaggcccagagcaagggggacatcctgcagagggtgcgggagatccgctaccagggcggcaacagaaccaacacaggcctggccctgcgctacctgagtgaccacagcttcctggtgtcccagggcgaccgggagcaggcccccaacctggtgtacatggtgacaggcaacccagccagtgatgagatcaagaggctgcccggggacatccaggtggtgcccatcggcgtgggccccaatgccaacgtgcaggagctggagcgcatcggctggcccaatgcccccatcctgatccaggactttgagaccctgccccgggaggccccagacctggtgctgcagcgctgctgcagcggggagggcctgcagatccccaccctgagccctgccccagactgcagccagcccctggatgtgatcctgctgctggatggcagcagcagcttccctgccagctactttgatgagatgaagagctttgccaaggccttcatcagcaaggccaacatcggcccccggctgacccaggtgtctgtgctgcagtatggcagcatcaccaccattgatgtgccctggaatgtggtgcctgagaaggcccacctgctgagcctggtggatgtgatgcagcgggagggcggccccagccagattggagatgccctgggctttgctgtgcgctacctgaccagcgagatgcacggggcccggcctggggccagcaaggctgtggtgatcctggtgacagatgtgtctgtggacagcgtggatgctgctgctgatgctgcccggagcaacagagtgacagtgttccccatcggcattggagacagatatgatgctgcccagctgcgcatcctggccggccctgctggggacagcaatgtggtgaagctgcagagaattgaggacctgcccaccatggtgaccctgggcaacagcttcctgcacaagctgtgcagcggctttgtgcgcatctgcatggatgaagatggaaatgagaagaggcctggagatgtgtggaccctgcctgaccagtgccacacagtgacctgccagccagatggccagaccctgctgaagagccaccgggtgaactgtgaccggggcctgcggcccagctgccccaacagccagagccctgtgaaggtggaggagacctgtggctgccgctggacctgcccctgtgtgtgcaccggcagcagcaccaggcacatcgtgacctttgatggccagaacttcaagctgaccggcagctgcagctatgtgctcttccagaacaaggagcaggacctggaggtgatcctgcacaacggggcctgcagccctggggcccggcagggctgcatgaagagcattgaggtgaagcacagcgccctgtctgtggagctgcacagcgacatggaggtgacagtgaatggccgcctggtgtctgtgccctacgtgggcggcaacatggaggtgaatgtgtatggagccatcatgcatgaggtgcgcttcaaccacctgggccacatcttcaccttcaccccccagaacaatgagttccagctgcagctgagccccaagacctttgccagcaagacctacggcctgtgtggcatctgtgatgaaaatggagccaatgacttcatgctgagagatggcaccgtgaccacagactggaagaccctggtgcaggagtggacagtgcagaggcctggccagacctgccagcccatcctggaggagcagtgcctggtgcctgacagcagccactgccaggtgctgctgctgcccctgtttgctgagtgccacaaggtgctggccccagccaccttctacgccatctgccagcaggacagctgccaccaggagcaggtgtgtgaggtgattgccagctatgcccacctgtgcaggaccaatggagtgtgtgtggactggaggaccccagacttctgtgccatgagctgcccccccagcctggtgtacaaccactgtgagcacggctgccccaggcactgtgatggaaatgtgagcagctgtggggaccaccccagcgagggctgcttctgccccccagacaaggtgatgctggagggcagctgtgtgcctgaggaggcctgcacccagtgcatcggggaggatggagtgcagcaccagttcctggaggcctgggtgcctgaccaccagccctgccagatctgcacctgcctgagcggcaggaaggtgaactgcaccacccagccctgccccacagccaaggcccccacctgtggcctgtgtgaggtggcccggctgcggcagaatgctgaccagtgctgcccagaatatgaatgtgtgtgtgaccctgtgtcctgtgacctgccccctgtgccccactgtgagcggggcctgcagcccaccctgaccaaccctggagaatgtcggcccaacttcacctgtgcctgcaggaaggaggagtgcaagagggtgagcccccccagctgccccccccaccggctgcccaccctgaggaagacccagtgctgtgatgaatatgaatgtgcctgcaactgtgtgaacagcacagtgtcctgccccctgggctacctggccagcacagccaccaatgactgtggctgcaccaccaccacctgcctgcctgacaaggtgtgtgtgcacaggagcaccatctaccctgtgggccagttctgggaggagggctgtgatgtgtgcacctgcacagacatggaggatgctgtgatgggcctgcgggtggcccagtgcagccagaagccctgtgaggacagctgccgcagcggcttcacctacgtgctgcacgagggggagtgctgcggccgctgcctgcccagcgcctgtgaggtggtgacaggcagccccaggggggacagccagagctcctggaagtctgtgggcagccagtgggccagccctgagaacccctgcctgatcaatgaatgtgtgcgggtgaaggaggaggtgttcatccagcagagaaatgtgtcctgcccccagctggaggtgcctgtgtgccccagcggcttccagctgagctgcaagaccagcgcctgctgccccagctgccgctgtgagaggatggaggcctgcatgctgaatggaacagtgattggccctgggaagacagtgatgattgatgtgtgcaccacctgccgctgcatggtgcaggtgggcgtcatcagcggcttcaagctggagtgcaggaagaccacctgcaacccctgccccctgggctacaaggaggagaacaacacaggagagtgctgcggccgctgcctgcccacagcctgcaccatccagctgcggggcggccagatcatgaccctgaagagagatgagaccctgcaggacggctgtgacacccacttctgcaaggtgaatgaaagaggagagtacttctgggagaagagggtgacaggctgccccccatttgatgagcacaagtgcctggccgagggcggcaagatcatgaagatccctggcacctgctgtgacacctgtgaggagccagaatgtaatgacatcacagcccggctgcagtatgtgaaggtgggcagctgcaagtctgaggtggaggtggacatccactactgccagggcaaatgtgccagcaaggccatgtacagcattgacatcaatgatgtgcaggaccagtgcagctgctgcagccccaccaggacagagcccatgcaggtggccctgcactgcaccaacggctctgtggtgtaccacgaggtgctgaatgccatggagtgcaagtgcagccccaggaagtgcagcaagtag

SEQ ID NO: 3532 - DNA, 816 bp, Artificial Sequence
  Description of Artificial Sequence: Synthetic coding sequence
atgacagagccccaggtgggctgtgtggcctgcccccgggtgcacaaggagcccgcccaggtgggcaccccctggccagccaagcccaggagccaccccaggaagagggaccccacagccctgctgcccaggagcctgtggccagcctgccaggagagcgtgacagccctgtgcttcctgcaggagaccgtggagcggctgggccagagccctgcccaggacacccctgtgctgggcccctgctgggaccccatggccctgggcacccagggccgcctgctgctggaccgggacagcaaggacacccagacccgcatcagccagaagggccgccgcctgcagcccccaggcacccccagcgccccaccccagaggcggcccaggaagcagctgaacccctgccggggcacagagcgggtggaccccggctttgagggcgtgaccctgaagttccagatcaagccagacagcagcctgcagatcatccccacctacagcctgccctgcagcagccgcagccaggagagccctgcagatgctgtgggcggccctgctgcccaccctgggggcacagaggcccacagcgctggcagcgaggccctggagccccggcgctgtgccagctgcaggacccagaggacccccctgtggagagatgctgaagatggcacccccctgtgcaatgcctgtggcatccgctacaagaagtatggcacccgctgcagcagctgctggctggtgcccaggaagaatgtgcagcccaagaggctgtgtggccgctgtggggtgtccctggaccccatccaggagggctag

SEQ ID NO: 3533 - DNA, 1182 bp, Artificial Sequence
  Description of Artificial Sequence: Synthetic coding sequence
atgaccacctacagcgacaagggcgccaagcccgagcggggccggttcctacactttcatagtgtgacattctgggtgggaaacgcaaagcaagcaacctctttttattgtagtaagatgggcttcgagcctttggcttaccggggcttggaaaccgggagccgcgaagtggtgtctcatgtgatcaagcaggggaaaattgtgttcgtgctttcttccgcattaaacccttggaataaggagatgggcgaccatctcgtcaagcacggagatggtgtgaaggacatcgcatttgaggtggaggactgtgactacattgttcaaaaagccagggaacgaggtgcgaagatcatgagagagccatgggtagagcaggataaattcggcaaggtgaagtttgctgtgctgcaaacatacggggacacaacgcataccctggtggagaaaatgaattacattggacagtttcttcctggttacgaggcacccgcatttatggaccccctccttcctaaactgcctaaatgctctctcgagatgattgaccacatcgtgggcaaccagcctgatcaggagatggtctcagcatccgagtggtatctaaaaaatctacagtttcatcgcttctggtctgtggacgatactcaggtgcacaccgaatacagttccctccggtctatcgtggtggccaactatgaagagagtatcaaaatgcctataaatgagcccgccccaggcaagaaaaaaagccagatacaagagtatgttgactataacggtggagccggcgttcaacatattgccctgaagactgaggacattattacagccatccggcatctgagggagcggggcctggaatttctgtcagtgcctagcacatactacaaacagcttagagagaaactgaagaccgcaaagattaaagtcaaagagaatattgacgcactggaggagctgaagatcctggtggactacgacgaaaaaggatacctcctgcagatctttacaaaaccagtacaggataggccaactctgtttttggaggtgatccagcggcacaaccaccagggatttggagccggtaactttaattcgctctttaaggccttcgaagaagagcaaaatctcaggggcaacttgacaaacatggagacaaacggcgtggttccaggcatgtag

SEQ ID NO: 3534 - DNA, 1065 bp, Artificial Sequence
  Description of Artificial Sequence: Synthetic coding sequence
atgggcttcgagcccctggcctaccggggcctggagaccggcagcagggaagtggtgtcccatgtgattaaacagggaaagatcgtttttgtgctgtcctcagctctgaatccgtggaataaggagatgggagatcacttggtcaagcacggcgacggcgttaaagatatagcttttgaggtcgaggactgtgattacatagtacagaaagcccgagaaaggggggcaaagattatgcgggagccttgggtggaacaggataaattcggcaaagtaaaatttgccgtgttacagacatacggagacacaactcacacattggtcgagaaaatgaactacatcggtcaatttctgcctggctacgaggcccctgcgttcatggacccgctactgcctaagctgccaaaatgttctttggagatgatcgaccatatcgtcggtaaccagcccgaccaagagatggtatccgcaagcgaatggtatctcaaaaacctacaattccaccgcttttggtctgtggatgacacccaggtacataccgagtattcgtcactccggagcatcgtggtggccaactatgaggaaagcataaagatgccaatcaacgaacccgcccccggcaagaagaagtctcaaatccaagaatatgtcgactacaacgggggagccggcgtccagcatatcgcgcttaagactgaggatatcatcaccgccattcgccacctgagagaacgtgggttggagttcctttctgtgcctagtacatactacaaacaactgcgcgaaaagctgaaaacggccaaaattaaagttaaggagaatatcgatgcactggaggaactgaaaattctggtggactacgacgagaaggggtaccttctccagatctttactaaaccagttcaagaccgcccaaccctgttcctggaggttatccagagacataaccaccagggatttggtgccggcaactttaattctctgtttaaggctttcgaagaagaacagaatctccgaggtaaccttaccaatatggaaaccaatggagtggtgcccggcatgtag

SEQ ID NO: 3535 - DNA, 1173 bp, Artificial Sequence
  Description of Artificial Sequence: Synthetic coding sequence
tacagcgacaagggcgccaagcccgagcggggccggttcctgcacttccacagtgtgacattctgggtcggtaatgccaagcaggctactagcttctactgctctaaaatgggtttcgagccactggcctataggggcctggagactgggtctagagaagttgtgtctcacgtgattaaacagggcaagatcgtcttcgtcctctcctcggccttgaacccatggaataaggagatgggcgaccaccttgtaaaacacggtgacggagttaaagacatcgcgttcgaggtggaagactgcgactacattgtgcagaaggcccgcgagcgcggtgcgaaaattatgcgcgagccctgggtggagcaggacaagttcggtaaggtgaaatttgccgtgctgcaaacctatggtgacacaacccatacacttgtggaaaagatgaattatatcggccagtttctccccgggtacgaggctcctgctttcatggacccactgctccctaaactgcctaaatgctctctagaaatgatcgaccatatagttggcaaccagcctgaccaagagatggtgtctgcaagcgaatggtacttaaagaaccttcaattccacaggttttggtctgtggatgacactcaagttcacactgagtactcttccctccgttcaatcgtcgtggctaactatgaggagtctatcaagatgcccatcaatgagcccgcccctggaaaaaagaagtcccagattcaggagtatgtcgattacaatggcggggccggggtccagcatattgctttgaagaccgaagatataattacagcaatacgccacctaagagaacgtgggctcgaattcctttcagtgccctccacatattacaagcaattgagagaaaagctgaaaacagccaagataaaggtcaaggagaacattgatgctctcgaagaactcaaaattctcgtggattacgatgagaaaggctatctgctccagatttttaccaaacccgtgcaggatagaccaactctgtttttagaggtgatacagcgccacaaccatcaggggttcggcgccgggaactttaacagcctgtttaaagcttttgaggaagaacaaaatcttcgaggcaacctcaccaatatggagaccaatggcgttgttccaggaatgtag

SEQ ID NO: 3536 - DNA, 438 bp, Artificial Sequence
  Description of Artificial Sequence: Synthetic coding sequence
atgagcaccgagggcggcggccggcggtgccaggcccaggtgagccgacgcattagcttttctgcatctcaccgcctctattctaaattcttatctgacgaggagaatctgaagctgttcggaaagtgtaacaatcctaacggccacgggcataactataaggtagttgtgactgtgcacggcgaaattgatccagccaccggaatggtgatgaatctagcagacctgaagaaatatatggaggaggctataatgcagcccctggatcataaaaacctggatatggatgtgccctacttcgctgacgtggtgtctaccaccgaaaatgttgcggtatacatttgggataacctgcagaaagtgttgccagtcggggtgctgtataaggtaaaagtgtacgagactgataacaacatcgtggtctataaaggggaatag

SEQ ID NO: 3537 - DNA, 4284 bp, Artificial Sequence
  Description of Artificial Sequence: Synthetic coding sequence
atgcaccagcggcacccccgggcccggtgcccccccctgtgcgtggcagggattctcgcatgcggcttcctgttgggctgttggggcccctctcacttccagcagtcatgccttcaggcactggaaccacaggctgttagttcatatctgagccccggagcccccctcaagggccgtcccccatctcccggatttcaacggcagcggcagaggcagcggagagccgcaggaggcatcctgcatctggagcttctggtagctgtaggccctgacgtctttcaggcacaccaggaagacacggagagatacgtgttaaccaacctgaatattggagccgaactgctgcgagatccctctttgggggcgcagtttcgcgtgcatctcgtgaagatggtaatcctgaccgagcccgagggcgcaccaaatataaccgcaaatctgacctcaagtctgctctctgtgtgcggctggtcccaaacgataaatcctgaagacgatacagatccaggccacgctgaccttgttctgtatattacccgtttcgacttggaattgccggatggcaatagacaagtaagaggtgtgacccaactgggaggagcatgtagccctacttggagttgcttgatcacagaggatactggcttcgacttaggggtgaccatcgcccacgagatcgggcatagctttgggctggaacacgatggggctcctgggtccggatgcggtcctagtggccacgtgatggccagtgatggagccgctcctagagccggactcgcctggtctccctgttcccggaggcagttactgagtctcctgagcgccggcagagctcggtgcgtatgggatcctccccggccacagcccggatcagccggacatccccccgatgctcagccaggtctgtactactccgctaatgaacagtgtcgcgtggcctttggaccaaaggccgtagcatgcacttttgccagagaacacctggatatgtgtcaggctctctcatgccacactgaccctcttgaccagagttcttgttcacggctactggtcccactgcttgatggcacggaatgcggagtggaaaagtggtgcagtaagggccggtgcaggtccctcgtcgagctgacacctatcgccgctgtccacggacggtggagcagctgggggcctcggagcccctgttctaggtcttgcggcggcggggtcgtcactcggaggcggcagtgcaataatcctcgacctgcattcggtggacgagcttgcgtcggcgccgatctgcaagccgagatgtgcaacacccaggcctgcgaaaaaacccaactggaatttatgagtcagcagtgcgcgcgcacagacgggcagcccctaagatccagccctgggggggcttcgttttaccattggggagctgcagtgcctcactcacagggggatgccctctgtagacatatgtgcagagccattggcgagtcattcatcatgaaacgcggggatagcttcctggatgggacgcgatgtatgcccagtggccccagggaggacggaacactaagtctatgtgtgagcgggagctgccgcacctttgggtgcgacggaaggatggattcacagcaggtctgggaccgctgccaggtgtgtggtggtgataattcaacttgtagtccaagaaaaggctcattcacagcaggccgggcaagagaatacgtaaccttccttacagtgaccccgaaccttactagcgtttacattgcaaatcatagaccactctttacacatctcgcggtgaggatcggaggcaggtatgtcgtggcaggaaagatgagcatctccccaaacacgacttacccaagcctgctggaggatggccgggttgagtatagggtagctctgactgaagataggttacccagactggaagaaattagaatttgggggccccttcaggaggatgctgacatccaagtatatagacggtatggggaagagtacggtaacctgacccgccccgacataactttcacctatttccagccaaagccgcggcaggcttgggtttgggcagcagtcagggggccatgttctgtttcttgtggcgcaggcctgcgctgggtgaattactcatgcctggaccaagcaagaaaagaactcgttgagaccgtacagtgccaaggctcacagcagccccctgcctggccagaagcctgcgttctggagccttgcccaccttactgggcggtgggcgatttcggtccatgctcagccagttgtgggggaggcctccgggagcggcccgtacgctgcgtggaagctcagggctcactgctgaaaacactccccccagccaggtgcagagccggcgcgcagcagcccgctgtggccctggaaacttgcaacccacagccttgtcctgcgaggtgggaggtctctgaacctagctcttgtacctccgccggcggagctggacttgcgttagagaatgaaacctgcgtgcctggcgctgatggcctggaggcaccagtcactgaagggcctggcagcgtggatgagaagctgccagccccagagccctgcgttggcatgtcctgccctccaggatgggggcatctagacgctaccagtgctggcgaaaaggccccatcaccctgggggtcaatcagaacgggggcccaggccgcccacgtgtggacaccagctgctggaagctgttccgtttcatgcgggaggggcctgatggagctgagatttctgtgtatggacagtgccctgagggttcctgtgcaggaggaactctgcgggctcgcctctaaacctggatcaagacgcgaggtatgccaggcggttccgtgtcccgctcggtggcagtacaagctagccgcatgcagtgtcagctgcggccgtggagtcgtcagacggattctctattgcgcacgagcacatggggaggatgacggagaggaaattctgttagacactcaatgccaggggcttcctcggcccgagccccaggaagcctgctccctggagccttgcccccctcgatggaaggtgatgagtctgggtccatgtagtgcctcttgcggactaggcacggccagacggtctgttgcctgtgtgcagctggatcagggccaagatgtggaagtcgatgaagctgcgtgtgcagccctggtacgacccgaggcttcagtgccgtgtctgatcgccgattgcacttaccgatggcacgtgggcacatggatggaatgcagcgtgagctgcggcgatggcattcaacgccgcagggatacatgcttgggcccgcaggctcaagctcccgttccggcagacttctgtcagcacctacccaagccagtgactgtgagggggtgttgggccgggccttgcgtcggtcagggtactccttccctggtgccacacgaggaagcggccgctcccggcagaactacggccactccagcaggagctagtcttgaatggagccaggcccggggcttactgttttctccagcgccacagcctagacgattgttacctgggccacaagagaactccgttcaaagttcagcatgtggtaggcagcacttggaacctactggaaccatagacatgagaggacctggacaggcggattgcgcagttgcaatcggccgccccctgggcgaggtggtgacactcagggtactggagtctagcttgaactgctctgctggagacatgctgctcctgtggggcaggctcacctggcgcaaaatgtgtagaaaactccttgacatgacattttcctccaagaccaacacactggtggtcagacagcgctgtgggagaccagggggaggagttcttttgagatatggatcgcagctggcccctgagaccttctatagggaatgtgatatgcaattatttggaccctggggcgagatagtgagtccctccttatcccccgctacaagcaacgcgggagggtgccggttgtttattaatgtggcccctcacgcgagaatcgccattcacgccctggccactaacatgggcgctgggacagaaggtgcaaatgcaagttatattctcattagagatacgcactctctccgtacgaccgccttccacgggcagcaggtgctttattgggaaagtgaaagctcccaagctgagatggaattctcggaggggttccttaaagcccaggcctctctgaggggtcagtactggactctccagtcctgggtgccagaaatgcaggatcctcagagttggaaaggtaaggagggtacctag

SEQ ID NO: 3538 - DNA, 3309 bp, Artificial Sequence
  Description of Artificial Sequence: Synthetic coding sequence
atgttccagctgcccgtgaacaacctgggcagcctgcggaaggcccgaaagacggtcaaaaagatattgtctgacatcggcttagagtattgcaaggagcacattgaggattttaaacagtttgaacccaacgatttctatctcaagaataccacgtgggaggatgtcggcctgtgggaccctagcctaaccaagaaccaagattatcgcacgaagcctttttgctgctctgcatgcccgttctcgagcaaattcttcagcgcctacaaatctcacttccgtaacgtgcacagcgaagatttcgaaaatcggattcttctcaattgcccatactgtaccttcaatgcggataagaaaacactggaaactcatatcaagatcttccatgcgcccaatgcaagcgctcctagcagcagtctgagcacctttaaggataagaacaaaaacgacggcctcaagcccaagcaggctgattccgtcgagcaggcagtctattactgcaaaaaatgtacctatagagatcccctttatgaaattgtgaggaaacacatctaccgtgaacatttccagcatgtggcagccccttacatagcaaaggccggcgaaaaaagcctgaatggagctgtcccgttgggatccaatgcccgggaggagtcctctattcattgtaaacgatgcttatttatgcccaaaagttatgaagcgctggtgcagcacgtgatcgaggatcacgagcgaattggctatcaggtgacagccatgattggccataccaacgtggtggtgccaagatccaaacctctcatgttgatcgcaccgaagccgcaagacaagaagagcatggggcttccgcctagaatcggttccttggcatccggtaacgtgcgatccctaccgtcacaacagatggtaaataggttaagtatcccgaagcctaacctgaattctacaggcgtcaacatgatgagctctgttcacttacagcaaaacaattacggcgtaaagtccgtgggccagggttatagtgttggccagtctatgcgccttggcttgggagggaacgcccctgtcagtattccccagcagtcacaaagtgtcaaacaactcctgccgtccgggaatggaaggtcctacggtctcggatccgaacagagaagtcaggccccagcaagatacagcctgcaaagcgccaacgcttcatctcttagttctggccagctaaaaagtccctccctgtcacaatctcaggcaagcagagtgctgggacagtcgagcagtaagcccgccgccgctgccaccggacctccacctggcaatacaagttcgacacagaagtggaaaatatgcacaatctgtaatgagctcttccctgaaaacgtttattccgtgcacttcgagaaagaacacaaggccgaaaaagtccccgccgtggctaactacatcatgaagatccataactttacatccaagtgtctgtattgtaaccgctatctgcctactgatactttgcttaaccatatgctgattcacggtctgtcctgcccatactgtcggtctacgtttaatgatgtggagaaaatggctgctcacatgcgtatggtgcacatcgacgaggaaatggggcccaagaccgattcaactctgagctttgaccttacgctgcagcagggttcccataccaacatacatctgctcgtgactacttataacttgcgggacgctccagccgaaagcgtggcgtaccatgcccagaacaatccccccgtgccccccaagccacaaccaaaggtacaggagaaagccgacatccccgtgaaatcctcaccccaagccgctgtgccatataagaaagacgtcggcaaaacactgtgcccactttgctttagtatcttgaaggggccgattagtgacgccctcgcgcatcatctcagggaaaggcaccaggtgatccagacagtgcaccctgttgagaagaagttgacttataagtgtatacattgcctgggagtgtacacaagtaatatgaccgcctccacaatcaccctgcatctagttcactgtagaggggttggcaaaactcagaacggccaggataagacaaatgctccctcaagacttaaccagagtcctagtctggcaccggttaagagaacatacgaacagatggagtttcctctcctcaaaaagaggaaactggacgacgattccgattctccgtcttttttcgaggagaagcccgaggagccagtcgtcctggcccttgatcctaagggacatgaggatgacagctatgaggctcgaaagtcattcctgaccaagtacttcaacaagcagccttatcctactcgaagagaaattgaaaaattagctgcctcactgtggctgtggaaatctgatatcgcctctcacttctctaataagaggaaaaagtgtgtgcgcgattgcgaaaagtataagcccggcgtgctccttgggtttaacatgaaggagctcaataaggtcaagcatgagatggattttgacgctgaatggctcttcgaaaaccacgacgaaaaagatagtagggtgaacgctagtaagaccgcggataaaaagctcaatctaggaaaagaggatgattcatcttccgattcattcgagaacctggaggaagagtccaatgaatccggatctcccttcgatcctgtgttcgaggtggaaccaaaaatctcaaacgataaccctgaagagcacgtattgaaagtaattcctgaagatgcttcggaatcagaggagaagcttgaccagaaggaagacggctctaagtatgagaccatacaccttaccgaggaaccaacaaagctgatgcacaatgcatcagattctgaggtcgaccaggatgacgtggtggaatggaaggacggcgcatcccctagtgaaagtggccccgggtcacagcaagtttcagatttcgaagacaatacatgcgaaatgaaacccggaacttggtcagacgaatcctcacaatcagaggacgcacgaagttctaagccagctgcaaaaaagaaggctaccatgcagggggatcgcgaacagttaaaatggaagaattctagctacggaaaggtggaaggcttctggagcaaggatcagtctcaatggaaaaatgctagcgagaacgacgaaaggctgtctaatccccagatcgaatggcaaaactcaactattgacagtgaagatggcgagcagttcgataatatgactgatggagtcgcagagccaatgcatgggtcattggccggcgttaaacttagcagtcaacaggcttag

SEQ ID NO: 3539 - DNA, 3309 bp, Artificial Sequence
  Description of Artificial Sequence: Synthetic coding sequence
atgttccagctgcccgtgaacaacctgggcagcctgcggaaggcccggaaaactgtcaagaagattctcagcgatatcggccttgaatactgtaaggaacatatcgaggatttcaagcagtttgagcccaacgatttctacctgaaaaatacaacttgggaagacgtgggcctgtgggatcctagtctgacaaaaaatcaagattaccgaaccaaacccttctgctgtagcgcttgccccttttcttcaaaattcttctctgcttacaaaagccacttcaggaacgtgcacagtgaggacttcgagaacagaattctactgaattgtccttactgcaccttcaatgctgataaaaagaccttagaaactcatattaagatctttcacgccccaaacgcatccgcaccatccagcagcctcagtactttcaaggacaagaataagaatgacggtctgaaacccaagcaggcagatagtgtcgaacaggcagtatactattgcaaaaaatgtacttaccgcgaccccctgtatgagatcgtgagaaagcacatatacagagaacacttccaacatgtggctgccccttacatcgccaaagccggagagaagagcctcaacggggcagtgcccttgggctctaatgctcgtgaggagagttcaattcattgtaaacgttgcctgttcatgcccaaaagctatgaggcgttagtacagcatgttattgaggaccacgagcgcatcgggtaccaggtgacggcaatgatcgggcatactaacgtagtggtgccccggagcaaaccgctgatgttaatcgctccaaaaccccaggataaaaaatcaatgggactgcctcccagaattggaagtcttgctagtggaaacgttcggagcctcccatctcaacaaatggtcaataggctctcaatccccaaacccaacttaaactcaactggagtcaacatgatgtccagcgtgcacttgcagcagaataactatggagtgaagagtgtgggccagggatactctgtggggcaatccatgcgactaggcctcggagggaatgcccctgtaagcatcccccaacagtctcagtccgttaagcagctgctgccgagcggaaacgggagatcttacgggctcggttccgaacagcggtctcaggcccctgcacgttattcactgcaatcagcgaacgcatcatctctgagtagtggacagctgaagtcccctagtctctcacagtctcaagcctcacgggttctaggccagtcctcttctaagcctgcggccgccgccaccggcccaccccccggtaacacctctagcacccagaaatggaaaatctgtacaatctgtaatgagctgttcccagagaacgtgtactctgtccatttcgagaaagaacataaagccgagaaagtgccagctgtggcaaattacatcatgaagattcataactttactagcaaatgcttatattgtaacaggtatctgccaaccgatactcttctgaatcacatgttgatccacggtttgtcttgcccttactgtcgttccaccttcaacgatgttgaaaaaatggcagcgcacatgagaatggttcacatcgacgaggaaatgggccctaagacagactcaaccctctcattcgatcttacattgcagcagggatcacacaccaatatccacctgctggttactacatacaatctccgagacgcccccgccgaaagtgtggcctatcatgctcaaaacaatcccccagtgcctcctaagccccagcctaaggtccaggaaaaggcggatatccctgtgaaatcttcaccccaggcagcagttccctataaaaaggacgtgggcaagaccctctgcccgctttgctttagcattctcaagggccccatctctgatgccttggcccaccatctgcgggagcggcatcaggtcattcagactgtgcatccagttgaaaagaagctgacttacaaatgtatacactgtctgggagtttacaccagcaacatgacagcttctaccatcacgttgcatttggttcactgtcggggcgtcgggaagactcagaatgggcaagataaaaccaacgctcccagccgattgaatcagtccccttctcttgcgccagtaaaaaggacttacgaacagatggaattcccgctactcaaaaagagaaagttagatgacgacagcgactccccctctttctttgaagaaaaacctgaggaacccgtcgtgctggccctggacccaaaaggtcacgaggatgactcttacgaggccagaaagagtttcctgaccaaatactttaacaagcagccatatcctaccagaagggaaattgagaaactggcagcatcattgtggctatggaaatccgacattgccagtcatttcagtaacaaaagaaagaaatgtgtccgggattgtgagaagtacaaacccggcgtcctgttgggctttaatatgaaggagttaaataaggttaagcacgagatggacttcgatgcagagtggcttttcgagaaccacgatgaaaaagattcacgagtcaacgctagcaagaccgccgacaaaaaactgaacctgggcaaggaggatgattcttcttcagactccttcgaaaacctcgaagaagaatccaacgaatctggatctcctttcgatcctgtcttcgaggttgagccaaagatcagcaacgacaaccccgaggagcatgtgttaaaggtgatccctgaggatgccagtgagtccgaggagaaacttgatcaaaaggaagatggaagtaagtatgaaactatccacctgaccgaggaaccaacaaagctcatgcacaatgcctccgactctgaagtagaccaagatgatgtggtggaatggaaggatggggcttccccgagtgaaagcggcccgggatctcaacaggtgagtgactttgaagataacacctgtgaaatgaaaccaggaacttggtcagacgagtcctcgcagagtgaggacgctcggagctctaagccagcagccaagaagaaggccactatgcagggcgacagagaacagctgaagtggaagaatagtagttatggtaaagtggaaggattttggtcaaaagaccagtcgcagtggaagaatgcatcagaaaatgatgaacgactgtcgaaccctcagatcgaatggcagaacagcacaattgattctgaagacggggagcagttcgataacatgaccgatggagttgctgaaccgatgcacggtagccttgccggggtgaagctgtccagccagcaggcctag

SEQ ID NO: 3540 - DNA, 3309 bp, Artificial Sequence
  Description of Artificial Sequence: Synthetic coding sequence
atgttccagctgcccgtgaacaacctgggcagcctgcggaaggccaggaagaccgtgaaaaagatcctgtcagatataggtctcgaatactgcaaagagcacatcgaggacttcaagcagttcgagccaaatgacttctacctgaagaatacaacgtgggaggatgtaggactgtgggacccctcgcttaccaaaaaccaggattatcgcacaaagccattctgttgttctgcatgtccattttcatccaaatttttcagtgcgtacaaatcccactttagaaacgtacacagcgaggatttcgaaaaccggattttgctgaattgcccttactgtaccttcaatgccgataagaaaacactggaaacacacataaagatatttcatgccccaaatgccagtgcacctagctcctctctgagtacctttaaagataagaacaaaaacgacgggctgaaacccaagcaagcggactcggtcgaacaggccgtctactactgtaagaaatgtacttatagggacccactctatgagatcgtgcggaagcacatctaccgtgagcacttccagcacgtggccgccccgtatatagcaaaagcaggtgaaaaatctctgaatggcgctgttccgttaggatctaacgccagggaagagagtagcatccactgtaaacgatgcctgtttatgcctaaatcttacgaagcactggttcagcacgttattgaggatcacgaaaggattggttaccaggtcactgcaatgattgggcacaccaacgtggttgtccccagaagcaaacctcttatgttgattgctccaaagccgcaagataagaagagcatgggactgcccccccggatcggctcgcttgccagcggaaacgtgagatccctgcccagccagcagatggtgaatagactgagcatacctaagcctaaccttaacagcacaggggtcaatatgatgtctagcgtgcacttgcagcagaacaactacggagtcaagtctgtaggccaagggtattcagttggacagtcaatgcgactgggcctaggtggtaatgcccccgtttcaatccctcagcaatctcaaagcgtgaagcagttgttaccgagcgggaacgggcggtcttacggcctgggctcagagcaacgctcccaggcacccgctagatacagccttcagtcagcaaacgcctctagcctgagcagcggccagcttaagagcccaagcctgagccagtcacaagcttcacgggttctcgggcaatcctcttccaaacccgcagccgctgcgacaggcccaccacccggaaacacttcatccacccagaagtggaagatttgtaccatctgcaatgagctgttcccagagaacgtgtactccgtacattttgagaaggagcacaaggccgagaaagtgcccgccgttgccaactatatcatgaagattcacaattttacaagcaagtgcctctattgtaaccggtatcttccaacggacacactgttaaatcacatgctgattcacggcttaagctgtccatactgcaggtctacattcaatgacgtcgagaagatggccgctcacatgcggatggtgcacatcgacgaagaaatggggccgaaaactgactcgaccctgtctttcgatctcacactgcagcagggatcacacaccaatattcacttattggtgacaacctacaatctgagagatgcccctgcagaatccgtggcctatcacgcacagaacaatcctcccgtccctcctaagcctcagcccaaagtgcaagaaaaagccgacataccagtcaagagcagcccacaggcggcagtaccatacaagaaggacgtcggtaagactctttgccctctgtgcttctccattctaaaggggcctatcagcgacgcgctcgcccaccaccttagagagagacaccaggtaatccagacagtccatccagtagagaaaaagctgacctacaagtgtatccattgtctgggtgtatacacatccaacatgactgcctccactattacactccatttagtccactgccggggagtgggcaagacacagaatggtcaggataaaacaaatgcccccagccggctgaaccagtcgccctcactagcccctgtcaagcgaacatatgaacagatggagttccccctgctgaaaaagcgcaagctcgatgacgactccgacagtccctctttcttcgaggaaaagcccgaggaacccgtggttctcgccctcgacccgaagggtcacgaggatgactcctacgaggctcggaaatccttcctgacaaaatacttcaacaaacagccctaccccacaaggagggaaatcgagaaattagctgccagcctgtggctctggaagtctgatattgctagccatttttccaacaagaggaaaaaatgcgttagggactgtgagaagtataaacccggggtgctgctggggttcaacatgaaggaattgaacaaggtaaagcatgagatggactttgacgccgagtggctgttcgagaaccacgacgagaaagacagccgggtgaacgcatccaagaccgccgataaaaagctgaacttgggcaaggaagacgactcttcctctgactcttttgagaatctcgaggaagaaagcaatgagtcaggatctccctttgatcctgtgtttgaagtggaacctaaaatcagcaacgataatcctgaagagcatgtgctgaaggtgattcccgaggacgcctccgagtccgaagagaaacttgatcaaaaagaagacggcagcaagtatgagaccatacatctgactgaagagcctacaaaactgatgcataacgcaagcgacagtgaagttgaccaagacgatgtagttgaatggaaagatggcgcatcgccgagtgagtctggcccagggagtcaacaggtaagcgatttcgaagataacacttgtgagatgaaacctgggacttggagcgatgagtcttcacagagcgaggacgccagatctagcaaacctgctgccaagaagaaagccacaatgcagggagaccgagaacaattgaaatggaaaaatagtagttatggaaaggtggagggattttggtccaaagatcagagccagtggaagaacgcaagcgaaaacgatgagcgcctttcaaatccccagatcgagtggcagaatagtaccattgatagcgaggacggagaacagttcgataacatgactgacggcgtagcagagccaatgcacgggagtctcgctggcgtaaagctcagttcgcagcaggcttag

SEQ ID NO: 3541 - DNA, 3309 bp, Artificial Sequence
  Description of Artificial Sequence: Synthetic coding sequence
atgttccagctgcccgtgaacaacctgggcagcctgcggaaggccaggaagacagttaaaaagattctgtccgacatcggccttgagtattgtaaggagcacattgaggatttcaaacagtttgaaccgaatgacttttatctgaagaatacaacttgggaggatgttggtctatgggacccaagcctgactaaaaaccaggactaccgcacgaaacccttctgttgctcggcttgtcccttctcttcaaagtttttttcagcttacaagtcccactttcgcaacgtgcacagcgaagacttcgagaatcgaatactgctgaattgcccctactgcacctttaacgctgacaagaaaactctcgagacacacatcaagatcttccacgccccgaacgcttcggccccttcttcttccctttcgaccttcaaggataagaacaagaatgatggacttaagccaaaacaagctgacagcgtggaacaagcagtttactactgtaagaagtgtacatatcgtgaccctctctacgaaattgtacgtaagcacatctaccgcgagcactttcagcatgtcgcagccccctacatcgccaaggctggcgaaaagtcattgaacggggcagtgcccttgggcagtaacgccagagaagagagtagcatccactgtaagaggtgcctgtttatgcccaagtcttacgaagctctagtgcaacacgtcattgaagatcacgagcgaattggttaccaggtgacggcaatgattggtcacaccaatgtagtggtcccacgctcaaaaccactcatgctcatcgcccctaaaccacaagacaagaaatccatggggttgccgccaaggataggctcactagcctctggcaatgtgagaagccttcccagtcagcagatggttaatcggttatcaataccaaagccgaatttaaattctaccggtgtgaacatgatgtcatccgtgcacttgcagcaaaacaattatggagtaaaatctgtgggacagggttattctgtcggtcagagtatgcggctggggctaggcggcaatgctccagtgtcaatcccccagcagtctcagagcgtgaagcagctgctcccaagcgggaatggccggagctacggcttggggagcgaacaacggagtcaggcgccagctcgctactctctgcaatccgcaaacgcttctagcctgtcaagtggtcaactcaaaagtccatcactgagtcagtcacaggcatcgagagtcctcggccagagcagtagcaagccagctgcagctgccactgggcctcctcccgggaatacaagctccacccagaaatggaaaatatgcaccatttgcaacgagttattccctgaaaacgtctacagcgtccacttcgaaaaggagcacaaagctgaaaaagtgccagccgtcgccaattacatcatgaagatccacaacttcaccagcaaatgcttgtattgtaaccggtaccttcccactgatacgttattaaatcacatgctgatccatggcttgtcttgcccctactgcagatctacatttaatgacgtcgaaaaaatggccgctcatatgaggatggtgcatattgatgaagaaatgggcccaaagacagatagcacacttagtttcgatctgaccttacagcaggggtcccacacgaatatccatttattagtcactacctacaatctaagggacgctcccgcagaaagcgtggcttatcacgcccagaacaaccccccagtacctcctaagccgcaacccaaagtacaggaaaaggctgatattccagtgaagtcctcgccccaggcagccgtgccttacaagaaggatgtgggaaagactttatgccccctgtgcttctccatccttaaaggtcctattagtgacgcattagctcaccatctgagggaaagacaccaggtgatccaaaccgtgcacccagtggagaaaaaactcacctacaagtgtattcattgtctcggagtctatacttccaatatgacagcctccaccatcaccctccacctggtacactgcaggggagtgggcaaaactcaaaatggtcaggacaagacgaatgccccgtctcggctcaatcagtctccctctttggcgcccgtgaaacgcacgtatgaacaaatggagttccccttgcttaaaaaacggaagttggatgatgatagcgacagcccctcttttttcgaagaaaagccagaggagcccgtagtgctagctctcgatcccaaagggcacgaagatgacagttacgaagcccggaaatcctttctcacgaaatatttcaacaagcagccatatccaactaggcgggagatcgagaagttggcggctagcctttggctctggaagtccgacattgcctctcacttctcaaacaagagaaagaaatgcgttcgcgactgcgaaaagtacaaaccaggcgtccttctaggatttaatatgaaggagctcaacaaagtaaaacacgagatggactttgatgcagaatggctttttgaaaatcatgatgagaaagattccagggtgaacgcatcaaagacagctgataagaaacttaatctcggaaaggaggacgacagtagctctgactcctttgagaatttagaggaggagagcaacgagtctggcagccctttcgaccctgtgtttgaggtcgaacctaaaatcagcaatgacaaccccgaagaacatgtactgaaggtaattccagaggacgcatccgagagcgaagaaaaactagaccagaaagaggacggctccaaatatgagaccatccatctcacagaggaaccaacaaaactcatgcacaacgcctcagacagtgaggtcgatcaagatgacgtggtggagtggaaggatggagctagccctagcgagtcagggccaggcagccagcaggtttccgatttcgaagataacacgtgcgaaatgaaacctgggacctggtccgacgagtcctcacagtcagaggatgcccggagctcaaagccggctgccaaaaagaaagccactatgcaaggggacagggagcagctgaaatggaaaaactcaagctatggtaaggtggaaggcttttggtccaaggatcagtcccagtggaagaatgcgagcgagaatgacgagaggttatcaaatccacagattgagtggcagaacagcacgatcgactccgaggatggagagcaattcgacaacatgaccgatggcgtggcagagccgatgcatgggtcccttgccggcgtgaagctctcaagtcaacaggcatag

SEQ ID NO: 3542 - DNA, 522 bp, Artificial Sequence
  Description of Artificial Sequence: Synthetic coding sequence
atgttccagctgcccgtgaacaacctgggcagcctgcggaaggcccgcaaaactgtgaagaaaatcctgtctgatataggactcgagtattgcaaagagcacatcgaagactttaaacagttcgaaccaaacgacttctacctgaaaaatacaacttgggaggatgtgggtttgtgggaccctagtctcaccaagaaccaggactacaggactaaacccttttgctgcagcgcctgcccgttttcttcaaaattttttagcgcttataagtcacattttaggaacgtgcattccgaggattttgagaaccgtattctgctgaactgcccgtactgcacctttaatgctgataagaagacccttgagactcacatcaagatcttccacgcccccaacgcctcagcaccctcctcttcgctatctacattcaaggacaagaacaagaacgatgggcttaaacccaaacaggccgactcagtggaacaagccgtgtactactgtaagaagtgtacgtacagatag

SEQ ID NO: 3543 - DNA, 441 bp, Artificial Sequence
  Description of Artificial Sequence: Synthetic coding sequence
atggtgatcctgaccgagcccgagggcgcccccaacatcaccgccaatttgacctcaagtctcctgagcgtgtgtggatggtcacagacaatcaatcctgaagatgatacggaccccggccacgccgacctggtattgtacatcacgcggttcgacctcgaactccctgacggaaaccgtcaagtgcggggcgtaactcaactgggtggagcttgctcccccacgtggtcttgtctgatcaccgaagacaccggctttgacctcggtgtcacaatagctcatgagattgggcataggatttgtgcacggccatctcccgcaactcagacaagatggaccaaggcagctgccgcagcaagcagcttccttagctggatggggcagaacgtcgcctggcgatccggggcgccccgagtggccgctgccccctggtggtcatag

SEQ ID NO: 3544 - DNA, 4116 bp, Artificial Sequence
  Description of Artificial Sequence: Synthetic coding sequence
atgcaccagcggcacccccgggcccggtgcccccccctgtgcgtggctgggattctggcctgcgggttcctgttgggctgctggggtccgtcacatttccagcaaagctgcctccaggcactggagccacaggctgtctccagctatctgtcacctggagccccactaaaggggcggccccctagtcctggctttcaacgccagagacagcgtcaacgccgggccgctgggggcattctccacctggagctcctcgtcgccgtcggtcctgatgtatttcaagcacaccaggaagatacagagagatatgtgctgacgaacctgaatatcggagcggagctcctgcgagaccctagcctcggcgctcagttccgcgtccaccttgtaaagatggttatcctgacggaacctgaaggtgctccaaatattaccgccaatctgacctcctcactcctcagtgtatgcggttggagccagaccatcaaccccgaggatgatacagatccaggccatgctgacctggttttgtatattaccagatttgatttggaattgccagacggaaaccgccaggtacggggtgtgacccaactgggcggcgcatgttccccaacttggagctgcctgattactgaagacactgggttcgacctgggcgttacaatcgcccacgagataggtcatagctttggtctggaacacgatggagccccaggatctggctgtggaccttctggacacgtgatggcctccgatggggcagcccctagagcaggcctcgcctggtcaccatgttcccgccgtcaactactctctctgctttccgctggtcgggcacggtgcgtctgggatcctccgagaccacaacccgggagcgccgggcaccctcctgatgcccagcccggcctatattacagcgccaatgaacaatgccgggtggccttcggcccaaaggcagtggcctgcacattcgccagagaacacttggacatgtgccaagcccttagctgccacactgacccactggatcaatcatcatgttcccgcctcctagtgcctctgctcgacggcacagaatgcggggttgagaagtggtgcagtaaagggcgttgcaggagcttggttgaactgactcctatcgcggccgtgcacggccggtggagctcctggggcccacgcagcccttgttcccgtagttgtggcgggggcgtagtaacacgtcgccggcagtgcaacaatcctagacccgccttcggcggtcgtgcatgcgtgggggccgacctgcaggcagaaatgtgtaacacacaggcatgcgaaaagacacagctggagtttatgtctcagcagtgcgctcgaaccgatggacaaccattaagatcctcgcccgggggcgctagcttttatcattggggagctgcagtacctcactcccagggagacgccctgtgccgccatatgtgtagagcaatcggagagtctttcatcatgaagcgaggcgacagctttctcgatggaacaaggtgcatgccttccggccctcgagaggacggaactctttctctttgcgtgtcaggctcatgccgtaccttcgggtgcgacggccggatggattcacaacaggtctgggacagatgccaggtatgtggcggcgataatagcacttgcagcccacgcaagggatccttcacggctggtagagcacgcgaatatgtgacctttctgaccgtaacgccgaacctgactagcgtctacatcgctaaccaccggcccctgttcactcacttggcagttcggattggcgggcgctacgttgttgccgggaaaatgagtatttccccaaatacaacgtacccctctctgttagaggacgggagggtcgagtaccgcgtggccttaacagaggatcggctgccccgactggaagagattcggatttggggaccgctccaggaggatgccgatatccaggtctaccgcaggtatggcgaggagtacggcaatctgacaaggcccgacattactttcacttacttccaacctaaaccgcgacaggcctgggtgtgggctgcggtgaggggaccctgctccgtgagctgcggggccggcctcagatgggttaattatagctgccttgatcaagctcggaaggagctggtagagacagtacagtgccagggcagccagcagcctcccgcatggcccgaggcttgtgtcctggaaccttgtcccccatactgggcagtaggtgatttcggtccatgttctgcttcctgcgggggaggactgcgagagcgcccagtcagatgcgtcgaagctcaggggtccctgttaaaaacattgccccctgcccgttgtcgcgcaggcgcccagcaacccgctgttgccttagaaacctgtaatcctcaaccgtgtcccgcgcgctgggaagtctccgagccctctagctgcacaagtgcagggggggccggcctcgcccttgaaaatgaaacctgcgttccaggggcagacgggctcgaagccccagtgacagagggtcccgggtccgtggacgagaagttgcccgcccccgagccctgcgtgggcatgagttgcccaccgggatggggacatcttgacgccacctcagcgggcgagaaagcaccgtccccgtggggtagcattaggactggtgctcaggccgcacacgtttggacacccgccgccggctcttgttcagtctcctgcggcagaggtttgatggagctgagattcctttgtatggattcagctctgcgagttccggtgcaagaagaattatgtggcttagctagcaaaccgggtagccgacgagaggtttgccaggcggtcccgtgccctgcacgttggcagtacaagctcgccgcatgttccgtgtcctgtgggcgtggcgtcgttcggaggatcttgtactgcgctcgggcccacggagaggacgacggagaggaaatacttctggacacccagtgtcagggcctgcctaggcccgagccccaggaagcatgcagcctggagccttgtccacctcgctggaaggtgatgtctctgggtccctgcagcgcctcatgtgggctgggaactgcacggcggtctgtcgcctgtgttcaattagaccagggccaggatgtcgaagtagatgaagcggcctgcgccgcactagtgagacccgaggcctctgtcccctgcttgatcgccgattgtacgtatcggtggcacgtggggacatggatggaatgttccgtgtcatgcggagacggcatccagaggcgaagagacacctgtctcggccctcaggctcaggctcctgtgccagctgacttctgccagcacctcccgaagccagtgacagtgcggggatgctgggcgggtccatgtgtggggcagggagcctgcggtcggcagcatttggaaccaacaggtacgattgacatgaggggtccagggcaagccgattgcgcagtcgccattggacgacctctgggcgaagtggtgacccttagagttcttgaaagcagtctgaactgttcagctggtgacatgcttttattatggggccggctcacatggaggaagatgtgtagaaaactcctggatatgacattctcaagcaaaacgaatactctcgtcgtgagacagcgctgcgggagaccggggggaggggtactgttacgttatgggtcccaattggcccctgagacattttaccgcgaatgcgacatgcagttgttcggaccctggggggagatagtaagccctagtctgagccctgcgaccagtaatgcaggaggctgtcgactcttcattaacgttgctcctcatgctcggatagcaatacacgccctcgcaaccaatatgggggcaggcacagagggcgccaacgcgagctatatccttatcagggacactcactctttgcgaacaaccgctttccacggccagcaggtgctatattgggagagcgagtcttcccaagcagagatggaattttcggaagggtttctcaaagcgcaggcaagcctcagaggccagtactggactttacagtcttgggtcccagagatgcaggacccccagagctggaaaggaaaggagggaacatag

SEQ ID NO: 3545 - DNA, 4023 bp, Artificial Sequence
  Description of Artificial Sequence: Synthetic coding sequence
atgcaccagcggcacccccgggcccggtgcccccccctgtgcgtggcaggtatccttgcatgcgggtttctgctcgggtgctgggggcctagccactttcagcaaagctgccttcaagccctagagccccaggctgtttctagctacttgagcccaggcgctcctcttaaggggcgtccaccttctcctggctttcagcggcagagacaacgccagcgaagagctgctggcgggatcttgcacctggaattgctagtcgctgttggccccgacgtctttcaggcacatcaggaggataccgagcgatacgtgctcaccaatcttaacattggtgcagagcttttaagagaccccagcttgggcgctcagttccgcgtccatctagtgaagatggtcattctgaccgagcccgagggggcgcctaatattaccgccaacttgactagcagcctgctctccgtctgcggatggagccagaccatcaatccggaggatgacacggaccccggccacgcagacttggttctttacatcacacgcttcgacctggaactccctgatgggaaccgacaggttcggggcgtgacgcaactcggtggcgcatgttccccaacgtggtcttgtctcattacagaggacaccggcttcgacctaggagtaaccattgctcacgagatagggcactcgttcgggcttgaacacgatggcgcacctggctccggatgtgggcccagtggccatgtcatggcatccgatggggccgccccacgagcaggtcttgcctggagtccctgctcgcgccgccagcttctatccctgctctctgcgaatgaacagtgtagggtggccttcggtcctaaagccgtcgcttgcaccttcgccagggaacacttagacatgtgccaggctttgagttgccatacggatccactcgatcagagtagctgctcaaggctgctggtgcccctcctcgatggaaccgaatgcggggttgagaagtggtgttccaagggacgatgcagatcactggtggagttaacccccatagccgccgtgcacggacgatggtccagctggggcccccgcagtccatgtagtagatcgtgcggaggcggcgtggtcacacgcagacgtcagtgtaataaccccagaccagccttcgggggtagggcgtgtgtgggcgccgatttgcaggctgagatgtgcaacacccaggcctgcgagaagacccagctggagtttatgtcacaacagtgtgctcgcactgacgggcagccacttcggagttccccaggcggagcttccttctatcattggggagccgctgtgccccactctcaaggtgatgcactgtgccgacacatgtgcagggctatcggcgagtccttcatcatgaagcgtggcgattcgtttctggatggcacacggtgtatgccttcaggcccacgcgaggacggcactctatctctgtgcgtgagtggctcctgtcgtactttcgggtgcgatggtaggatggattcacagcaggtatgggatcggtgtcaggtgtgtggcggggacaatagcacatgtagcccacggaaaggctccttcacagccgggcgcgcccgcgaatatgtgaccttcttgaccgtcacccccaacctcacctcagtatacatcgcaaaccataggccattgttcacacacctggctgtcagaattggaggtcgatacgtagtggctggaaagatgagcatttcccctaacactacttaccccagtctgctggaggacggccgggtcgagtatcgtgtggcactgaccgaggacagactgcctagactggaggaaattcggatctggggccccctgcaagaggacgctgacatccaggtttatcggaggtatggagaagaatatggtaacctgactaggcccgacataacgtttacatacttccagccaaagccccgtcaggcctgggtgtgggcagcagtccggggcccttgctcagtgtcctgtggcgctgggttgaggtgggttaattactcctgtcttgaccaggccaggaaagagctggtcgaaaccgtccaatgccagggttcgcagcagccacctgcatggcccgaggcttgcgtcttggaaccatgtcccccatattgggcagttggggactttggtccttgtagtgccagttgtggcggggggctccgtgagaggcctgtgcggtgcgtggaagctcaaggttccctgctcaaaacactgccccccgcaaggtgtcgcgcgggcgcccagcagccggccgtggccctcgaaacatgtaatcctcagccttgcccggcgcggtgggaagtctcggagccctcctcatgtacctccgcgggaggcgccggtctggcgttggagaatgagacgtgtgtcccaggtgcggatggtctggaagcaccggtcactgagggtcccgggagcgtcgatgagaaactgccagcccccgaaccgtgcgtgggaatgagttgtccgcctgggtggggtcacctagacgcgaccagcgccggcgagaaggcaccctcaccatggggaagcatccgcacaggagcccaggccgcacatgtgtggaccccggcagctggatcttgcagtgtgtcctgcggacggggattaatggagctgagatttctttgcatggatagcgccctccgggtgccagtgcaggaagaattgtgtggattagccagcaagcccggctccagacgggaggtgtgtcaggctgtgccttgtcccgcccgctggcaatacaagctggccgcatgcagtgtctcttgtggacgtggagtggttcgccgtattctgtattgcgcacgtgcacacggtgaagacgacggcgaagaaattctcctggatacacagtgccaggggctgcctagaccagagcctcaggaggcctgttctttagaaccttgtcccccaagatggaaggtgatgtcattgggcccatgctctgcctcctgcgggctgggcaccgctcgcaggagtgtagcttgtgtccagctggaccagggacaagacgtcgaggtggacgaagccgcctgcgccgcacttgtgagaccagaggcctctgtgccctgccttatagcggattgcacatacaggtggcacgtgggaacttggatggagtgtagtgtgtcctgcggtgacgggatccagaggagacgcgatacctgcctaggtccccaggcccaggcccctgtgcctgccgatttttgccaacaccttccaaaacccgtgacagtgcgaggctgttgggccgggccatgtgtgggtcaaggcgcgtgtggcagacaacacctcgagcctaccggcactattgatatgcgggggcctggccaggccgattgcgcagttgcaattggaagacctcttggagaagtggttacgctgagagtactcgagtcctccctgaactgttccgctggtgacatgttattactctggggacgtctgacctggaggaaaatgtgcagaaaactgttggacatgacattctcgagtaaaacaaataccctggtcgtgaggcaacgctgcggtagaccaggaggaggcgtgctgctcaggtatggaagtcagctcgcgccagaaacattttaccgggagtgcgatatgcagctgttcggcccctggggagaaatcgtgagtccaagcctctctcccgctacaagtaatgctggggggtgtagactttttatcaacgtggctcctcatgccaggattgcaatccacgcactggcaacgaacatgggtgccggtactgaaggggctaatgcatcctacatcctcattcgcgacacccactcacttagaacaacggcctttcacgggcaacaagtcctgtattgggagtcagagtcttcacaagccgaaatggagttcagtgaaggatttttgaaggcgcaggcaagcctaagaggccagtactggactttacaaagttgggtgcccgaaatgcaagacccacaatcttggaagggaaaagaagggacctag

SEQ ID NO: 3546 - DNA, 672 bp, Artificial Sequence
  Description of Artificial Sequence: Synthetic coding sequence
atgcggggccccggccaggccgactgcgccgtggccatcggccggccactaggggaagttgtaactctccgcgtcctagagagctctcttaactgcagcgccggagacatgttactgctgtgggggcgcctcacctggagaaagatgtgtaggaaattgctcgatatgacctttagtagtaagaccaataccctggtggtgcggcagcggtgcggaaggcctggagggggagtcctgctcagatatggtagccaacttgcccctgaaaccttctacagggagtgtgatatgcaattatttggtccatggggtgaaatcgtatccccatccctctccccggccacatcaaatgccggcggctgccgactgttcatcaatgtcgcaccccacgctcgcatcgcgatccacgccctggccaccaacatgggggccggtactgagggagccaatgcttcttacatcctgattagggatacacactcactcagaactactgcttttcatggccagcaggtgttgtactgggaaagtgaatccagccaggctgaaatggaattctccgaggggttcctgaaggctcaggctagtctcagaggccagtactggactctgcaaagctgggtgcctgagatgcaggacccacagagttggaagggaaaggaggggacatag

SEQ ID NO: 3547 - DNA, 1035 bp, Artificial Sequence
  Description of Artificial Sequence: Synthetic coding sequence
atgcaccagcggcacccccgggcccggtgcccccccctgtgcgtggccggtattttagcctgcggctttctcttaggatgttggggacctagccactttcaacagtcatgcctgcaagccctggaaccacaagctgtttcttcttatctgtctcccggagcaccactgaaagggaggccaccctccccaggattccaacgccagaggcagaggcaacgccgcgctgccggtggcatcctccaccttgagctgctcgttgctgtggggccagatgtattccaagcgcaccaggaagatacagaacgttatgtactgacaaacctgaatataggagccgagctgttaagggatccttcgctgggcgcgcagtttcgagtccacctggtgaagatggtcattctgaccgagcccgagggggcccctaacatcactgcaaatcttacttcaagtctcctgtcagtgtgcgggtggtcccagaccattaatccagaagacgacaccgatccagggcacgccgacttggttctatacataacaaggttcgatctggagctcccggatggcaaccgccaggttcgcggagtgacacagctcgggggtgcctgctcaccaacctggtcctgtctcattactgaggacacaggcttcgacctcggcgttacgattgcgcatgaaattgggcatagttttgggctggagcacgacggtgcccccggttcagggtgcggaccttccggccacgtcatggctagcgatggcgccgcaccccgtgcagggttggcatggtcaccttgcagccggcgtcagctactgtcactactccgtcctgtgcccccatccccccttccactcctggccacccatttatgtgccggcagatccctcagcctgggcccctcacaagaacctgcacctggcggggggcgcggacctagaactccagtcccaacccataagcgtcctaggtttcaaaccctgccgtcatcctgcccgctgcttcggcctgcctcttccagatgtacccctcgcgactag

SEQ ID NO: 3548 - DNA, 831 bp, Artificial Sequence
  Description of Artificial Sequence: Synthetic coding sequence
atgcaccagcggcacccccgggcccggtgcccccccctgtgcgtggctggaatcctcgcctgcggcttcttacttggctgctggggaccttctcacttccagcagtcatgtctgcaggcacttgaacctcaggccgtgagttcctacttgagtccaggtgcgcccctgaaaggacgaccaccctctcctgggttccaaagacagcgccagagacagagacgagccgcaggcggtatcctgcatcttgagcttctggtggctgtcggacccgatgtgttccaggcccaccaggaggacacagaacggtacgttctaacgaatctcaacatcggcgccgaattgctacgtgatccctcactcggggcccaatttagggttcatcttgtgaaaatggtaattctaaccgaaccagagggagcccccaatataacagccaatctgacctctagcctgctctccgtgtgtgggtggtctcaaactattaacccagaagacgatacagatcctggccatgccgaccttgtgctgtacataacacgattcgacctggagctccctgatggaaatcgtcaggtcagaggtgttacacaactgggcggggcttgctccccgacatggtcatgtctgatcacagaggataccgggttcgatctgggagtgactatagctcacgagatcggacaccgcatctgtgcgcggccatcacccgctacccagacacgctggaccaaggcagccgctgcggctagctcctttctaagttggatggggcaaaatgtcgcttggcgctccggagctccccgggtggctgcggccccatggtggagttag

SEQ ID NO: 3549 - DNA, 4284 bp, Artificial Sequence
  Description of Artificial Sequence: Synthetic coding sequence
atgcaccagcggcacccccgggcccggtgcccccccctgtgcgtggcggggatcctggcatgcggtttcctgctgggctgttggggaccaagccacttccagcagtcttgtttacaggcgttggaaccccaggccgtgagctcatacctcagtccgggggcccctctgaagggtagaccacccagtcctggctttcagagacagagacagcgacaacgccgagccgcaggggggatcctacatctggagcttctggtggccgtgggccccgatgtgttccaagcgcatcaagaggataccgagcgctacgtactgaccaatcttaatataggagcggaactgctccgggacccttcgctaggcgcacaattccgggtgcatctcgttaaaatggttatcctcaccgagcctgagggcgccccaaacatcaccgcaaatcttacaagttccctgctgtccgtatgtggttggagtcaaaccatcaatcccgaggatgacaccgacccagggcacgccgacctggtgctctatattacaaggtttgacttagaactccctgacggtaacaggcaggtgagaggcgtcacacagctcggcggagcttgctcgccgacatggagctgcctcattacagaagatactggcttcgacctgggcgtgacaatcgctcatgagattggccacagtttcggcttggagcacgatggggctccagggtctgggtgcgggcccagtgggcacgtgatggcctctgatggagccgcgccacgggccggtctggcatggtctccatgctcccgcagacagctgttgtccttactcagtgctggtagagcgcgctgtgtgtgggatccaccaagaccacagcccgggagtgctgggcaccccccggacgcacagccaggactgtactattccgctaatgaacagtgcagggtggcattcgggcccaaagcagtggcttgtaccttcgcgcgcgagcacttagacatgtgtcaagccctgtcgtgtcacaccgatccactggatcagagttcttgttcccgcttactcgtgcctttgcttgatgggactgagtgtggtgtggaaaaatggtgcagcaagggccgatgtagatcactcgtggagctgacgcctatcgcggcagtccatggaaggtggtcctcttggggacctcgtagtccttgttcgcgaagctgtggtggcggcgtggttactagaaggagacagtgcaacaatccacggccggcgtttggagggagggcatgtgttggggctgatctgcaagcggaaatgtgtaatacccaagcatgcgaaaagacccaattggagttcatgagccagcagtgtgccagaactgacggccagcctcttcgatcctcaccaggcggcgcttctttttatcattggggggcggccgttccccattctcaaggggatgccctttgcagacatatgtgtcgagctattggcgaatcctttattatgaaacgtggggatagcttcctggacggcacaagatgcatgccttccggtcctagagaggacggaacgctttccctttgcgtatcaggatcatgtagaacctttggatgcgacggaagaatggacagccaacaggtgtgggataggtgtcaggtgtgtggcggagacaattccacctgtagtccccgcaagggatctttcacggcaggccgagcacgagagtacgttacttttctaactgtgaccccaaatcttacttccgtgtacatcgctaatcaccggcctttgttcactcatttggctgttagaatcggaggaaggtacgtggtcgctgggaagatgtccatatcaccgaacaccacttacccgagcctgctggaggacggtagggtcgaatatagagtggcccttacggaggaccgcttaccccggctcgaagagattcggatatggggccccctgcaggaagatgctgatatccaggtctatcgcaggtatggcgaggagtatggtaacctcacaaggcccgatattacatttacatattttcagccaaagccgcgccaagcctgggtgtgggccgctgttagggggccttgctccgtttcatgcggggctggattaaggtgggttaactacagctgccttgaccaggccaggaaggagttggtggaaacggtgcagtgtcaaggatcgcagcagcctccagcttggcccgaggcctgcgtcctggagccctgtcctccatattgggcagttggcgactttggtccctgttccgccagttgcggcggagggttacgcgagcggcccgttagatgtgtggaggctcagggaagcctgcttaagactctgccaccagcacgatgcagagctggtgcacagcagcccgctgtggcgctcgagacatgtaatccccagccatgtccagcacggtgggaggtcagtgagcctagctcctgtacgtccgctggcggagccggcctggccttagaaaacgagacctgcgtgcctggcgccgatggattggaagctccagtaacagaaggaccaggctccgttgacgaaaagctcccggctcctgaaccatgtgtggggatgtcctgcccccccggttggggacatctcgatgctacttccgccggtgagaaagccccctccccctgggggtcaatccgcaccggggcccaagctgcgcacgtgtggacaccagcagccggcagctgctccgtgagctgcggtcgcgggctgatggagctcagatttttatgtatggattctgctctgcgtgtacccgtgcaagaagagctgtgcgggctggctagcaaacctggatcccggcgcgaggtgtgccaagcagtgccctgtcctgcaagatggcagtataaactggccgcctgctctgttagctgcggacgtggcgtggtccggaggattctgtactgtgcgcgcgcgcatggggaagatgacggcgaagaaattctgctcgacactcagtgccagggacttccccgccctgagccccaggaggcctgcagcctcgagccgtgtccacccagatggaaagtgatgtctttaggtccctgcagcgccagctgcggactaggaaccgcccggaggagtgtggcctgcgtccagctggatcaaggccaagacgtcgaggtcgacgaggccgcctgcgcagccctggtgcgaccagaggctagcgtcccttgcctaatcgccgactgtacttatcgttggcacgtcgggacttggatggaatgctcagtatcctgtggggacggcattcagagaagacgcgacacgtgtctgggccctcaggcccaagccccggtccctgcggatttttgccaacacctcccgaagcccgtcactgttcgcggttgttgggctgggccctgtgtaggccaaggtactccatccctggttccacacgaagaggccgcggcccctggtagaacaaccgcaacaccagcaggcgcctcccttgagtggagccaggcccgcggactcctgttctcacctgcccctcaacccaggaggctcctgcccggaccacaggaaaattcagttcaatcttcagcatgtggtcggcagcacctggagcctaccggcaccattgatatgcgcggccctggtcaggcggattgcgcagtcgccatcggtcggccactcggcgaggtggtgactctcagagttctggaaagcagtctcaattgcagcgccggagatatgttgctgctatggggacggctcacctggagaaagatgtgcaggaaactcctggacatgaccttctcatccaagacaaataccctagtcgtcaggcagcggtgtggtcgtcctggaggaggagtcttattacggtatggcagccaactcgccccggagacattttatcgggaatgcgacatgcagctttttgggccttggggggaaatagtgagcccatccctgtccccggcaacatctaacgccgggggatgccgactgtttattaatgtggccccccatgccagaatcgcgatacacgccctggccacgaacatgggcgccggtactgagggtgctaacgcttcatacattctcattcgcgacacccattccctccgtacgactgcctttcatggacagcaggtgctctattgggaaagcgagtcatctcaagcagagatggaatttagtgaagggtttcttaaagcccaggcaagcttaaggggccagtactggacgctgcagtcgtgggtgcccgaaatgcaagatccgcagagctggaagggcaaggaggggacttag

SEQ ID NO: 3550 - DNA, 1095 bp, Artificial Sequence
  Description of Artificial Sequence: Synthetic coding sequence
atggacatgtgccaggccctgagctgccacaccgaccccctggaccagtcctcttgtagtcggttgctggtgccattgctggacgggactgaatgcggagtggagaagtggtgtagcaagggacggtgccgaagtttggtggagctgacacccattgccgcagtgcatgggcgatggtcttcctggggccctcggtctccctgctcgagaagctgtggtgggggggtcgtgacccgtagaagacagtgcaataaccccagacccgccttcggcgggagagcatgtgtcggggcggatctgcaggccgaaatgtgtaacacccaggcttgtgagaagacacagctcgagtttatgagccagcagtgcgccaggacggacgggcagcctctgaggagcagccccggcggagcaagcttctaccactggggtgccgccgtgccccacagccaaggcgacgccctctgccggcacatgtgcagagcaattggcgaaagctttattatgaaacgcggggattcttttctggatgggactcggtgcatgccatccggccctcgggaagatggtacattgtccctgtgcgtctctgggtcttgccgtacatttggatgcgatgggagaatggatagtcagcaggtctgggatcgctgccaggtgtgcggtggcgacaattctacgtgtagcccccgcaaggggagttttaccgccgggcgggctcgcgagtatgttaccttcctgacagttacccccaacctgacttctgtgtacatcgcaaaccacagacccctcttcactcatttggctgtcaggatcggcgggcggtacgtggtagcagggaaaatgagcatttcacctaacacaacgtatcccagcttactcgaggatggccgtgtggaatatagggtcgcccttactgaggacaggctgccacggctagaagagatccggatctggggccctctccaggaggatgcagacattcaagtggggggggtcagggctcaacttatgcacatcagttggtggagtcggcccggacttggtgagcgtgacctctgcgcccgcgggcgatggcccggagggtcgagtgactag

SEQ ID NO: 3551 - DNA, 1095 bp, Artificial Sequence
  Description of Artificial Sequence: Synthetic coding sequence
atgccctaccagtaccccgccctgacccccgagcagaagaaggagctatccgatatagcacatcgtattgtggcacccggaaaaggcatccttgctgcggacgaatcaacggggtccattgcaaaacgattacagtctattggaaccgagaacactgaagaaaatcgtcggttctaccggcagctgctgctcacagcagacgatcgggttaacccctgtatcggcggagtgattcttttccacgagaccttatatcaaaaagccgatgacgggcgacccttcccccaggtaattaaaagcaagggcggagtggtggggatcaaggtggataaaggagtagttccactggccggaacaaacggcgagacaacaacgcaaggattagacggactgagcgaaaggtgcgctcagtataaaaaagacggcgccgactttgcaaagtggaggtgtgtgcttaaaatcggagaacacaccccttccgcgctggcaatcatggagaacgctaacgttctcgcacgttatgcctcgatctgtcagcagaatggaattgtgccaattgtggagcctgaaatcctccccgacggtgaccacgacctcaaacgatgtcagtatgtcacagagaaagttctggccgccgtgtataaagccctctctgatcaccacatctatctggaaggaacactgttgaaaccgaacatggtgactccaggccatgcctgcacacaaaagttctctcatgaggaaattgcaatggctacagtcactgctctccgccgcactgtaccccccgccgttaccggaattacctttctgtccggcgggcaaagtgaagaagaggccagcatcaatctgaatgccatcaataaatgtccattgctgaagccctgggccttgacctttagctatggcagagccctgcaggcttctgctttgaaggcatgggggggtaagaaagagaatctgaaggccgcgcaggaggagtatgttaagcgcgcactggccaatagtttggcctgccaaggcaagtacacaccctcaggccaggccggcgccgccgcaagcgagtcactcttcgtctctaatcatgcctattag

SEQ ID NO: 3552 - DNA, 1095 bp, Artificial Sequence
  Description of Artificial Sequence: Synthetic coding sequence
atgccctaccagtaccccgccctgacccccgagcagaagaaggagctctctgatatcgcacatcgaatcgtcgcacctgggaaggggatcctggctgcagatgagtctaccgggtctatcgctaaaaggctccaaagtatcggaaccgagaatacggaggagaaccgacgcttctatcggcagctcttgcttacagctgatgaccgcgttaatccatgtattggcggtgttattttgttccacgagaccctgtaccaaaaagcggatgatgggaggcccttccctcaggtgattaagagcaagggcggggtggtcgggattaaagtggacaaaggcgttgtccccctggccggcacgaacggagagacaactacacagggtctcgacggtctatctgagcgctgtgctcaatataaaaaggacggagccgactttgccaaatggcggtgtgttttgaagatcggagagcacacaccatcagcactggctattatggaaaatgctaatgtcttggcaaggtacgccagcatttgccagcagaacggcatagttcctatcgtggagcctgagattctgccggacggtgatcatgatctgaaaaggtgtcagtacgtgaccgagaaggtgctggctgctgtgtacaaagcactgtcagatcatcatatctatctggagggtaccctgctcaaaccaaacatggtcaccccagggcacgcctgcacccaaaaattttcacacgaagagatagctatggctaccgtgaccgctttaagacgcactgttcctcccgctgtgactggaatcactttcctgtccggcggacagtctgaagaagaggccagcatcaatctgaatgcaatcaacaagtgccctctactgaaaccatgggctctgactttctcttatggacgagctcttcaagccagcgccctcaaagcctgggggggcaaaaaagaaaacctgaaagctgcccaggaagagtacgtcaaaagggctctggcaaatagcctcgcatgccagggcaaatacacccctagtggacaggccggggcagcggcgagcgagtctttgtttgttagcaatcacgcttattag

SEQ ID NO: 3553 - DNA, 1257 bp, Artificial Sequence
  Description of Artificial Sequence: Synthetic coding sequence
atggcccggcggaagcccgagggcagcagcttcaacatgacccacttgagtatggcaatggcctttagctttcctccggtagcaagcgggcagctgcatccacaactggggaatacacagcatcagactgaattgggcaaggagctggcgacaacttccaccatgccataccagtatccagccctcacacccgaacagaagaaagaactttctgatatcgcccatcggatagtggcccctgggaaaggtattctggcggccgatgagtctaccggatccatagccaaacggttgcagtctatcgggaccgaaaacacggaggagaaccgcaggttttatcgacagctgctacttaccgctgatgatagggtgaatccgtgcattggcggagtaatattattccatgaaactctttatcagaaggcagacgatggccggcccttcccccaggtcatcaagtctaagggtggggtggtgggtatcaaggtggataagggagtggtaccactcgcaggcaccaacggcgaaactaccacccaggggctggacggattgtcagaacgctgcgcccaatataaaaaagacggtgcggactttgccaagtggagatgcgtcctaaagatcggcgaacacacaccttccgctctcgcaattatggagaatgccaatgttctcgcgcggtatgcctcgatctgtcaacagaatggcatagtacccattgtagagcctgaaatcctgccagacggagatcatgatctgaagcggtgtcaatacgtaactgagaaggtcctcgccgcggtctacaaagctctgtccgatcaccatatctacctggaaggtacgttgctgaagccaaatatggtgacaccaggccatgcatgcacccagaagttcagccatgaagagatcgccatggcgactgtcacagccttacgcagaactgttccacccgctgtcaccggaatcactttcctgtccggcggccaaagtgaagaggaggcgtccattaacctcaacgccatcaataaatgccctctgcttaagccctgggctttaaccttttcctacgggcgtgcactgcaagctagtgccctcaaggcttgggggggcaagaaggaaaatctcaaagcggcacaagaggagtacgtaaagagggcccttgccaatagcctggcatgccagggtaaatacacaccatctggtcaagccggagcggcagcatcagagagtctgttcgtatctaatcacgcctattag

SEQ ID NO: 3554 - DNA, 1095 bp, Artificial Sequence
  Description of Artificial Sequence: Synthetic coding sequence
atgccctaccagtaccccgccctgacccccgagcagaagaaggagcttagtgacattgcccaccgcatcgtcgctcccggcaaaggaattctggctgccgacgagagcacaggaagtatcgccaaacggctccagtctatcggaacggaaaacaccgaggagaaccggcgattctaccgtcagttactccttacagctgacgatcgcgtaaacccctgcattgggggggtcattctttttcatgagactctttaccagaaggcggacgatggaagaccatttccccaggtaatcaaatccaaggggggagtagtgggcattaaagttgataaaggcgtagttcccctggccggcactaacggagagaccaccacccaaggattagacggtctctcagaacgctgcgcgcaatataaaaaggacggggctgattttgctaaatggcgctgtgtgctgaaaattggagagcacaccccctcagcccttgccatcatggagaacgctaacgtactcgcgcgctacgccagcatatgccagcaaaacggcatagtgccaatcgtcgagccagagattctgccagacggggaccatgacctgaaaaggtgtcagtacgtcacagagaaagttctggccgcagtctacaaagccttaagtgatcaccacatttatctagagggcacattgctgaagcccaacatggtgactccgggccacgcctgtactcagaaatttagccacgaggaaatagccatggccacagtgacggcccttcgtcgaacagttccccctgcggtgaccgggatcacattcctgagcggaggtcagtcggaagaggaagcatccatcaacctgaacgccatcaataagtgtcctcttctgaagccttgggctcttaccttctcttatgggagggcattgcaagcaagcgctctcaaagcatggggcggcaagaaggagaatctgaaagccgcccaggaggaatacgtgaagcgcgctctggcaaattctcttgcgtgccaggggaagtatactccctcgggccaagccggtgccgctgcatctgagtctctgttcgtatccaaccatgcgtattag

SEQ ID NO: 3555 - DNA, 1095 bp, Artificial Sequence
  Description of Artificial Sequence: Synthetic coding sequence
atgccctaccagtaccccgccctgacccccgagcagaagaaggagcttagcgatattgcccatcgcatcgttgctcccggaaagggaattttagcagccgacgaatcaacaggaagcatcgcaaagagattacagtcgataggtactgaaaacaccgaagagaaccgtcggttttatagacagttgttgcttacggccgacgaccgcgtaaatccctgcatcggaggagtcatcctgttccacgagaccctttatcagaaggccgacgatgggcggcctttcccacaggtcatcaaaagcaaaggcggagttgttggaataaaagtagataagggggttgttccactggctgggacaaatggcgaaacaacaacccagggactagatggcctttctgagcggtgcgcccagtacaagaaagatggtgcagattttgccaaatggcgctgcgtgcttaagattggagaacatactccctctgcccttgctatcatggaaaacgccaacgtgttagctagatacgcctcaatttgccagcagaacgggatagttcccatcgttgagcctgagatactacctgatggggatcacgacctcaagagatgtcagtatgtgaccgagaaggtcctcgccgcagtctataaagccttatctgaccatcacatttaccttgagggcactttgctgaagcctaatatggtcactcccggacacgcctgcacccagaagttcagtcacgaagagattgccatggcaacagttacagctctacgccgcactgtgccacccgccgtgactggaatcacgtttctgagcggtgggcagtcagaggaggaagcctccattaatctcaacgcgattaacaagtgccccctccttaagccttgggcgctgaccttctcttatggcagagctttgcaggcaagcgctttgaaagcatggggaggcaaaaaagagaatctgaaggctgcacaggaggagtacgtgaagcgggctctggcaaactcccttgcttgtcaagggaagtatactccctctggtcaagctggcgctgccgcctcagagtcactgtttgtgagcaaccatgcctattag

SEQ ID NO: 3556 - DNA, 1257 bp, Artificial Sequence
  Description of Artificial Sequence: Synthetic coding sequence
atggcccggcggaagcccgagggcagcagcttcaacatgacccacctgagcatggcgatggccttcagtttcccacccgtggcttcgggacaactgcacccccagctggggaacacccaacaccagacagaattaggcaaggaactggccaccacatcaaccatgccttatcagtaccccgcactgaccccagaacagaaaaaggagctgagcgacatagcccatagaatcgtggcccccggaaagggaatcctcgcggctgacgaatccactggatccatcgccaagcgactacaatccattggaacggagaacactgaggaaaatcggcgattttaccgacagctacttcttactgctgacgatcgcgtaaacccttgcattggaggcgttatcctgtttcatgaaacgctttaccagaaggctgacgatggtcgcccatttccgcaggtgatcaaaagtaaggggggagtggtcgggataaaagtagacaaaggcgttgtgccgctggctggcaccaatggcgagaccactacccaaggcttggacgggctcagtgagagatgcgcacagtacaagaaggatggcgccgatttcgcaaaatggcgatgcgtgctaaagatcggagagcatacgccctccgctctggctattatggagaatgctaacgtcctggcgcgctatgcgtccatttgtcagcagaatggtatcgtgcccattgtcgaaccggaaatacttccggacggtgaccacgatctgaaacggtgccagtacgttacggaaaaggtgttagcggcagtgtataaagctctgtccgatcaccacatctacttggaaggtaccctgctgaaacccaacatggtgacacctggacacgcctgtactcaaaagttttctcacgaagagatcgctatggctactgtcacagcccttcgaaggaccgtacccccagctgttaccggaataactttcttatcaggcggtcagtctgaggaagaagcctccatcaatcttaatgctataaacaagtgtcccctgttgaagccttgggcgctcacctttagttatggacgggccctgcaagcctccgcgttgaaagcctggggaggaaaaaaggagaatctgaaggcagcacaagaagagtatgtgaaacgggcactcgccaatagcctggcctgtcaaggaaaatacacgccctcaggccaggctggcgccgctgccagcgagtccctgttcgtgtcgaatcacgcgtactag

SEQ ID NO: 3557 - DNA, 1095 bp, Artificial Sequence
  Description of Artificial Sequence: Synthetic coding sequence
atgccctaccagtaccccgccctgacccccgagcagaagaaggagctgagcgacatcgcacatagaattgtggctcctggtaaaggaattcttgccgccgacgagagtaccggatctattgccaagcgtctccaatccatcggaactgaaaacaccgaggagaaccgacgcttctatcggcaactgctcctcactgccgacgaccgggtgaatccctgcatagggggggtcattctttttcatgaaacactgtatcagaaggccgacgatgggcgcccattcccacaagttatcaaaagtaaaggtggtgttgtgggaattaaagttgacaagggagtcgtgccactcgcaggaaccaatggagaaacgactacccaaggccttgacgggctgtcagaaaggtgcgcccagtacaaaaaagatggcgccgatttcgccaagtggaggtgtgtgctgaagatcggggagcacacgccatcagcgctcgccattatggagaatgcgaatgtgctagctcgatacgcttctatctgccagcaaaatggcatcgtgcccatcgtcgaacctgagatcctgcccgacggggaccacgacttaaagaggtgtcagtatgtaacagaaaaagtcctcgccgccgtgtacaaagcactgtctgatcatcatatctatttggagggtacacttctcaagcctaacatggtcacacccggtcacgcttgcacgcagaagttttcccatgaagagattgccatggctaccgtgactgccctgaggagaactgtcccccccgccgtgactgggattactttcttgagcggaggccagtccgaggaagaagcctcaattaatctgaacgctataaacaagtgcccactcctgaagccctgggccctaacctttagctatggccgcgcattgcaggcctccgctctcaaggcctggggcggaaagaaggagaatctgaaagctgcgcaagaggaatatgttaagagggccctagcaaattctctggcatgccaagggaaatacacaccatcggggcaggctggcgcggcagcgtctgagagcctttttgtttcaaatcacgcttattag

SEQ ID NO: 3558 - DNA, 1344 bp, Artificial Sequence
  Description of Artificial Sequence: Synthetic coding sequence
atgagcgccagcaagatccccctgttcaagatgaaggacctgatcttgatcttgtgtctgctcgagatgtctttcgccgtacctttcttcccgcagcagtccggcacgcctggcatggcgagcttatctcttgagaccatgcggcagctggggtctctgcaacggctgaataccctttctcaatattcccgctatgggtttggaaagtcttttaactctttatggatgcacggccttctccctcctcacagttctctgccatggatgaggccaagagaacacgaaactcagcagtacgaatattccctccccgtgcatccaccacccctgccaagtcagccaagtctgaaaccgcagcaaccagggcttaagcccttcttacagtcagcagcggccacaaccaaccaggcaactgcgctgaaggaagccctgcagccgcccatacacctcggccatctgccgctgcaggaaggggaacttccacttgtgcagcaacaggtggcgcctagtgataagcctccaaagccggaattacctggggttgattttgccgaccctcaggggccgagtttaccgggaatggattttcctgatccccagggcccctcactacccggcttggatttcgcagaccctcagggatcgaccatcttccaaattgcgagactcattagccacggccccatgccccaaaacaagcagagtccactttatcctggtatgctctacgtgcctttcggggccaaccagttgaacgcccccgctagactcggcataatgagctctgaggaggtggcaggaggcagggaggacccgatggcctacggagccatgttccctggcttcggcgggatgcgcccgggattcgaaggtatgcctcataacccagctatggggggagacttcacgctggaattcgatagtcccgttgctgccactaagggccctgaaaacgaagagggtggcgcccaaggttcccccatgcctgaggcaaatccagacaacctggaaaatccggccttcctcacagagctggaaccggcaccacacgccggcctcctagcacttccaaaagatgatatcccagggctgcctcggtctccctctggcaaaatgaaagggctcccctccgtgactcctgcagccgccgacccgctgatgactcccgagctcgccgacgtgtaccggacatatgacgctgacatgactaccagcgtggattttcaggaagaggcaaccatggacacgaccatggcccctaacagtctgcagacctctatgcccggcaacaaggctcaggaacctgaaatgatgcatgacgcgtggcattttcaggagccctag

SEQ ID NO: 3559 - DNA, 1299 bp, Artificial Sequence
  Description of Artificial Sequence: Synthetic coding sequence
atgagcgccagcaagatccccctgttcaagatgaaggacctgatcctcatcctctgccttttagaaatgtccttcgcagtgccgttttttcctcagcagtcgggtacccccggcatggcttcactgtctctggaaacaatgaggcagctgggctccctccagagattgaataccctatcccagtattcgagatacggctttgggaagagctttaacagcctctggatgcatggactcctccccccgcattcatccctgccttggatgcgaccccgcgagcatgagacacagcagccgagcctgaaacctcaacagcccgggcttaaacctttcctccagtccgctgctgcaacgacgaaccaggccaccgccttgaaggaagctctgcagcctcccatccacctgggtcacctgccgctgcaggagggggagcttccattggtccaacagcaggttgcccccagtgacaaacctcctaagcccgaactccctggtgtcgactttgcggatccacaggggccttccctgcccggcatggacttccctgatccgcaaggccccagtctgccaggcctggatttcgcagatccccaaggctctaccatcttccagatcgcccgtctgatcagccacgggccaatgccacaaaacaaacaaagcccactatatcctggtatgttgtacgtcccctttggagctaaccagctgaacgcgcctgcccgactgggaataatgtcctccgaggaggtggccggcggccgcgaggaccccatggcatatggggccatgttcccagggttcgggggaatgcgtcccgggttcgaggggatgccccacaaccctgctatgggaggagatttcaccctcgagttcgactcaccagtggccgccaccaaaggtcctgagaatgaggaggggggtgcccaaggctccccgatgcccgaggcaaaccccgacaacctcgaaaatccagcctttctcacagagctcgaacctgctcctcatgcggggctattagctttacccaaggatgacattcctgggctgccaaggagtccttccggaaagatgaaagggctgccctccgtcaccccagccgctgccgacccactcatgactcccgagctggcagacgtgtacaggacttatgacgctgacatgaccacctccgttgacttccaggaagaggcaaccatggacaccacaatggctcctaattcactacagacctcgatgccaggcaataaggcgcaggagccggagatgatgcatgatgcttggcatttccaggagccttag

SEQ ID NO: 3560 - DNA, 1341 bp, Artificial Sequence
  Description of Artificial Sequence: Synthetic coding sequence
atgagcgccagcaagatccccctgttcaagatgaaggacctgatcctgatcctgtgcctactggagatgagtttcgcggtacccttttttccccagcagtcaggcacccctggcatggcctccttatcacttgagactatgcggcagctggggtcattgcaacgcctgaacaccctctctcaatacagccgttatggcttcggcaagtctttcaacagtctgtggatgcatggcttgttacccccacacagttccctgccctggatgagacctcgtgagcacgaaacccaacagtatgagtattctctgcctgtgcacccaccccccttgccgagtcaacctagtctgaagccgcagcagcccgggctcaagccattcctgcagagcgcggcagctactactaatcaagctactgcccttaaggaagccctgcagcctcctatccacctgggtcatctgcctctccaagaaggcgagctgcccctggtgcaacagcaagtggccccttcagacaagccaccaaagcctgaacttagagtagattttgccgatccacagggtcctagtttacctggcatggatttcccagacccacagggcccttctcttcccggtctagacttcgccgacccacagggctcgactatatttcagatcgcaagacttatcagccatggtcctatgccacagaacaagcagtcaccactgtatcccggcatgctctatgtaccgttcggggctaatcagcttaacgcgccagcccgcctcgggatcatgtccagcgaagaggttgccggaggtagagaggaccctatggcatacggagccatgtttcctggctttggtggtatgcgtcccggtttcgaaggcatgccacacaatcctgcaatgggaggcgattttacattggagtttgatagtcccgtcgccgccaccaaaggtcctgagaacgaggagggtggcgcacagggtagccccatgccggaggcaaatccagacaacctggaaaatcccgctttcctcactgaactcgagcctgcaccccatgcaggcctactggcactgcccaaagacgatattccaggactgccccggtccccgtccggcaaaatgaaaggacttccgtcagtgacacctgccgccgcagaccccctcatgaccccggagctagccgacgtgtacagaacttatgacgcggatatgacgacatctgtggatttccaagaggaggcaactatggacaccacaatggctccaaactccctgcagacatccatgccaggtaataaggcacaggagcccgaaatgatgcacgatgcgtggcactttcaagaaccctag

SEQ ID NO: 3561 - DNA, 528 bp, Artificial Sequence
  Description of Artificial Sequence: Synthetic coding sequence
atgggcacctggatcctgttcgcctgcctgctgggcgccgccttcgcgatgcccgtgctcactcccctgaaatggtatcagtccatccgcccaccctacccgagctacggctacgaacccatgggtgggtggctgcaccaccagatcattccagtcttgtctcaacagcatccacccactcatacattgcagcctcaccatcatatcccggtggtccccgctcaacaacctgtaattccccagcagcctatgatgcctgttccgggtcagcattccatgacgccgattcagcaccaccagcctaaccttccgcctcccgcccaacaaccctaccagccgcaacccgtccaaccgcagcctcaccagccaatgcagccgcaacctcctgtgcatccaatgcagcctttacctccccaaccccctctgccccctatgttcccaatgcagccactgccccctatgttgccggatcttacactggaggcctggccctccactgataagaccaaaagggaggaagtcgactag

SEQ ID NO: 3562 - DNA, 618 bp, Artificial Sequence
  Description of Artificial Sequence: Synthetic coding sequence
atgggcacctggatcctgttcgcctgcctgctgggcgccgccttcgcaatgcctctgccgccacacccaggtcatccagggtacatcaattttagctatgagaattcacactcacaggccattaacgtggacaggaccgcactggtactcacccctctgaagtggtatcagagtatccgcccaccttatcctagttatggttatgagccgatgggagggtggctacaccatcagatcatacctgtactgtcccagcagcaccccccaacccacaccctccaaccacaccaccacatccctgttgtgcccgcccagcaacccgtgattccccagcagcctatgatgcctgtgccaggccagcacagcatgaccccgatacagcatcaccagcccaatttacctccacccgcacagcagccctatcagccccagcccgtgcaaccgcagcctcatcagccaatgcagcctcaaccgccagttcaccccatgcaacctctgcctccacagccacctcttccacccatgttccccatgcagcctcttcctcccatgctgccagatctgacacttgaagcatggccttccactgataaaactaagcgggaggaggtggattag

SEQ ID NO: 3563 - DNA, 576 bp, Artificial Sequence
  Description of Artificial Sequence: Synthetic coding sequence
atgggcacctggatcctgttcgcctgcctgctgggcgccgccttcgccatgccactgcctcctcatccgggccatcccggctacattaacttttcttacgaggtgctgaccccattgaaatggtatcagtctatacgccccccgtacccatcatatggctatgaacccatgggcggatggctccatcaccagattattcctgtgctgtcacaacagcatcctcctacgcacacgctccagccacatcatcatatcccggtcgtgcccgcccagcagcctgtgattccccagcagcctatgatgccagtgccgggtcagcatagcatgacgccaatccagcatcatcagcccaatttacctcctcctgcccaacagccttaccaaccgcagcccgtacagccacagccgcaccagcccatgcaaccccagccccccgtccaccctatgcagcctctcccgccacagccaccgctcccacctatgtttcccatgcagccgttacctcccatgctgcccgacctcactctggaggcatggcccagcacagacaagacaaagagagaagaagtcgactag

SEQ ID NO: 3564 - DNA, 4023 bp, Artificial Sequence
  Description of Artificial Sequence: Synthetic coding sequence
atgttccgggtgggcttcctgatcatcagcagcagcagcagcctgtcacccctgctgctggtttcagtcgtgagggttaacacaacgaattgtcacaagtgtttgctcagcggtacttacattttcgccgttctgcttgtgtgcgtggtttttcacagcggagcgcaagaaaagaattacacaattagagaggagatacccgaaaacgtgctgataggtaatctcctgaaagacctgaacctatccttgatccctaacaagagcctgaccacaacaatgcagtttaaactggtttataaaaccggggacgtacccttgatcaggatcgaggaagacactggcgagatcttcacgacaggagccagaatcgatcgggaaaaactgtgtgccggtatcccgcgtgacgaacactgtttctacgaagtcgaagtggctatcctaccagacgagatttttagattagtcaaaatccgcttccttatcgaggacattaacgataatgcacccttgttcccagctactgtgataaacattagcatccctgagaattccgccatcaattctaaatacaccctgcccgcagcagtcgaccccgacgttggcattaacggcgtccaaaactacgaactgattaaatcccagaatatctttggtttagatgtcatcgagaccccagaaggggacaagatgccccagctgatcgtgcagaaggaactcgaccgggaagaaaaggacacttacgtaatgaaggtgaaggtggaagacggaggttttccacagcgtagcagcacagccatcttgcaagtctctgtgaccgacaccaacgacaaccatcccgtgttcaaggagaccgaaatcgaagtgagtatcccagaaaacgctccagtcggtactagtgtcactcagcttcatgccaccgatgctgacataggggagaatgccaagatccacttttcatttagtaacctggtttcaaacatcgcaaggaggttatttcacctcaatgcaacaaccggccttattaccataaaggagcctttggaccgggaggaaacaccgaatcataagctcttggtgctcgcctccgacggaggccttatgcctgctcgggcaatggtgttagtgaacgtgactgatgtgaacgacaacgtgccatcaatagatatcaggtacattgtaaaccccgtcaacgatactgtcgtgctatcagaaaatatacctctcaataccaagatcgctctgattaccgtgaccgacaaggatgctgaccataacggacgcgtgacttgctttactgaccacgagataccatttcggctgcgaccagtcttcagcaaccaattcctgctggagaatgctgcgtatcttgactatgagtctaccaaagaatatgctattaaattgttagccgcggacgccggaaagccccccctcaatcagtcagcaatgctgttcattaaggtcaaagacgaaaacgataatgcccctgtgtttactcaatcctttgtaacggtcagtattcctgagaataatagtccaggtatccaactgatgaaggtgtctgcgactgatgcagattcgggccctaacgcagagataaactacctgcttggccctgacgcgccgcccgagttctctctagacaggagaaccgggatgcttactgtcgtgaagaagctggacagagaaaaggaggataaatacctgtttaccattttggctaaagacaacggcgtccctcccctgacctctaacgtcacagtattcgtgagtattatagatcagaatgacaatagtcccgtgttcacccacaacgaatataagttttatgtcccggagaacctgccgcgacatgggacggtgggtctgataaccgttacagatcccgactacggggacaatagcgccgtgactctttctattttagatgaaaacgatgacttcacaatcgacagccagacaggcgttattaggcccaatatcagtttcgaccgggagaaacaggagtcatacaccttctacgttaaggccgaggacggtggtagggtatcacggtcttccagcgccaaagtcaccattaacgtggtggacgtgaatgacaacaaacctgtcttcatcgttccaccatataattacagctacgaactcgtgctaccttccacaaatcctggaaccgtggtgttccaagttattgccgtggataatgacacaggaatgaacgcagaggttcggtactcaattgtgggcggaaatacccgggatctgtttgctatcgaccaggagactgggaacataaccctcatggagaaatgtgatgtgactgacctcgggctgcatagagttctggtcaaagccaacgatttaggacagcctgactcactctttagtgtggtaattgtcaatctcttcgtgaacgagtctgtaacaaacgccacattgattaacgaactggtgaggaagagtattgaagctcccgttacaccaaatacagagattgccgatgtttcatcaccaacatccgattacgtgaagatcctggtcgctgccgttgccgggaccattaccgtcgtcgtggtgatctttattaccgctgtggtgcgttgcaggcaggctcctcaccttaaggccgcccaaaagaacatgcagaactcagaatgggctaccccaaatccagagaacagacaaatgataatgatgaagaaaaaaaagaaaaaaaagaagcattcaccaaagaatctgctgttgaatgtcgtaacaatcgaagagaccaaagctgatgacgtggactcagacggcaatagagtaactctggacctgcctatcgatctcgaagaacagacaatggggaagtacaattgggttaccacccctaccacttttaagcctgactctccagatctggcgcggcactacaaatccgcgtcacctcagccagcgtttcagatccagcctgaaacccccctgaatctgaaacatcacataattcaggagcttcccttggacaatactttcgtggcctgtgatagtatttcaaactgcagttcatcatctagtgacccttactccgtgagcgattgcggctaccctgtgactacgtttgaggtgcctgtctctgttcacacccggcccagtcaaagacgcgtcacgttccaccttccggaaggcagccaagagagtagctccgatgggggcttgggcgatcacgatgccggtagtctgaccagcactagtcatggactgcccctcgggtacccccaggaggagtattttgatagggccacaccaagtaacagaacagagggagacgggaactctgacccagaaagcaactttatttccggcatgagggagaagattactgtccagccaaccgtggaagaggcatcagataactgtactcaggagtgtctaatatatggccacagcgacgcttgttggatgccggccagtctggaccactcgtcttcctcacaggcacaggcatctgccttatgccattctcccccactgtcgcaggctagcacacaacatcacagccctccagtgacacagacgatcgtcctttgccattcccctcctgtcacacagaccatcgccctttgtcactctccgcctccaatccaggtcagcgccctgcatcactcccctccgctggtgcaagggacagccttgcatcattctccaccatcagcccaagctagtgccctgtgttacagtcctccgttggctcaggccgctgcgatttcccacagctcctcattgccacaggtcatcgccctccacagatcgcaagctcagtccagtgtttcactacagcaggggtgggtgcagggcgctaacggactgtgttctgtcgaccaaggagttcaaggtagtgcaacttcacagttttacacaatgagtgagcggctgcaccccagtgacgatagcatcaaggtgatcccccttacaacattcgcacctaggcagcaggcccgaccttcacgcggagacagtccaattatggaaacccatccactctag

SEQ ID NO: 3565 - DNA, 621 bp, Artificial Sequence
  Description of Artificial Sequence: Synthetic coding sequence
atgggcacctggatcctgttcgcctgcctggtgggcgccgccttcgccatgcccctgccaccccaccccggtcaccctggatacatcaacttcagttatgagaattcccattcccaagccattaacgtagatagaatcgctctggtgctaacccctctgaaatggtatcagagcatgattcgccctccctactcttcatatggctatgaacctatgggcggttggctacatcaccagatcatcccagttgtgagtcaacaacaccctttgacgcataccctgcagagccaccatcacattccggtcgtgccagcgcagcagccccgggtgcgtcaacaggccctaatgccggtcccaggtcagcaaagcatgacccccacccaacatcatcagcctaatctaccattgccggcacagcagcctttccagccgcaaccggtccagccccaaccccatcagcctatgcagccacagccaccggttcaacccatgcaaccgcttcttccccagccccctctcccgcccatgttccccctccgtccactgccacctatcctccccgacttgcaccttgaggcctggcctgccacggacaaaacaaaacaggaggaagtggattag

SEQ ID NO: 3566 - DNA, 618 bp, Artificial Sequence
  Description of Artificial Sequence: Synthetic coding sequence
atgggcacctggatcctgttcgcctgcctggtgggcgccgccttcgctatgcccctgccaccacacccgggacacccgggttacatcaatttttcttacgagaattcccacagtcaggccatcaacgtcgatagaatcgccctagttctcactcctctgaagtggtaccagtctatgattaggcctccttactcatcctacgggtatgagcccatgggtggctggctgcaccatcaaattattccagttgtgtcacagcagcaccccttaacccataccctgcaatcccatcaccatatccctgtggtgcccgcacagcagcccagagttaggcagcaggccctgatgcctgtgccaggccagcagtctatgactccgactcaacatcaccagccaaacttaccactgcccgcccagcagccctttcagcctcagcctgtgcagccccagccgcatcagcccatgcaaccccaaccccctgtccagcccatgcagcctctgttaccacagccccctctaccgccaatgttcccgctgaggccgcttcctcctatattgcctgatctccatctggaggcctggccagccaccgataagacaaagcaggaagaggtctag

SEQ ID NO: 3567 - DNA, 4599 bp, Artificial Sequence
  Description of Artificial Sequence: Synthetic coding sequence
atgggccacagcaagcagatccggatcctgctgctgaacgagatggaaaagctggaaaagaccctcttcaggctggagcagggctacgaactgcagtttagactcgggccgaccctgcaggggaaagcagtcacagtgtacaccaattatccatttcccggtgaaacttttaaccgtgaaaagttccgttcgctggactgggagaatccgactgaacgggaagatgacagcgacaagtactgcaagctaaacctacaacagtctgggtcctttcagtattactttctccaggggaatgagaaatctggcgggggatatattgtggtggatccaatcttgcgggtgggagccgacaatcacgtgctgccccttgattgtgtgactctccaaactttcttggccaaatgcctggggcctttcgacgagtgggagtccaggctccgagtcgctaaagagagcggctataacatgatccacttcacaccactgcagactctgggtttgagtcgatcatgttacagtctggcgaaccaactggaactaaacccagacttcagtcgccccaatagaaagtatacttggaacgatgtaggccagctggtcgagaaactgaaaaaggagtggaatgtgatttgcataacagacgtcgtgtataaccatacggccgcaaatagtaagtggatccaggagcaccctgagtgtgcatacaaccttgtcaattccccacatctgaagcccgcatgggtgctggatcgtgccctctggagatttagttgtgatgtagcggaaggaaagtacaaagaaaaggggattcccgcactgatcgagaatgatcaccacatgaactcgattagaaaaattatctgggaggatatctttccgaagctgaaactgtgggaatttttccaggtcgacgtgaataaagcggtagagcagtttagaagactgctgacgcaggagaaccggagagtcaccaaatccgatcctaatcaacacctcaccattatccaggatcccgagtatcgccgattcgggtgtacagtggacatgaatatcgccctgaccacctttataccccatgataagggccccgccgccattgaagagtgttgtaactggtttcataaaaggatggaggagctgaatagcgagaagcatcgactaattaattatcaccaagaacaggcagtgaactgcttgctcggtaacgtgttctacgaaagactggccggccacgggcctaagctcggacctgttaccagaaaacatcccctggtcactaggtatttcaccttcccttttgaagagatcgattttagtatggaagagtccatgatccacttgcccaacaaggcatgctttcttatggctcacaatgggtgggtgatgggcgatgacccgctgcggaatttcgccgagccaggcagcgaggtatacctgcggcgggagcttatctgctggggagactcagttaaactgcgctacggcaacaagcccgaggattgtccctatctgtgggctcacatgaagaaatataccgaaataactgccacctatttccagggcgttcgcttggataattgtcactctacccccctgcacgtggccgagtatatgcttgatgcggcccgcaacctgcagccgaatctgtacgtcgtagccgaactttttacaggaagcgaagacttggacaatgttttcgtcactagactgggtatatcaagtctgatccgagaagctatgagcgcctacaacagccatgaggagggtcgactcgtttatcggtacggcggggaacccgtgggatcatttgtccagccatgtcttaggccgctgatgcctgcgatagcccatgccctgttcatggatattacccatgacaatgagtgcccaatcgtacacagaagcgcgtatgatgcgttaccgagcaccaccatcgtgagtatggcctgttgtgcgagcggtagtacccgtgggtacgatgaattagtgccgcatcagatttcggtggtgtcagaagaaaggttctatactaagtggaaccccgaggccctgccctctaacaccggagaggtgaacttccagagtgggataatcgcagccaggtgcgctattagcaaactccaccaggaactgggagccaaaggcttcattcaggtgtatgtggaccaggtggacgaggatatcgtcgctgtcacacgacatagcccctctatccatcagtccgtagtggctgttagccgcacggcctttaggaatcctaagacatcgttctacagcaaagaagtgcctcagatgtgcatcccagggaagatcgaagaggtggtcctggaggcacgtaccatcgagcgtaacactaaaccctacaggaaggatgagaactccatcaacggcacccctgatatcaccgttgaaatccgagaacacatccaactgaatgagagtaaaattgtcaagcaagcgggggtcgcgaccaaggggccaaatgagtatattcaggagattgagttcgaaaatctgagccccggctcagtgatcatcttccgcgtgtctctggatcctcacgcacaagtggccgtcggaatcctaaggaaccacctgactcaattcagtccacattttaaaagcggtagcttggcggtggataacgccgacccaatcctgaagattcctttcgccagtctggctagcagactcaccttggccgagttgaatcagattctttaccgctgtgaatccgaagaaaaggaggacggtggcggctgctacgatatccccaactggagtgcgctcaaatacgcagggctccagggcctcatgtcagtattggccgagatcaggcctaagaatgatctggggcaccccttctgcaataacttgcggtcaggcgactggatgattgactatgtgtctaacagacttatctctagaagcggcacaatagctgaggtggggaaatggctgcaggccatgtttttctatctgaaacaaatcccccgctaccttattccatgctattttgacgctatccttatcggagcgtacaccaccctgctcgacacagcttggaagcagatgagctcgtttgtccagaatggctcaactttcgtaaagcatctcagcctcggatccgtccagttgtgtggtgtggggaaattcccttcgctgccaatcctgagccctgctctgatggatgtaccgtaccgactaaatgaaattactaaggaaaaagaacagtgttgtgtcagccttgccgcaggcctgcctcacttctcatccggtattttcagatgctgggggagggacactttcatcgctctgcgaggcatcctcctgataacaggaaggtacgtggaggctaggaatatcattctggccttcgccgggactctacgtcatggcctgatcccaaatctgttgggggagggcatttatgcaagatacaactgccgagacgcggtgtggtggtggttgcagtgcatacaggattactgtaaaatggtgcccaatggtctcgatatacttaagtgtccggtgagcagaatgtatcccactgacgatagtgcgcctctgcctgccggaactcttgatcagcctcttttcgaggtgatccaggaagcaatgcagaaacacatgcagggcattcaattcagggaacgaaatgccgggccacagatcgatcgtaatatgaaagacgagggctttaacattaccgcaggtgtggacgaggagacaggatttgtttacggaggcaacagatttaactgcgggacgtggatggacaagatgggcgaaagcgatagagcccgcaaccgtgggatccccgcaaccccaagggatggatcggcggtggaaatagtcggccttagtaaatcggccgttcgatggttacttgagttatctaaaaagaacatcttcccatatcatgaagtgaccgtgaaacgacatggaaaagcaatcaaggtttcttacgacgaatggaaccgaaagatccaggataacttcgaaaaactgttccacgtgagcgaggatccctccgatctgaatgaaaagcatcccaatttagtacataaacggggaatctataaagacagttacggtgcctcgtctccttggtgtgattaccagctgcgacccaattttacgattgcgatggtggtggctcctgagttgttcacgacagagaaagcttggaaggctttagagatcgcagagaaaaaactgctggggcccttagggatgaagactctggaccccgatgatatggtgtattgcgggatttatgacaacgcgctcgacaacgacaactataacttggccaagggcttcaactaccaccaagggccagaatggctctggcccataggctactttctgcgcgccaagctgtatttcagccgtctgatgggccccgaaaccacagctaagactatcgttcttgtgaagaacgtgctgtctcggcactatgtccatcttgaacgctcaccatggaagggtttgccggaactgacaaacgagaacgcacagtactgccctttttcttgcgaaactcaggcctggagcattgctactattctagagactctctacgacttgtag

SEQ ID NO: 3568 - DNA, 4551 bp, Artificial Sequence
  Description of Artificial Sequence: Synthetic coding sequence
atggcccccatcctgagcatcaacctgttcatcggctacgagctgcagttccgtctcgggcctaccctacaaggtaaagccgtgactgtttacacaaactaccccttccctggcgaaacatttaacagggaaaagttccgctcacttgattgggagaatccgacagaaagagaggatgattccgataaatactgtaagctgaatctacagcagtctggatccttccaatactactttcttcagggcaatgagaaaagcggaggcggctacatcgtggtggaccccattctgagggtgggcgccgataaccatgtgctcccccttgattgcgtcacactgcagacctttctggcaaaatgtctgggaccttttgacgaatgggaatctcggctgcgcgtcgctaaagaatctggatataatatgattcatttcacgcctctacaaacgctcggactctctaggagttgttacagcctagcaaaccagctggagctgaaccccgattttagccgccccaaccgcaagtacacttggaatgacgttggccagctggttgagaagttaaaaaaagaatggaacgtgatctgcatcacggacgtggtctataatcatactgccgccaacagcaaatggatacaggagcatccagagtgcgcctacaatttggtaaattcacctcatttgaagcctgcttgggtgctggaccgggccttatggcgatttagctgtgacgtagctgagggaaagtacaaggaaaaaggcattccagcccttatagagaatgaccaccatatgaactcaatcagaaagatcatctgggaggatattttccctaagctgaagctgtgggaattctttcaggtggatgtgaacaaggccgtcgaacaattccgccgtcttttgacacaggaaaaccggcgagtcactaagtcagacccaaatcagcatctcacaattattcaggaccctgaatatagacgctttggctgcacggtggatatgaacatcgccctgactacgttcatcccacatgataaaggacccgctgccattgaagaatgttgtaattggtttcataaaaggatggaggaattaaattctgaaaaacatcgtctgataaattaccatcaggaacaggccgtgaactgtctcttagggaacgtattctatgagcgcctcgccggacatgggcctaaacttggtcccgtaacccggaagcatcctctcgtgactaggtatttcacattcccctttgaggaaatcgatttctcaatggaggagagtatgatacatcttccaaataaggcatgctttctgatggcccacaatgggtgggtcatgggagacgacccactacggaacttcgcagaacccggcagcgaagtctatctgaggcgggagctcatttgctggggagactctgtcaagctgagatacggcaacaagccagaagattgcccttacctttgggcacacatgaagaagtatactgagatcacagctacttatttccagggcgtgcgccttgataactgccacagcactcccctccatgttgctgaatatatgctggacgctgctcggaacctgcagcccaacctctacgtagtggcagagttattcacgggctctgaggatttagataatgtttttgtcacacgcctgggtatctccagcctcattcgagaagcaatgtcagcttacaactcacatgaggaaggccgcctggtgtatcgctatggaggggaacccgtaggctcttttgtccagccatgcctgaggcccctgatgcctgcgattgcccatgcactattcatggatataacccacgacaacgagtgccctatcgttcatcgatctgcctacgacgccctaccttccacaaccatcgtaagtatggcttgttgtgcttcgggatcaacacgtggatacgacgagctggtaccccatcagatttctgtggtcagcgaggagaggttttacaccaagtggaacccggaggccttgccaagcaatactggagaggtgaactttcagagtgggataatcgctgctcggtgcgcgatttccaagctgcaccaggagctgggggcaaaggggttcatacaggtgtatgtagaccaggtcgacgaggatattgtggccgttacgcggcactccccaagcatccatcagagtgtcgtggcagtgagcagaaccgcgtttcgtaacccaaaaaccagcttttactcaaaagaagtgccccaaatgtgcattcctggcaaaatcgaggaagttgtgctcgaagcacggaccatcgaacggaatactaagccttatcggaaggacgaaaactccatcaacggcacaccggacataacagtcgagatccgagaacacattcagctgaacgagtcaaagatcgtgaagcaggccggcgtcgccaccaagggccccaacgagtacatccaggagatcgaattcgaaaatttatcccccggcagcgtaattatattcagagtctcccttgatccacacgcccaggtggctgtggggatactgcgcaaccatctaacccaatttagtcctcattttaaatccggtagtttagctgttgacaacgccgatcccatactcaaaatcccctttgcctccctggcatccagactgactctggctgaactgaatcagatcctctatcggtgcgaatcagaagaaaaagaggatggtggtggttgttacgatatccccaattggtctgccttgaaatatgctggtctacagggtctaatgtctgtcctggccgaaatccgaccaaagaatgacctggggcaccctttttgcaataacctgcggtccggcgactggatgatagattacgtctctaaccggctgatcagtcggtctggtacgattgcggaagtcggcaaatggttgcaggcaatgttcttctaccttaaacagattcctcggtacctcattccgtgctatttcgacgccatcctcataggtgcctacaccactttactggacaccgcatggaagcagatgtcttcttttgtgcagaacggctccacctttgtgaaacacctgtcattagggtccgtgcaactgtgtggagtggggaagttcccatctctccccatactgagcccggccctcatggacgtaccgtatcgtttgaatgagatcacgaaagaaaaggaacagtgctgcgttagtctggccgcaggcttacctcactttagctccggaatcttccggtgttggggtagggatacatttatcgctctccggggcatactgctcattactggtcgctatgtggaggccagaaacattattctagcatttgcgggaaccctgcgccatggactcatcccgaacctattaggtgagggaatctacgcccgctataattgccgagatgctgtgtggtggtggctgcaatgcatccaggattattgtaagatggtgcctaacggtctagacattcttaagtgcccggttagccgaatgtatcccacggatgacagtgcccccctgcctgctggaaccttagaccaaccactattcgaagttatccaggaagcgatgcaaaagcacatgcagggaatacagttccgggagagaaacgcgggccctcagatcgatcgcaatatgaaggatgaggggtttaatattacggctggggtcgatgaggaaactgggttcgtgtatggaggcaataggttcaactgtggaacatggatggacaagatgggtgagtctgatagggcccggaatcgaggcattcccgctacccctagagacggatcggccgtggagattgtcggcctgtctaagtccgccgtccgctggctccttgaattgtctaagaagaatatcttcccctaccacgaggtgaccgttaaacgtcacggaaaggccatcaaggtttcctacgacgagtggaatcgtaaaatccaggacaacttcgagaagctgttccatgtgagtgaagatccaagcgatttgaacgagaagcatccaaacctggttcacaagcgcggcatatataaggactcatacggagcttctagcccatggtgtgactatcagctgcggccaaactttactattgctatggtagtggcacccgaactgtttacaaccgaaaaagcatggaaggcccttgagatagcagagaagaaacttttggggccattgggtatgaagactctggacccagacgacatggtgtactgcggaatttacgacaatgccctcgataacgataattataatttggccaaggggttcaactaccaccaaggaccggagtggctgtggccaatcggctacttcctgagagcgaaactgtatttctcgcggctcatgggaccggagacaaccgcaaaaactatcgttctcgtcaagaatgttctgagtcgccactacgtccacctggagcgcagtccctggaagggattgccagagctgaccaatgagaacgcccaatactgccctttttcttgtgaaacccaggcttggagcattgctaccatcctggaaactctctacgacctgtag

SEQ ID NO: 3569 - DNA, 4548 bp, Artificial Sequence
  Description of Artificial Sequence: Synthetic coding sequence
atgagcctgctgacctgcgccttctacctgggctacgagctgcagtttcgcctgggtccaacgttgcagggcaaggccgtcactgtatacacgaattacccatttcctggagaaactttcaaccgggagaagtttcgtagtctggattgggaaaaccccacagaaagggaagatgattctgacaagtattgcaagctgaaccttcaacagagcggaagtttccagtattactttcttcaagggaacgagaagtcaggtggaggttatattgtggtggatcccatattgcgggtgggggcggacaaccatgtgttgcccctggactgcgtaactcttcagacatttcttgctaagtgcctaggcccatttgatgaatgggagtccaggcttagggtcgctaaggagtctggctacaatatgattcactttaccccactccaaaccctggggctttcccgcagttgttatagcctggccaaccaattggagcttaacccagatttctctcggcctaatcgcaagtacacatggaacgacgtgggccagttagtggagaaactcaaaaaagagtggaacgtaatatgtatcaccgatgttgtgtataaccacaccgcagcaaattcaaagtggatccaggaacaccctgaatgtgcttataatttggtgaactcaccccacctgaagccagcctgggttctggacagggcactgtggaggttcagttgcgacgtggctgagggtaagtataaagagaagggcatcccagcgctgatcgaaaacgaccaccacatgaactcaatccggaaaatcatctgggaggatatctttcctaaattaaagctgtgggaatttttccaggtggatgtgaacaaagccgtggagcagtttagacggctgctaacgcaagaaaatcgcagagtgactaagtctgaccctaaccagcatctgaccatcatacaagatcccgagtacagacgtttcggatgtactgttgacatgaatatcgccctgacaacgttcatcccccacgataagggtccagccgccatagaggaatgctgcaactggtttcacaaaagaatggaagagttaaactcagaaaaacataggcttattaactatcaccaggagcaagccgtcaactgcctcctgggcaatgtgttctacgaaagactcgccggccacggccctaaacttggaccagttacacgcaaacaccccctagtgacacggtacttcacttttccattcgaagagatcgacttcagcatggaggagtccatgatccaccttccgaataaagcgtgcttcctgatggcccataacgggtgggtcatgggtgatgatcctctgcggaattttgctgagcctggatctgaggtctacctgcggcgagagctgatctgttggggggattcggtgaagcttagatatggcaataagcccgaagactgcccatacctctgggcccatatgaaaaagtataccgagatcacagctacctacttccagggtgtcagattagataattgtcactcgacccctctgcacgtggcggaatacatgcttgacgctgctagaaaccttcaaccaaacctgtatgtcgtggcggagctctttaccggaagtgaggatctcgacaacgtttttgtgacgcgactgggtatcagctctctgatccgggaggcaatgtcagcatataactctcatgaggaggggaggcttgtgtaccggtatggaggcgagcccgtaggttcttttgtgcagccttgcctgagaccgctcatgccagccatagcacatgccctgtttatggacatcacgcatgacaacgagtgcccgattgtacatcggtccgcatatgacgcccttccaagcaccacgattgtgtctatggcctgctgcgcttcagggagcacacgtgggtacgatgagctggtgccccaccagatttccgtggtaagcgaggaaagattctacactaaatggaaccccgaggctttacccagtaacacaggagaggtcaattttcagtcaggcatcattgccgcacggtgcgccatcagtaaactgcaccaggagctaggggcgaaaggtttcattcaggtatacgtcgatcaggtggacgaggacattgtcgccgtgacaaggcactctcccagcattcaccagtcggtggtggctgtttcccgaaccgccttcaggaatcccaaaaccagtttttacagcaaggaggtgccacagatgtgtatccccggaaagatagaggaggttgtcctggaggcaaggaccattgaacggaacactaaaccctaccgcaaggatgaaaactccatcaatgggacacctgacattactgtggagatccgcgaacacatccagctgaacgaaagcaaaatagtcaaacaagcgggcgtggccactaaggggcctaacgaatacatccaggagatagagttcgaaaatctgagcccaggcagcgtgatcatttttcgggtctcgttggacccccatgctcaagttgcagtaggcatcttaaggaatcacttaactcagttctctccccacttcaagtcaggctcactcgccgttgacaacgctgatcctatactgaagatcccctttgcgagtctggccagtagattgacactggcagaactgaatcagattctgtaccgctgcgagtccgaggagaaagaggatgggggtggctgttatgacatcccgaattggagcgctctcaagtatgcgggtctccaaggcctgatgagcgtgttggccgagattagacccaaaaatgacctcggacacccattctgcaacaatctccggtcaggcgattggatgatcgactatgtcagtaaccggctcatatccagatctggtaccatagctgaggtggggaagtggctccaggctatgtttttttatttgaagcagatccctagatatttgattccctgctattttgatgcaatcctcatcggggcctatacaaccctgctagacaccgcttggaaacagatgagctcattcgtacagaatggctctacctttgtgaagcatctcagcttggggtccgtgcaactgtgtggtgtgggcaagtttccttcactgcctatattatcccctgctctgatggacgtgccctaccggctgaatgagatcacgaaggaaaaggaacagtgttgtgtatcactggcagctggactgccacacttctcaagtggcattttccggtgctggggccgggatacattcattgctttgcgagggattcttcttatcaccgggcgctacgttgaagcaagaaatattatactggctttcgctggcaccctacgtcacgggctgatcccgaatctcctgggcgaggggatttatgccaggtacaactgtcgggacgccgtatggtggtggcttcagtgcatccaggattactgtaaaatggtacccaacggcctggatattctaaagtgcccggtctctcgcatgtacccaaccgatgattctgctcccttaccagccgggacactcgatcagcccttgtttgaggtgatccaggaagcaatgcaaaaacacatgcaggggatacagtttcgagaaagaaacgcaggaccacaaattgaccggaacatgaaggatgagggctttaacattactgctggggtcgatgaagagacgggcttcgtgtatggggggaaccgcttcaactgcggaacttggatggataagatgggggagtccgatcgtgcacgcaacaggggcattccagctacaccgcgcgatgggtcagcggtcgaaattgtggggctgagtaagtcagccgttaggtggctccttgaactgagcaagaagaatatcttcccttaccacgaggtgaccgtaaagcgccatgggaaggctatcaaagtaagctacgatgaatggaacaggaagatacaggacaactttgagaagctgttccacgtgtccgaggacccatctgatctaaatgaaaaacaccctaatctggttcataagcgcggaatttacaaggattcctatggagcctcctcaccttggtgcgactaccaactgcgcccaaatttcacaatcgcaatggtggtggcacccgaactgttcaccacggagaaagcctggaaagcgctcgagatagcagagaaaaagctgttaggacccctcggtatgaagacactggatcccgatgatatggtgtactgcggcatttatgataatgcgctggataatgataactacaacctggcaaaaggtttcaactatcaccaggggccagaatggctgtggcctataggctatttcctccgagccaaactctacttttctcgactgatgggacccgaaactacagctaagactattgtcctggtgaaaaacgtgctatctcggcactatgttcatctggaacgtagcccctggaaaggactacctgagcttacgaacgagaatgcccagtattgccccttcagctgtgaaacacaggcatggtccatcgcaactatacttgagaccctttatgacttatag

SEQ ID NO: 3570 - DNA, 4599 bp, Artificial Sequence
  Description of Artificial Sequence: Synthetic coding sequence
atgggccacagcaagcagatccggatcctgctgctgaacgagatggaaaaactcgaaaagaccctgttccggctggagcagggctatgagttgcagttccgacttggacccacattgcagggaaaagcagttactgtctacaccaactaccccttccccggggagacctttaacagagagaagtttcgctccctcgactgggaaaatccaactgagagggaggatgattccgataaatattgcaaactgaatttgcagcagtctggctcctttcagtactacttcctgcaggggaacgagaagtccgggggtggttacatcgtcgtcgatccaattctgagagtgggggccgataaccacgtcttaccactggactgtgtaaccctgcagaccttcctggctaaatgtctgggcccgttcgacgagtgggaatcccgcctgcgggtcgcaaaggagtctggctacaacatgatccacttcacccccctgcaaaccttaggcctcagccggtcctgctacagcctcgccaatcagctcgagctgaacccagattttagtcgaccaaacagaaaatatacatggaatgacgtagggcagctcgttgagaagctgaagaaggagtggaatgtcatctgtattaccgacgttgtctacaaccataccgccgccaactctaagtggattcaggaacatccagagtgcgcttacaatctcgtaaactcccctcacctgaaacctgcctgggtgttagaccgggccctatggcgattttcctgtgacgtggcagagggtaagtataaggaaaaagggattcccgcccttatagagaatgaccatcacatgaatagtatacgcaagattatttgggaagatatctttccaaagttaaagctctgggagttctttcaggtggatgtgaataaggccgtcgagcagttcagacgcctgctcacccaagaaaatagaagggtaacaaagtcagaccctaaccagcatcttaccatcatccaggaccctgaataccgccgattcggctgtaccgtggacatgaacattgctcttacaacctttatcccccatgacaaggggccagccgccattgaggaatgctgtaattggttccacaagaggatggaggaactgaatagcgaaaagcacagacttatcaactatcatcaggaacaggctgtgaattgcctgctcggaaacgtattctatgagagattagcaggacatgggccgaagctgggtcctgtgacaagaaagcaccccctggtgacccgctacttcaccttccccttcgaagagatcgatttctctatggaagagagcatgatccatctacccaataaggcatgtttccttatggcccacaacggatgggtgatgggagatgaccccctgcgtaatttcgccgagcctggaagtgaggtctacctccggagggaactgatctgctggggagattccgtgaagctaagatacggaaataaacccgaagactgcccttacctatgggcgcatatgaagaagtatactgaaatcacggctacttactttcagggagttaggctcgataactgtcacagcacacccctgcatgtcgccgaatacatgttggatgccgcccgtaacttacagcccaacttatacgtggttgcagagctctttaccggatccgaggacctcgataatgtgttcgtgacacgcctgggaatttcgtctctgattcgggaggccatgtcagcctacaatagtcacgaggagggaaggctggtgtataggtacgggggagagccggtgggatcattcgtgcagccctgtcttcgcccgcttatgccagcaatcgctcacgctctgtttatggatattacacacgataatgagtgtccaatagtccatcgatctgcctacgacgcattgccatccactactatagtcagtatggcgtgctgtgcatcagggtctactagagggtatgatgagttggtacctcatcagattagtgtcgtgtccgaagagaggttctacacgaagtggaaccccgaagcattgccttctaacacaggggaggttaatttccagtctggcatcatagctgccagatgcgccatcagcaagttgcaccaggagctcggggcgaagggattcattcaggtgtacgttgaccaggtggacgaagacattgtcgctgtaacccgacacagcccttcaatccaccaatctgtcgtcgcggtttcccggacggcatttagaaaccccaaaaccagcttttactctaaagaagtgccccagatgtgcattcccggcaagattgaggaggttgtactcgaggcccggacaattgagaggaatactaaaccgtaccggaaagatgaaaacagcatcaatggaacgcccgacatcactgttgagataagagagcatatccagctgaatgaatctaaaatcgttaaacaggcaggggtggcaaccaagggcccaaacgagtatatccaggaaatagaattcgagaatctcagtcccgggtcggtgatcatctttcgtgtcagtttagatcctcatgctcaggtggccgtgggcatcctgaggaaccacttgactcagttttcccctcacttcaagtcaggctcgcttgccgttgataatgccgatcccattctgaaaatcccgttcgcctctctggcctctagattgaccttggccgaacttaaccagatattatataggtgcgagagcgaagagaaagaagatggtgggggatgctacgacattcctaactggtctgctttaaagtatgctggcttacaaggtttgatgtctgtgcttgcagagatccgcccaaaaaatgatctgggccaccccttctgtaacaatttgcgcagcggagattggatgatcgactacgtatctaaccgtttaattagccgatctggaactatagctgaggtcgggaaatggctgcaggctatgttcttctatcttaagcagattcctcggtacctcatcccatgctacttcgacgcaatactgatcggcgcttatactacgctgttggacaccgcatggaagcagatgagcagcttcgtgcagaatggcagtacatttgtcaagcaccttagcctgggctccgtccaactgtgtggagtgggcaaatttccgagcctgcctatactgtcgcccgccctgatggacgtgccttatcgattaaacgagatcaccaaggagaaagaacagtgttgtgtgtcactggctgccgggttgccgcatttctcttctggaatctttcggtgctggggacgcgacacctttatcgccttacgcggcatcttgctgatcacgggacggtatgtggaagcccgaaatataatcctggcttttgccggaacgctgcggcatgggctgattcctaatttgctgggggaagggatatacgctcgatataactgtcgcgatgcggtttggtggtggctgcagtgcatccaggattactgcaaaatggtccctaacggattggatatcctgaagtgccccgtaagtcgcatgtacccaactgatgatagtgcccctttacccgcggggactttagaccagccgctcttcgaggtgatccaggaggctatgcaaaagcatatgcaggggattcagtttagagagcgaaacgccgggccccagattgatagaaacatgaaggatgaggggtttaacatcaccgccggagtcgacgaagagacagggtttgtgtacgggggcaatcggtttaactgtgggacatggatggacaagatgggtgagagcgatcgtgcccgaaatagaggcattcccgccacacccagggacggatccgccgtggaaattgtaggcctcagcaaatcagcagttaggtggttactggaactgagcaagaaaaacatctttccttaccacgaggtgacagtaaagagacacggcaaagcaattaaggtttcctatgacgagtggaacagaaaaatccaggacaactttgagaaattatttcacgtgagtgaagacccttccgatctcaatgaaaagcatcccaatttggtccataaacggggcatttacaaggatagctacggagcctcatctccctggtgcgattaccaactgagacctaacttcactattgccatggtggtcgctccggaactgtttactacagaaaaggcttggaaggccctggagatagcagagaagaagctgcttggtcccctgggcatgaagacactggatcctgacgacatggtgtattgcggaatttatgacaatgcccttgacaacgacaattacaatctggccaagggattcaattaccatcaggggcctgagtggttgtggcccatcggttacttcctgagagcaaagttgtacttttctagactgatggggcccgaaaccactgcaaaaaccatcgtactggtaaagaatgttctaagtcgacactacgttcatttggagcgttcaccctggaagggtttgcccgaactgactaacgagaacgcccaatattgtccgtttagctgtgagacacaggcctggtctattgctactattctggagactctctacgatctctag

SEQ ID NO: 3571 - DNA, 4551 bp, Artificial Sequence
  Description of Artificial Sequence: Synthetic coding sequence
atggcccccatcctgagcatcaacctgttcatcggctacgagctgcaatttagactaggaccaactctccagggcaaggcagtcacagtttacaccaactatccttttcccggcgaaaccttcaaccgagagaaattccgctccctggactgggagaacccgacggagcgcgaagatgactctgacaagtattgtaagctgaatttgcagcaatctggctcattccaatactacttcctgcagggcaacgagaaatccggaggcggatacatcgtggtggacccaattcttagagtgggggctgataaccatgtccttcccctggactgtgtgactctccagacctttctggcaaagtgcctggggcctttcgatgaatgggaatctcggttgagggtggctaaggaatccgggtacaacatgattcactttacgcccctgcaaaccctcgggctgtcccgttcctgctattctctggccaaccaactggaactgaacccagatttcagccgacctaatcgaaaatatacctggaatgacgttggtcaactggtagagaagcttaagaaagaatggaacgttatttgcatcacggacgtggtgtacaatcataccgctgccaacagcaaatggatacaagaacaccccgaatgtgcctataatcttgtgaatagtccccatttaaagcctgcgtgggtgctcgacagagctttgtggcggttttcgtgcgacgtggccgaaggaaagtataaggaaaaaggcatacccgcactgatcgaaaatgaccaccatatgaacagcatccgtaagatcatctgggaggacattttccccaaactgaagttgtgggaatttttccaggtcgatgtgaacaaggccgtcgagcagtttcgcagactcctgacccaggaaaataggcgcgtgactaaaagtgacccaaatcagcatctcaccatcattcaagatcccgagtacaggagatttgggtgcaccgtggacatgaatatagcccttactaccttcatcccacacgacaagggccccgcagccattgaagagtgctgtaattggtttcacaaacggatggaagaattaaactcagaaaagcatcgactaatcaactatcaccaggaacaagccgtcaattgtctcctgggaaatgtcttttatgagcggctggctgggcacggaccaaagctgggccccgtgacgcgcaagcacccgctggtaactcgctacttcacctttccatttgaggagatcgactttagcatggaagagtctatgatacatctgccaaacaaagcctgcttcttgatggcccacaatggctgggtaatgggagacgatccgttgcgcaactttgctgaacctggatccgaggtttaccttcggcgcgaacttatctgctggggtgatagcgtgaaacttaggtatggcaacaagcccgaggattgtccctacctgtgggcgcacatgaagaaatacacagagataaccgctacgtatttccaaggagtgaggctggacaactgccactcaacaccactgcacgtcgccgagtacatgctggacgctgcacgcaacctccaacccaacctgtatgtggtggccgagctattcacgggctccgaagatctggataatgtcttcgtcacgcgcctggggatctccagcctcattcgggaggcaatgtctgcatacaatagccacgaggaaggccgtctggtgtatagatacggcggtgaacctgtcggctccttcgtacagccctgcctccggcccctgatgcctgcaattgcccacgccctttttatggatatcactcatgacaatgagtgcccgattgtgcatagatcggcgtacgacgcactaccctctacaacgattgtgagtatggcatgttgcgcaagtgggtctacccgcggatatgacgagctggtgccgcatcaaatttccgtcgtgagcgaagaacgcttctacacgaaatggaacccagaagctctgccttctaatactggcgaagtgaactttcagagcggaatcatcgccgctcgatgcgccatttcgaagctacatcaggagcttggggctaagggatttattcaggtgtacgttgaccaggtggacgaggatatagtggccgtgactagacactcgccctcaattcatcagagcgttgtcgcagtctcccgtactgcgttcaggaatcccaaaacctcattctattccaaagaggtgcctcagatgtgtatcccaggcaagattgaagaggttgtgcttgaagcgagaaccatcgagcgcaatacaaaaccataccggaaagacgaaaattctatcaatggcacgcctgacattaccgtggagattcgggagcatatccagcttaacgaaagcaaaatcgtcaaacaggcgggagtcgcaaccaaaggacctaacgaatacattcaagagatcgaattcgagaatctgagtcccggatctgtgattatttttcgtgtgtccttagatcctcacgcacaagttgctgtcgggatcttgcggaatcatctcacccagttttccccgcactttaaaagcgggagtcttgcagtggacaatgccgaccccatcctgaagattcctttcgcaagtcttgcttccagactgaccctggctgagcttaaccagatcctctacaggtgtgagagtgaggagaaggaagacgggggaggatgttacgatattcccaattggtccgccctgaaatacgcaggtcttcaaggcctgatgagtgtcctcgccgaaattagacctaagaacgaccttgggcaccccttttgtaacaatctcagatccggggactggatgattgattacgttagcaatcgtctgatctcaagaagcgggaccattgccgaggtgggtaaatggctgcaggccatgtttttctatctaaagcagattccacgttacctgattccatgctatttcgacgctatcctgataggggcctatacgactttgcttgataccgcttggaaacagatgagtagcttcgtccagaatggctccacgtttgtgaagcaccttagtttaggctccgtccaactgtgcggcgtgggaaagttcccgagcttgccaatcctttcccctgctctcatggatgtgccctatagactgaacgaaatcacgaaagagaaggagcagtgttgcgtctccctcgccgccgggctcccccatttcagctcgggcattttccggtgctggggacgggataccttcatcgctctgcgggggatactcttgatcacagggcggtatgtagaagcacgaaacataattctggcctttgcgggaaccctgaggcacggactcatccccaatttgttgggcgagggaatctatgcgagatataattgccgggacgcagtttggtggtggctgcaatgcatccaggattactgtaagatggtccctaatggcttggatatacttaaatgcccagtgagcagaatgtaccctacagatgacagcgcaccattacccgccgggactcttgaccaacccctcttcgaggtgatccaagaggccatgcagaagcatatgcaaggaattcagtttcgcgagcggaatgctggtcctcagatcgatcggaatatgaaagacgagggcttcaatattaccgccggggtagatgaagaaaccggattcgtatacggaggcaatcggtttaattgcggcacctggatggacaagatgggagaatccgaccgggcccgtaacagaggaattccagccactccccgggatggaagcgcggtcgaaatcgtcggactgagcaagtcagctgttcgttggctgctggaactgtccaaaaagaacatcttcccttaccacgaagtgaccgtgaagcgccacggtaaagccatcaaggtttcatacgacgagtggaatcggaagattcaggacaatttcgagaaattgtttcatgtcagtgaggatccctctgatctcaatgagaaacatccaaaccttgtccataagagggggatctacaaagatagttatggagcgtcatctccctggtgtgattatcagttgcggcccaactttactattgccatggtggttgcgccagaactttttactacagagaaggcatggaaggcactggagattgcggagaagaaactgttggggcccttggggatgaagacactggacccagacgacatggtgtattgcggtatatacgacaatgcactcgataacgacaactacaatctcgctaagggatttaattatcatcaagggcccgagtggttgtggcctatcgggtactttctccgagctaagttatacttttcaaggttaatgggtccagaaaccactgccaagaccatcgtgttggtgaaaaatgtacttagtcgacactacgtgcacctggagaggagcccatggaaggggctacccgaactgacaaatgagaatgcccagtactgcccttttagttgcgaaactcaggcatggtcaatagcaaccatcctagagacgctctacgatttgtag

SEQ ID NO: 3572 - DNA, 4599 bp, Artificial Sequence
  Description of Artificial Sequence: Synthetic coding sequence
atgggccacagcaagcagatccggatcctgctgctgaacgagatggaaaagttggaaaagactttgtttcggctggagcagggctatgagctgcagtttcggctggggccaaccctgcaaggaaaagcggtcaccgtgtacacaaactaccctttccctggagagacgttcaaccgggagaagttcaggagtctggattgggaaaatccgaccgagcgagaggatgatagcgataagtattgcaagctgaacttgcaacagagcgggagttttcagtattatttcctgcaggggaatgaaaaatccggcggtggctacatcgttgtcgatcccatcctgagggtcggggccgataaccacgtgttgccactggactgcgtgaccctacagacctttttggcaaagtgcctgggaccatttgatgagtgggagtctagattacgggtcgccaaagaatccggttacaatatgatccattttacacctctgcagacactcgggctgtcccggagctgttactcactggccaaccagcttgaactgaacccggattttagtaggccaaacaggaaatatacatggaatgatgtcggccagcttgtcgagaaactaaagaaggagtggaatgtgatttgcatcactgacgtggtgtataaccacactgccgctaatagcaagtggatccaggagcatcctgagtgtgcttacaacctagtaaactctccgcacctgaaacctgcctgggttctggacagagcgctgtggcgcttcagctgcgacgtcgccgagggcaaatataaggaaaagggaatccctgccctgattgagaacgatcaccacatgaacagcatcagaaagattatctgggaggatatattccctaagttgaagctgtgggaatttttccaggtagacgtgaacaaggcagtggagcaatttcggaggctactgacacaggaaaataggcgcgtcacaaagtctgatccaaaccagcatctcaccataatacaggatccggagtatcggagattcgggtgtaccgtggatatgaacatcgcattgaccactttcatcccccacgacaaaggtcctgccgctatcgaagagtgttgtaattggtttcataagaggatggaggagttaaacagcgagaaacatagacttattaattaccatcaggagcaggccgtgaactgccttctcggaaacgttttctacgagaggctggctggacatggtcctaagcttggcccagttacacgtaaacacccactcgtgacccgatactttacatttccgttcgaggagattgacttcagcatggaggaatcgatgatacatctgcctaacaaggcgtgtttccttatggcacacaacgggtgggtcatgggagacgaccccctgcgaaacttcgccgagcctgggtcagaggtgtatttgcgccgcgaactgatttgttggggagatagtgtgaagctgaggtacggaaataagccagaggattgcccttatttgtgggctcacatgaaaaagtacacagaaattactgccacttattttcagggagtgcggctggataattgccactcgacaccactccacgtggccgagtatatgctggatgcagcccgtaacttgcaacccaacctctacgtagtggccgagttattcaccggctccgaggacctggacaatgtttttgttacccgactagggatttcctctttgattcgagaagctatgtccgcctacaactctcacgaggagggccgcctagtgtatcgctatgggggcgaacccgtgggtagctttgtgcagccttgcctgcggcctcttatgccagccattgcacatgccctcttcatggacattacccatgacaacgagtgtccaatcgttcacagatcagcgtacgatgctttaccgagcacaactatcgtgtctatggcttgttgcgctagcggaagcacccgcgggtatgatgagttggtgcctcaccaaatatccgtcgtgtcggaggagcgtttctataccaagtggaatcctgaagctctccctagcaacactggtgaagttaatttccagagcggcattatcgccgctagatgcgccattagtaagctgcaccaggagctgggtgccaaggggtttattcaggtctacgtggatcaagtggatgaggatatcgtggctgtcacacggcattctcccagcattcatcaaagtgtcgtcgcagtgtccagaactgcgttccggaaccccaagacatccttttactccaaagaggtgccccagatgtgcattccggggaaaatcgaggaagtcgtcctcgaggcacgtacaatagaacgaaatactaaaccatacagaaaggacgagaacagtatcaacggtacgcctgatatcacagtcgagatcagagagcacatccaattaaatgagagcaagatagtcaagcaagcaggagtggccaccaagggaccaaacgaatatatccaggagattgagttcgagaacctgtcaccagggtcagtaattatttttcgcgtttccttggatccacatgcccaggtcgcagtgggcatcctgcggaatcacctgactcagttctctcctcacttcaagtcaggttcactagccgttgacaacgccgacccaattctgaagataccattcgcaagcctggcttccaggctgacactggccgagttaaatcagattctctaccgttgtgaatccgaagaaaaggaggacggggggggatgctatgacattcccaactggagcgccctgaagtacgccggcctgcaagggctgatgtcagtgctggctgagattcgcccaaagaacgaccttgggcacccgttttgtaacaacctccgctccggggactggatgatcgactatgtttcgaaccgcctgatctcccggagcggaaccattgcggaagtgggaaaatggctacaggccatgttcttttatctgaaacaaattccaagatacttgattccatgctatttcgacgccatactgattggagcctacactactttgctggatacagcctggaagcaaatgtcatcatttgttcagaatggtagcacgtttgttaaacatcttagtcttggatccgtgcagctgtgcggtgttggtaaatttccttctctacctatcctgagccccgcattgatggacgttccgtatcgacttaacgagattactaaggagaaggagcagtgttgtgtatctctggcagccggcctgcctcatttttcaagcggaatctttaggtgttggggtcgggatacttttatcgcccttagaggcatccttctaataactggtcggtatgtcgaggccagaaatatcattcttgccttcgccggaactctgcggcatggtctgatcccgaaccttttaggcgagggcatatatgccaggtacaactgcagagacgcagtctggtggtggctccagtgtattcaagactattgtaaaatggtcccgaacggtctggatatcctcaaatgccccgtgagtcggatgtaccccacggatgactctgccccactgccagccggaactctagatcagccgctgttcgaggttattcaggaggccatgcagaagcacatgcaggggatccagttccgcgagagaaatgctggacctcagattgatcgcaacatgaaggacgaaggatttaatattacagcaggcgtcgatgaggagaccggctttgtatatgggggaaatcgttttaactgcggtacatggatggataagatgggcgaatcagaccgcgctaggaatcgcggcattccggctacaccacgggatggcagtgctgttgagatagtgggactcagtaagtcagcggttcgttggttgctggaattgagtaagaagaacatcttcccctatcacgaggtgaccgtgaagcgacatggaaaggccatcaaggtgtcctatgacgagtggaaccgtaaaattcaagacaatttcgagaagcttttccatgtttcagaggaccctagtgacctcaatgaaaagcatccaaatttagtccacaaaaggggcatctacaaggactcctacggtgcaagcagcccttggtgcgactatcagctcaggcctaacttcactatcgcgatggtggttgcccccgagctgttcacaacagaaaaggcttggaaagcgctggaaatcgctgagaagaagctgttaggacccctaggcatgaaaacactggatcctgacgatatggtgtactgtggaatttatgataatgccctggacaatgacaattacaaccttgccaagggatttaactaccaccaggggccagagtggctctggcccattggttactttctccgggcgaagctgtacttcagccggctgatgggccctgagaccaccgccaaaaccatcgtcctcgtaaaaaacgtactgtcgcgtcactacgttcatctggagagatccccatggaagggcttgccagaactcaccaatgagaatgcacagtactgcccattctcatgtgagacacaggcttggtccattgcaaccatattagagacgctgtacgatttgtag

SEQ ID NO: 3573 - DNA, 4599 bp, Artificial Sequence
  Description of Artificial Sequence: Synthetic coding sequence
atgggccacagcaagcagatccggatcctgctgctgaacgagatggagaaactggagaagactctgttccgtctcgaacagggctacgaactccagttccggctggggcccactctccaggggaaagcggtgacagtctacaccaattatcccttccccggcgagacgttcaaccgcgaaaagtttaggtctctggattgggaaaatcccaccgaaagagaagacgacagcgacaagtactgtaagttgaatctccaacagtccggctcattccagtattatttcttacagggcaatgagaaaagcggggggggctacatagtggtggaccctattctgcgggtgggcgctgataaccatgtgctgcccctcgattgcgtcacattgcagacctttctcgctaaatgcctgggtccatttgacgaatgggagtcccgactgcgcgtggccaaagaatctggttacaacatgattcatttcacccccctacagactcttggactgagcagatcatgttacagcttggccaaccaactcgaactgaatccagactttagtaggcccaaccgaaaatatacatggaacgacgtgggacaactcgtggagaagctgaagaaagagtggaacgtcatatgcattactgatgtggtgtacaaccatacggccgccaacagcaaatggatccaggagcatcctgagtgtgcatacaatctggtgaattcccctcatcttaagcctgcttgggtactggaccgcgccctgtggcgcttctcgtgtgacgtggctgaaggtaagtataaggagaagggtattcccgctctgatcgaaaacgatcaccatatgaactctatacggaagatcatctgggaagatatttttcctaaactgaagctatgggagttcttccaggtcgacgtgaacaaggctgtcgaacagttccgcaggctactgacgcaggagaaccgcagggtcactaaatctgaccccaaccagcacctgaccatcattcaggatcccgagtatcgtaggttcggctgtaccgtcgatatgaacatcgccctgaccaccttcatcccccacgacaaagggcccgctgctattgaagagtgctgcaactggtttcacaagagaatggaggagctgaatagcgaaaagcataggctcatcaactatcaccaagaacaggcggtgaactgcttgcttggaaacgttttttacgaaaggcttgccggccacggccccaaactcggaccggtgactagaaaacatcccctggtgacacggtattttaccttcccgttcgaggaaatcgacttctctatggaagagagcatgattcatctgccgaataaggcatgcttcctgatggcccataacggatgggtgatgggtgatgaccccctgcggaactttgcagaacctgggagtgaggtctatttgcgacgggaactcatttgctggggtgatagtgtgaaactgcgatatggaaacaaacccgaagactgcccatatctttgggctcatatgaagaagtatactgagattacggcaacctactttcagggagtcagattggacaattgccactcgacgccccttcatgttgcggaatacatgctggatgccgcgagaaatctgcagcctaacctctacgtggtggctgagctgtttactggatccgaggacctagataacgtgttcgtaacaagactgggcatcagcagtttgatacgggaggccatgagcgcttacaattctcacgaggaaggacggctggtgtatcgttatggcggtgagcctgtcgggtccttcgtgcagccctgtctcagacccctaatgccagctattgcacacgccctgttcatggatatcacccacgacaacgaatgtcctattgttcacaggagcgcttatgacgcactgcccagcaccactatagtctccatggcatgttgtgcatcggggagcacaagaggttacgatgagctggtgcctcaccagatatccgtcgtttcagaggaaaggttttataccaagtggaaccccgaggccctgccaagcaataccggagaggtgaatttccagtcgggcattatcgcagccaggtgcgcgatcagcaagctgcaccaggaactgggggccaagggcttcattcaggtttacgtcgaccaggtggacgaggacatagtggctgtgacgaggcactctcccagcatccaccaaagtgttgtcgcagtctcacgcacagctttccggaaccccaagactagcttctatagtaaggaagtcccgcagatgtgcatcccagggaagattgaagaagttgttctcgaggctcgcacaatcgaaagaaacacgaaaccttataggaaagacgaaaacagcatcaatggcacacccgacatcacagttgaaatccgagagcacatacagctgaacgagtctaagatagtcaagcaggctggagtcgccacaaaaggacccaatgagtacatacaggagatagagtttgagaatctctccccagggagtgtaatcatctttcgggtctctctggaccctcacgcgcaggttgccgtcggaattcttcgcaaccacctgactcaattttcaccccacttcaaaagtggttcattggccgtggataacgcggatccaattctcaaaattcccttcgcaagcctggcaagcaggctaacacttgcggagcttaatcagattctttatagatgcgagtcagaagagaaggaggatgggggcggctgctacgatataccgaattggagtgccttgaagtacgcaggactgcagggactcatgtcagtgctggcagagattcgcccaaagaacgacctcggacaccccttttgtaataacctacgcagtggcgattggatgatcgactacgtgtctaaccgcctgatttctcgctcaggtactatcgccgaggtcgggaaatggctccaggctatgttcttttacttgaagcaaatccctaggtacctgatcccctgctatttcgacgccattctgatcggggcatacaccaccctgctggatacagcatggaaacaaatgagcagttttgtgcagaatggatcgacatttgtgaagcacctgagcctgggcagcgtccagctttgtggcgtggggaagtttccttccctacctatcctgtctccagctctgatggacgtcccatacagattaaacgaaattaccaaagagaaagagcaatgctgcgtttccttggccgctggtctgcctcactttagttctggtattttcaggtgttggggacgagatacctttatagctctgcgtgggattctgctcatcacggggagatatgtcgaagcccgcaatatcatcctcgctttcgctgggacactacggcatggcctcatcccgaatttgctgggagaagggatctatgctagatacaactgccgcgatgcggtatggtggtggttgcagtgcattcaagactactgtaagatggtgccgaacggactcgacattcttaagtgccccgtgagtagaatgtatcccactgacgattccgccccgttgcccgcaggcaccctggatcaaccactctttgaagtgatccaggaggccatgcagaagcacatgcaggggattcagttcagggaaaggaacgccggcccacagatagatcgtaacatgaaagacgagggatttaacatcacagctggcgtggacgaagaaaccggatttgtgtacggtggcaataggtttaattgcggaacctggatggacaaaatgggcgaatccgaccgtgcccgcaacagaggaataccagccactcctagagacggctctgcagtggaaatcgtggggctcagcaaatctgccgtccgatggttactggaactgagcaaaaagaatatttttccctaccatgaggtgacagtcaaacgacatggtaaagctatcaaagtcagttacgatgaatggaataggaaaattcaggataactttgaaaaactctttcacgtgagtgaggatcctagtgacctcaatgaaaagcaccccaatctggtgcataaacgtggtatatacaaggactcatacggtgcatcatccccttggtgcgactaccagctcagaccaaatttcactattgctatggtggtcgctcctgaattgttcaccaccgaaaaggcctggaaagcgctggagatcgccgagaaaaaactcctaggtccactgggaatgaaaaccttggaccccgatgacatggtctactgcggaatttacgataacgctctcgataacgataactataacctcgcaaaaggctttaattatcaccagggaccggaatggctgtggcctatcggttatttcctgagggcgaagctttactttagccggctaatgggccccgaaaccaccgccaagactattgtactagtgaagaacgtcctgtctcgccattacgtacacttggagcggagtccttggaaaggactgcccgagctgacgaatgaaaatgcacaatactgtcctttttcgtgcgagacacaagcatggagtattgccactatcttggaaacactctatgatctgtag

SEQ ID NO: 3574 - DNA, 672 bp, Artificial Sequence
  Description of Artificial Sequence: Synthetic coding sequence
atgaacaagcccctgctgtggatcagcgtgctgaccagcctgctggaggcgttcgcccacaccgatctgtccggtaaagtgttcgtctttccaagggaatccgtgacagatcacgtgaatctcataactcccctggaaaagccacttcagaatttcactctgtgctttcgggcctattctgatctctctcgggcttacagcctgttttcttacaacactcagggccgcgacaacgaattactggtgtacaaagaacgagtcggcgaatattccttgtatatcggacgtcataaagtgacttctaaggtgatcgaaaagttccccgcccccgtccacatctgcgtgtcttgggaatcatcctctgggattgctgagttttggataaatggtactcctctcgtgaaaaaggggctgcggcagggctattttgtggaagcccaacccaagatcgttctgggacaggagcaggacagttacgggggaaagtttgatagaagccagtcatttgtcggagagattggagacctgtacatgtgggactcagtcctcccgcctgagaatattctgagcgcgtaccagggcacgcccctccccgcaaacattctcgattggcaggcccttaactatgagatacgggggtatgtcatcattaagcccctcgtctgggtctag

SEQ ID NO: 3575 - DNA, 2418 bp, Artificial Sequence
  Description of Artificial Sequence: Synthetic coding sequence
atgagcagcagcagctggctgctgctgagcctggtggccgtgaccgctgctcaatcaaccattgaggagcaggctaagacatttctagacaaattcaaccatgaagccgaggatctattttaccaatcctcactggcttcctggaactacaataccaacattactgaggagaatgtccagaacatgaataatgcaggggacaaatggagcgctttcctgaaggaacagagtactctggcccagatgtatccgttgcaggaaattcagaacctaaccgtgaagttgcagctccaggcacttcagcagaacggctcctccgtgctgtccgaagataagtcaaagagactgaataccatcctcaataccatgtcaactatttattcaacgggcaaggtgtgcaatcccgacaatccccaagagtgtctgttgcttgagcctggactcaatgaaatcatggctaactcactggactataatgagcgcctgtgggcatgggagagctggaggtctgaagttgggaaacaactgagacctctttacgaggagtacgtggttctgaagaatgagatggcccgggcaaaccattatgaagactacggtgactattggcgaggtgattacgaagttaatggggtggacggatatgattacagccgtgggcaactgatagaggatgtggaacatacctttgaggaaatcaagcccctctatgaacaccttcatgcctacgtgagggcgaaactcatgaatgcttatccctcttacatctcgcccattggatgcctccccgcccatctgctcggagatatgtggggtagattctggactaacctctattctctcacagttccatttggccagaagcctaacatcgatgtgacggacgcaatggtcgaccaggcatgggatgcccaacgcatcttcaaagaggcagagaagttctttgttagcgtgggtctaccaaacatgactcaagggttctgggagaattccatgctgacagatccagggaatgtgcagaaagctgtgtgccatcccactgcctgggatcttggcaaaggtgactttcggatcctcatgtgtactaaggtgacaatggatgacttcttaaccgctcaccatgagatgggccatatccagtacgacatggcatatgccgctcagccattcctgctccgtaacggtgcaaacgagggcttccatgaggcggtgggagagatcatgtcgctgagcgccgcaacaccaaaacaccttaagtctattgggttgttgtcacctgacttccaggaagacaatgagaccgagattaactttttactaaagcaagccctgacaatcgtggggaccctgccattcacatacatgcttgagaagtggaggtggatggtgtttaaaggcgaaattcccaaggatcaatggatgaagaagtggtgggaaatgaagagagagattgtgggagtcgtggaacccgtaccacacgacgaaacgtactgcgacccagccagcctgttccacgtgagtaatgactacagcttcataagatattacacgcgtactctgtatcaattccaattccaagaggccctttgccaggccgctaagcacgagggaccgctgcacaaatgcgatattagtaacagtacagaagccggacaaaaattgttcaacatgcttagactgggaaagagcgaaccctggactctcgctctggaaaatgtcgttggcgcaaaaaatatgaatgtgcgcccattgctgaactacttcgagccattatttacatggctcaaagaccaaaataagaatagcttcgtcggttggtctacggactggagcccgtacgccgaccagagtatcaaggtgaggattagcctgaaatcggccttgggggacaaggcctacgagtggaacgataatgaaatgtatctgttcaggtccagtgtggcttatgccatgcgtcagtacttccttaaggtcaaaaaccaaatgatcttatttggcgaagaggatgtgcgggtggctaatctgaaaccgcgaatatcatttaactttttcgtcaccgcaccaaaaaatgtaagcgacatcattccacgtactgaggtcgaaaaggcgatccggatgtcgcggagcaggataaacgacgcatttcggctgaatgacaattccctggagtttctgggaattcagcccacactgggcccaccgaatcagcccccagtcagtatttggctgattgtgttcggcgtggtgatgggggtaatcgtcgtaggcatcgtgatcctgatttttacaggaatccgtgatcgtaaaaaaaagaataaggcgaggtccggcgagaatccatacgcatccatcgatatttccaagggcgagaacaatcctgggttccagaacaccgatgatgtgcagacttccttctag

SEQ ID NO: 3576 - DNA, 2418 bp, Artificial Sequence
  Description of Artificial Sequence: Synthetic coding sequence
atgagcagcagcagctggctgctgctgagcctggtggccgtgaccgccgctcagtcgactattgaggaacaggctaaaacatttctcgataagtttaaccatgaggcagaagacctgttttatcagagcagtctggcctcatggaactataataccaacataacagaagaaaacgtacagaatatgaataatgctggggataaatggagtgcttttctgaaagagcagtccacgttagcacagatgtaccctctgcaggagatccaaaaccttacagtgaagttgcagctgcaggctctgcaacagaatggttcttcagtgctgtcagaagataagtcaaagagacttaacaccatactcaatactatgtcaacgatttactccaccgggaaagtgtgcaatccggacaatccccaggagtgcttgttgctagaacctgggctcaacgagatcatggccaatagtttggactataatgagcggctgtgggcttgggaatcctggcgcagcgaggtggggaaacaactccgccccctgtacgaggagtacgttgtacttaagaacgagatggccagagctaatcactatgaagactatggagactattggagaggcgactatgaagttaacggcgtggatggttatgactactcccgcggccagctcattgaagatgtcgagcacactttcgaggagatcaagcctctgtatgagcatctccacgcttatgttcgggccaagttgatgaacgcatacccgtcttacatctcacctatcggttgtctcccggcgcacctattgggagatatgtgggggcggttttggaccaatctgtacagcctaacggtgccatttggccagaagccaaacattgacgtgactgatgcaatggtagatcaagcctgggatgcgcagcggatcttcaaggaggcagagaagttctttgtctctgtgggcctgccaaacatgacccagggcttttgggagaatagcatgctgactgatcccggaaatgtgcagaaggccgtttgtcaccctacagcatgggacttaggcaagggagattttagaattctgatgtgtacaaaagtaacaatggacgacttccttactgcccaccatgaaatggggcacatccaatatgacatggcctatgccgctcaacccttccttcttcgcaatggggccaacgaagggttccacgaggccgtgggcgagataatgagccttagtgccgccacacccaaacatctgaagagcatcggcctgcttagcccagactttcaggaagacaacgagaccgaaattaacttcctgttaaaacaggccctcacaatagtgggaactctcccgttcacatacatgctggaaaaatggcggtggatggtgtttaagggcgaaatacctaaggaccagtggatgaaaaagtggtgggagatgaagcgggaaatcgttggtgtcgttgagcccgtgccacatgacgaaacctattgtgatccagctagtctgtttcacgtgagcaatgattatagttttatccggtactatactagaacgttgtaccagttccagtttcaggaagctctgtgtcaagcggcgaaacatgaggggcccctgcacaaatgcgatatcagtaactcaaccgaagcaggccagaagttgttcaacatgctgcgcctaggaaagtccgaaccatggaccctcgctctggagaatgtggtgggagcgaagaacatgaacgtgagacccctgctgaactatttcgaacctctatttacttggctgaaggatcagaacaagaactccttcgtagggtggtccactgattggagcccatatgcggaccagagtataaaggtgcgaatctctctgaaaagcgcccttggtgataaggcgtacgagtggaatgacaatgagatgtatctgttcaggagttcagttgcatacgccatgcgtcaatacttccttaaggtcaagaaccagatgatcctgtttggggaggaggatgttagagtggctaacctcaagccccgaatcagcttcaattttttcgttacagcacccaagaacgtctctgatatcatccctcggaccgaggttgaaaaggccattcgcatgtcgcgctctcgaattaatgacgccttccggcttaacgacaatagcctggagttcctcggaatccagcctactctgggcccaccaaatcagcctcccgtctccatatggttgatcgtcttcggagtagtgatgggcgtgatcgtcgtcgggatcgttattctcatctttaccgggattagagatcgcaagaaaaaaaataaagcacgcagcggagagaacccttatgctagcatagatatttcgaaaggcgagaataatcctggcttccagaatacagatgatgtccagacaagcttctag

SEQ ID NO: 3577 - DNA, 804 bp, Artificial Sequence
  Description of Artificial Sequence: Synthetic coding sequence
atgaaggccgccgtgctgaccctggccgtgctgttcctgaccggctctcaggcccgccatttctggcagcaggacgaacccccacagagcccttgggaccgagtcaaagatctcgctaccgtgtacgtggatgtcctcaaggactctggcagggactatgtgtcccagtttgaggggtcagccctcggaaagcagctcaacctgaaactgcttgacaactgggacagcgttacctcgacgttttcaaagcttcgtgaacagctgggaccagtgacacaagaattttgggacaacctcgagaaggagacagagggccttaggcaagagatgtccaaagatttagaggaagtaaaggccaaggtccagccatacctagacgatttccagaaaaaatggcaagaagagatggaattatataggcaaaaagtggagccactgcgcgccgaactgcaagagggggctaggcagaagcttcatgagctccaagagaagctgtctccgttgggcgaggagatgcgtgatcgggccagggcacatgtggacgcacttagaacgcacctggctccctactcggacgaactgcggcagtgtcttgcagctcgccttgaagcactgaaagagaatgggggggcccgcttggccgaatatcacgctaaagcaactgagcacttgagcaccttgagtgaaaaggccaagcctgccctcgaggatctcagacaaggcctcctgcctgtgctagaaagtttcaaggttagtttcctgagtgcacttgaggaatacaccaaaaagctgaatactcagtag

SEQ ID NO: 3578 - DNA, 804 bp, Artificial Sequence
  Description of Artificial Sequence: Synthetic coding sequence
atgaaggccgccgtgctgaccctggccgtgctgttcctgaccggctcccaggccagacacttctggcagcaggatgagccacctcagagcccctgggatcgcgtaaaggacctggccacagtatatgtcgatgtcttgaaagattcggggagggattacgtgtcacaatttgaggggagcgctttaggcaaacagctcaatctgaagttactggacaactgggactccgtgaccagtacatttagcaagcttagagaacagctgggcccggtgacacaagagttctgggataacctcgagaaagagactgaaggactgcgtcaggagatgtctaaggatcttgaggaagtcaaggcgaaggttcaaccttatctcgacgatttccagaagaagtggcaagaagagatggagctctaccgccagaaggtggagcctctgcgagcggagctgcaggagggagctcggcagaagctgcacgagctgcaggaaaaattgtccccactgggagaggaaatgcgggattgcgccagagcccacgtggacgctctcaggacccatctcgccccgtactccgacgagctgcgtcagcgactggcggctaggttggaagcactgaaggaaaacggaggcgcccgtcttgccgaatatcacgctaaggcaaccgagcacctctcaaccttaagtgagaaagccaaacctgctctagaagacctcagacagggtctgctgcccgttctcgaatctttcaaagtgagcttcctttctgctctggaagaatacaccaaaaagctcaatacacagtag

SEQ ID NO: 3579 - DNA, 804 bp, Artificial Sequence
  Description of Artificial Sequence: Synthetic coding sequence
atgaaggccgccgtgctgaccctggccgtgctgttcctgaccggctcccaggcccggcacttctggcaacaggacgagcctccacaatctccttgggaccgggtcaaggatttagcgacagtgtatgtagatgtgcttaaagactcgggtcgagattacgtgagccagtttgagggttccgcactcggcaaacaattgaatttaaaactgctcgacaactgggactctgtaacttctacgttttccaagctgcgagaacagctggggcccgtgactcaggagttctgggacaatttggaaaaggaaaccgaggggcttaggcaagagatgtcaaaagatttagaggaggtaaaggcaaaggtacagccttacttagacgactttcaaaagaagtggcaggaagaaatggaactgtaccgacaaaaagttgagccactccgggcggaacttcaggaaggggcaagacaaaagctacacgagctgcaagaaaagttgagcccactgggagaagaaatgcgtgatcgggccagggctcacgtcgatgccctgcggacacacctcgccccctactcagacgagctgaggcagcggttagctgctagattagaggcactgaaggagaacggtggcgcccgactggccgaataccatgctaaggcaacagagcatctcagtaccctgagcgagaaggctaagccagcactcgaggacctgagacagggtctgctgcctgtgctggaatcctttaaggtcagtttcctgagcgctcttgaggagtacacaaaaaagctgaatacacaatag

SEQ ID NO: 3580 - DNA, 804 bp, Artificial Sequence
  Description of Artificial Sequence: Synthetic coding sequence
atgaaggccgccgtgctgaccctggccgtgctgttcctgaccggctcgcaggcacgccatttttggcagcaagacgaacccccccagtccccctgggaccgagtcaaagacctggctaccgtgtacgtggatgtccttaaggacagtggtcgcgattacgtgtcgcaatttgagggctccgcactgggtaagcaacttaacctgaagctcctggataattgggacagtgttacatccacgttttccaagctgcgcgaacagctcgggccagtgacacaggagttctgggataatctggagaaggagacagaggggctgcggcaggaaatgtccaaggatcttgaggaggtgaaggcaaaagttcaaccatatctggacgatttccagaaaaaatggcaagaggaaatggagctatataggcagaaagtagaaccgcttcgggccgagctacaagagggggcccggcagaagctccatgaactccaagagaaactcagtcctctaggcgaggagatgagagaccgagcacgggcccacgtggacgccctgagaacccatctagcaccctactctgacgagttgagacagcggcttgcggctcgactcgaagctcttaaggaaaacgggggagccagactggctgagtaccacgccaaagctacagaacacctctcaactctctctgagaaagctaagcctgccttagaagaccttcggcagggattgctacccgttttggaatcctttaaagtgagcttcttatcagcattggaggaatatacgaagaagctgaatacccagtag

SEQ ID NO: 3581 - DNA, 804 bp, Artificial Sequence
  Description of Artificial Sequence: Synthetic coding sequence
atgaaggccgccgtgctgaccctggccgtgctgttcctgaccggctcgcaggccagacacttctggcaacaggatgagccaccccagtctccctgggacagagtgaaggatctcgcaaccgtctacgtggacgtgctgaaggacagtggacgcgattacgtatcccagttcgagggttcggccctaggaaagcagctgaacttgaagctgctcgataattgggacagcgtgacttccacattttctaaattacgtgaacagttaggcccagtcactcaggagttttgggataacctagaaaaggagacagaagggcttaggcaagagatgtcaaaggacctcgaggaggtgaaagccaaggttcaaccgtatcttgacgattttcagaaaaaatggcaggaggaaatggagttgtacaggcagaaagtggaaccattgcgggctgaattacaggaaggcgctcggcagaaattgcacgagctccaggagaagctgtccccactgggcgaggagatgcgggaccgcgcacgagcacatgtggatgccctccgtacccaccttgccccgtattccgacgaactgcgccaacggctggcagctcgactggaagcactcaaggaaaacggaggggcgcgattggcagaataccacgcgaaggcaacggagcatctaagcacactgtccgaaaaagccaaaccggccctggaagaccttaggcagggcctactgccagtgctcgagtccttcaaggtctctttcctgagcgcacttgaagagtacacaaagaagctgaatacacagtag

SEQ ID NO: 3582 - DNA, 804 bp, Artificial Sequence
  Description of Artificial Sequence: Synthetic coding sequence
atgaaggccgccgtgctgaccctggccgtgctgttcctgaccggcagccaggcccggcatttctggcaacaagacgagccaccccaatccccgtgggatagagtgaaggacctggccacagtttacgttgacgtgctgaaggactctggacgggactatgtgagccagtttgaaggaagcgccctggggaaacagctgaacctcaaactcctcgacaattgggattcggtgacgagcaccttcagtaagctacgggagcagcttgggcccgtcacacaggagttctgggacaatctggagaaagagaccgaagggctgaggcaggaaatgagtaaggatctcgaagaagtgaaagccaaagttcaaccctacctggacgatttccagaaaaagtggcaggaggaaatggagctttacagacagaaggtcgaacccctgagagccgaactgcaggagggagctcgtcagaagctgcacgagctccaggagaagctgagcccccttggcgaagagatgagagaccgggctagagcccatgtcgacgctcttaggacccatcttgccccgtattcagacgagttaagacaacggcttgcggcccgcttagaggctctcaaagagaatggcggtgctaggctcgccgagtatcacgccaaggcaaccgaacatctcagtacattaagtgaaaaagcaaagccggcgctagaagacttgcgtcagggcctcctccccgtgctagagtcctttaaggtttccttcttgtccgccctggaggaatacacaaagaagttgaatacacaatag

SEQ ID NO: 3583 - DNA, 1653 bp, Artificial Sequence
  Description of Artificial Sequence: Synthetic coding sequence
atgaccggcgacaagggcccccagcggctgagcggcagcagctacgggagcatttcatcgccaacctcccccacatcacctggccctcagcaagcccccccgcgcgagacatacctgtccgagaaaataccaattccagacactaaacctggcaccttctctttgcgtaaactctgggctttcactgggccaggattcctcatgtctatcgccttccttgatcccggcaacattgaatccgacctccaggccggggctgtcgccggattcaagctcttatgggtactgctgtgggccacagttctcggactactgtgccagcggctcgccgcaagattgggagtggtgaccggcaaagacttgggcgaagtttgtcacctgtattaccccaaagtcccaaggaccgttctctggcttaccatcgagctagctatagttggctctgacatgcaagaggtgattgggaccgcaatagcgttcaacttactttccgcgggccgaatacccctgtggggtggcgttctgataactatcgttgacacattcttctttcttttccttgacaattacggactccgcaaattagaagcctttttcggactgttaatcaccataatggccctcacctttggctacgaatacgtcgtggctcgccccgaacagggtgcattactgcgaggcctgtttctcccatcttgccccggctgtggccacccggagctgttgcaggcagtgggcatcgttggcgctattatcatgccccacaatatctatctgcacagcgcactcgtgaagtctagagagatcgacagagctaggagagcggatatcagggaggcgaacatgtatttcctcattgaggccaccatcgcccttagtgtctctttcataataaatctgttcgtgatggccgttttcgggcaggctttctatcagaagacgaaccaggcagctttcaatatctgtgcaaacagttccctgcacgactacgctaaaattttcccaatgaacaacgccacagtggccgtggacatctaccagggcggagtgatcctgggatgtctgtttggccccgccgctctatacatctgggcaattggactcctggccgccggccagtcatccacgatgactgggacttacgcagggcaatttgtgatggaaggattcctgaggctgcgctggtctcgctttgcacgggtactgctgactcgctcatgcgcgatactcccaacagtgctggttgctgtgttcagggatctgcgcgatctgtccggcctgaatgacctgttgaacgtccttcaatcactactgcttccgtttgcggtgcttcctatcttaacatttacgtcaatgccgaccctgatgcaggaattcgccaatggcctgttgaacaaggtcgtaacttcatcgatcatggtgctggtatgcgcgattaacctctacttcgttgtttcatatttgccatccctaccccaccccgcatacttcgggttggccgctctgttagcagccgcctatctcggcctcagcacctatctggtgtggacgtgctgtctcgctcacggtgctacttttttggcccactcctcccatcatcactttctctacgggctgctggaggaggaccaaaagggggaaacctctggatag

SEQ ID NO: 3584 - DNA, 13035 bp, Artificial Sequence
  Description of Artificial Sequence: Synthetic coding sequence
atggaccccccccggcccgccctgctggccctgctggccctgcccgcactgctcctcctcctgctggccggtgccagggccgaagaggagatgctcgagaacgtctccctggtgtgtccgaaggatgccacaagatttaaacacctgagaaagtacacctacaactatgaggctgagtcctctagcggtgtccctggcacggcagactcccgatccgccacaagaatcaactgcaaggttgagctagaagtgccgcaactgtgtagctttattctgaagacgtctcaatgtactctcaaagaagtatacgggtttaatccagaaggaaaagcccttcttaagaagacgaaaaacagcgaagagtttgccgcggctatgtcccgttacgaactaaaactcgctatccccgagggaaagcaagtgtttctgtaccctgaaaaggacgagcccacttatatactgaacatcaaaaggggtattatcagcgccctccttgtcccacctgaaaccgaggaagccaagcaggtgctttttttagacactgtgtacgggaattgtagcactcacttcacagtgaaaaccaggaaaggaaatgtagcgaccgagatatctacagagagggacttaggacagtgtgacaggtttaaaccaatccgcaccgggatttctcccctggccctaattaaaggcatgacccggccgctctccaccctcatctcttctagtcagtcgtgccagtacactttggatgccaaacggaagcatgtggctgaagcgatatgtaaggagcagcacctttttctgcccttctcctataagaataaatacgggatggtggctcaagtgacccagactctgaaacttgaggatacgccgaagatcaattctagattcttcggcgaggggactaagaagatgggcctggccttcgaatctaccaagtcaacttcacctcctaagcaggcggaagcggtgctgaaaactttgcaagaactcaagaagctgaccatctccgaacagaatatccagagggcgaacctgttcaataaattggtaactgagctgagaggcctgagcgatgaagccgttacttcattgctgccccagctgatcgaggtctcatcgcctatcacattgcaggctctagttcagtgcggtcagccccagtgttcaacccacattttacagtggctcaagcgagtacatgcaaatcccctgctcattgacgtggtgacttacctggtagccttgatccccgagccaagcgcacagcagttaagagagatttttaatatggccagagatcagcggagcagggccaccctgtatgctctgtctcacgccgtgaacaactatcataaaacaaatcctactggaacgcaagagctcctggatatcgccaactacctgatggaacaaatacaagacgactgcaccggggacgaggattacacgtatctgatcttgagagtgatcggcaatatgggtcagacgatggagcaacttacacctgagttgaaaagcagcattcttaagtgtgtccaatctacaaaacccagtcttatgattcaaaaagcagctatccaggccctgaggaaaatggagccaaaagacaaggaccaggaagtactgctgcagacattcctagatgacgcctccccaggagacaagcgcctggccgcctacctgatgcttatgcgtagccccagccaagctgatattaacaagatcgtgcagatcctgccctgggagcagaacgaacaggtaaagaacttcgtcgcctcccacatcgcgaacatcttgaatagcgaggagctggacatacaggacctcaagaagttggttaaggaggccctgaaagaaagccagctgccaactgttatggacttccggaagttctcccggaattaccaactgtataagagtgtttccttgccctctctcgaccctgcctcggccaaaatagaggggaatttgatttttgatccaaataattaccttcctaaggagtctatgttgaaaacaaccctgactgcattcggcttcgcctctgccgatttgatagaaattggacttgaagggaaaggattcgagcccactttagaagcactgtttgggaagcaggggtttttccctgattccgtaaacaaggccttatattgggtgaacggtcaggtgccggatggtgtgtctaaagttctggtcgatcacttcggttatacaaaggatgataagcacgaacaggatatggttaacggaatcatgttgagcgtggaaaagctcattaaggatctgaagagtaaggaagtacctgaagcaagagcatacctccgtatacttggagaggagctgggctttgcatccctccatgaccttcaactgttggggaaactgctgctgatgggcgcaaggaccttacaggggattccccaaatgatcggagaagtgataaggaaaggatccaaaaatgattttttcctgcactacatctttatggagaacgccttcgaattgcctacaggcgctggcctccaattacagatctcttccagtggggtgatagcgcccggcgccaaggccggggttaagctggaagtggcaaatatgcaagctgagcttgtggccaaaccttctgtctccgtcgagttcgttacaaatatggggattatcataccagacttcgccaggtccggagtgcagatgaataccaattttttccatgagagcggtctggaagctcatgtagccctgaaagctggcaagctgaagttcataattccttctcccaagcggcccgtcaaactccttagtgggggcaacacgctacatctggtgtccacaacaaaaacagaagttatcccccctctgatagagaacaggcagtcatggtctgtctgcaagcaagtgttcccaggactgaattattgcacgagcggcgcatactcaaacgccagtagtactgactcagcttcttactaccccctcacgggcgacactcggctggagctagaacttaggccaaccggagaaatagaacaatactccgtgtcagccacatatgagctccaaagagaggacagggccttggttgataccctcaagtttgtgacacaagctgagggagctaaacagactgaagccactatgacgttcaaatataaccgccaatctatgacactcagctccgaggtgcagatcccggatttcgacgtcgacctaggcaccatcttgagggtgaatgacgaatctacagagggcaagacatcctaccgacttaccctcgacattcagaacaagaagatcaccgaggtcgcactgatgggccacttatcctgcgatacaaaagaagagcggaaaatcaagggagtcatttctatcccccggctccaggccgaggcaagatctgagatcctggcccactggagtccagctaagctcctactgcagatggattctagtgcgactgcctatgggtccaccgtgtcgaaacgcgtggcctggcactacgacgaagaaaagattgaattcgagtggaacaccggtactaatgtcgacacaaagaagatgacttcaaatttccccgttgacctgtccgactaccccaaatcgcttcacatgtatgccaaccggctgctcgaccaccgggtgcctcagacagacatgacttttcgacacgtgggcagcaaactgatcgtggccatgagttcctggctccagaaggctagtggcagcctcccttacacacagacgctgcaggaccacctgaattctctgaaagagttcaatcttcagaacatgggcctcccggactttcatattccagagaatctgtttcttaagtcagacgggcgggtcaaatacaccttaaacaaaaacagcctcaaaattgagattccattaccattcggcggtaagagcagcagagatctgaaaatgctcgagaccgtgaggacccccgctctgcatttcaagagcgttggctttcaccttccctcccgggagtttcaggtaccaaccttcactattcccaaactgtaccagttgcaggtccccttgctcggtgtgctcgatctgtcaactaatgtatacagcaatttgtataactggagcgcatcctactctggggggaacactagcactgaccacttcagcttgagagctaggtaccacatgaaggccgattctgtcgttgatctactgtcctacaatgtgcagggttctggagagaccacgtatgaccacaagaatacatttacactgtcatatgacggctccctgagacacaaatttcttgatagtaacatcaagttttcccacgtcgaaaaactgggaaataatccagtcagcaagggcctcctgatcttcgatgcaagcagcagctggggcccccagatgagcgcctctgtccacctggactccaagaagaagcaacacctgtttgttaaagaggtgaaaatagatggacagtttagggtcagttccttttacgctaagggcacgtatggactcagttgccagcgtgaccctaataccggcaggttaaatggggaatccaacctgagatttaatagctcctatctgcagggcacaaaccaaatcacgggcaggtatgaagacgggacacttagtctgacatccacttccgatttgcagagcggcattatcaaaaataccgcctccctgaagtacgagaactatgaacttactctcaagtctgacaccaacggcaagtacaagaatttcgccacgtccaataagatggacatgacattctctaagcagaacgctctgctgcgctccgaataccaagccgactacgagagcctgagattcttcagccttttaagtggttctctcaacagccacgggcttgaactgaatgctgatattctgggaacggataagattaactcaggagctcacaaggccacacttagaattgggcaggacggtatctcaacatcagctaccactaacttgaaatgctccctgctggtcctcgagaatgagttaaacgcagaactcgggttatccggcgcctcaatgaagctcaccaccaatgggagatttcgcgagcacaacgccaagttttctctggatggtaaggcggcactcacagaattgagcttgggcagcgcctatcaagctatgattctgggcgtggattcaaaaaacatctttaatttcaaagtctcccaggaaggactgaaattgtcaaatgacatgatggggtcgtatgccgagatgaagttcgatcacaccaatagcctaaacatcgctgggcttagccttgacttcagttcaaagttggacaatatttactcctcagacaagttctacaagcagacagtgaatcttcagctgcaaccatattcactggtcacaacactaaacagcgatcttaagtacaatgcccttgacctgaccaataacgggaagctgagacttgaaccccttaaactgcacgtggctgggaatctgaagggagcctaccagaataatgagattaaacacatctacgcaatttcaagcgcagcgttgagtgcatcgtacaaagccgacacagtggccaaggtgcaaggcgtggaattctcacaccgcctcaacaccgatatcgcagggctggcaagcgcaattgacatgagtacgaactataactctgactcgttacattttagcaatgtctttcggtccgtgatggctccatttacaatgaccatcgacgcgcacaccaacgggaatgggaaactggccctctggggcgagcacacagggcagctttatagcaagttccttttgaaggcagaaccgctggccttcactttctcacacgactacaagggcagcacaagtcaccaccttgtgtcccggaagtctatatctgccgccctggaacacaaagtgtcagccctgctgacgccggcggaacaaactggtacctggaagctgaagacacaattcaataacaacgagtattcccaagacttagacgcctataataccaaagacaagataggagtcgagctcacggggcgaaccttggctgacctgacgcttctggatagccctattaaggtgcctctcctcctatccgagccaatcaacatcattgatgcgttggaaatgagagatgccgttgagaagccacaagaatttaccatcgtcgcatttgttaagtacgataaaaatcaggatgttcactcaataaacctgccgttctttgaaaccttgcaggagtacttcgaaaggaaccgccagaccataatcgtggtgttggagaatgtccagaggaatttgaagcacatcaacatcgaccagtttgttaggaaatatagagccgccctgggaaaattacctcagcaggctaacgactatttaaactcctttaattgggagcgacaggtcagtcacgctaaagagaagctgacggcgctgacaaagaagtatagaatcaccgaaaatgatatacagatcgcactggacgacgccaagatcaacttcaacgagaaattgtcgcagctccagacttatatgatacagttcgatcagtatattaaggactcttacgatcttcatgacctgaagatcgccattgccaacatcattgatgaaatcattgaaaaactcaagtctttggacgaacattaccacatacgggtgaacttggtgaagacaatccacgacctgcatttgttcatagagaacatcgactttaataaatctggctctagcacggcgagctggatccagaacgtggacactaagtatcaaatcaggatccagatccaagaaaaacttcagcagctcaagcggcacatccagaacatcgatattcaacacctggcggggaagctgaaacagcacatcgaagccattgacgtgagggttttgctggatcagctcggcacgaccatctcctttgaacggatcaacgatatactggagcacgtcaagcattttgtaatcaacttaattggcgatttcgaggttgcagaaaaaataaatgccttcagggctaaagtccatgaactaatcgaacgctacgaggtggatcagcagatccaggttctcatggataagctggttgagcttgcccaccaatacaaattaaaagaaacgatccagaagctgtccaacgtgctgcagcaagtaaaaatcaaagactactttgaaaagttggtcggattcattgatgatgccgtgaaaaagttaaacgaactgtcatttaagacctttattgaagatgtgaataagtttttagacatgcttataaaaaagctgaaatctttcgactaccatcaatttgttgatgaaactaacgataaaatccgcgaagtcacacagaggctaaacggagaaatccaggctcttgaactgccacaaaaggccgaagctttaaaattgtttctggaagagaccaaggctacggtcgccgtgtatctagaatcccttcaggataccaaaatcaccttgataattaactggttgcaggaagctctttcctcagcctccctcgcgcacatgaaagccaaatttcgagagacccttgaagatactcgggatcgcatgtatcaaatggatattcagcaagagctccaacgctacctctccctggtgggccaggtctacagcaccctggtgacctatataagtgactggtggactctggcagccaagaacctcacggattttgccgagcagtatagcatacaggattgggctaagcgtatgaaagcgctggtcgagcagggtttcacggttccggaaatcaagacgatattgggtaccatgccggcttttgaggtctctctccaggccctgcagaaggctacctttcaaactcctgacttcatagtgccactcacagatctgcggataccctctgtgcagattaacttcaaggatctcaagaatatcaaaatccccagcaggttttccacacccgaattcactatcctgaacacctttcatattccttcattcacaatcgacttcgtcgaaatgaaagttaagatcatcagaactatcgatcagatgctcaatagcgaattacaatggccagtacctgacatatatctgagagatttaaaggtggaggatatccccctcgctagaataaccctgccggacttccgcttacctgagatcgccatcccagagtttatcatccccaccctgaaccttaatgatttccaggtgcctgacctacatatccccgaatttcagctgccgcacatctcccatacaattgaggtgcccacctttggcaagctgtattcaatcctgaagatccagagccccctctttaccctcgatgcgaacgccgatatagggaatgggactacctcagccaatgaggcagggatcgcagcctctattactgctaaaggggaatctaaactggaagtcctgaattttgatttccaagcaaatgcccagctcagtaatccaaagatcaaccccttggccctgaaggagtccgtgaagtttagtagcaaatatctcaggaccgaacatggatctgagatgctgttttttggcaacgctatcgagggaaagtcaaatacggtggcgtctctccacaccgagaagaacacactggaactcagtaacggtgtaattgttaaaattaataaccaactgacactggatagcaacactaagtatttccacaagctcaacatccctaagctagacttctccagccaggctgacttaagaaatgagattaaaaccctcctgaaggctggacacatcgcttggacatcatctggcaagggctcttggaaatgggcttgtcctcggttctccgatgaaggtacccacgagtcacaaattagcttcactattgagggacctctcacctcctttgggctgtcaaacaaaattaactctaaacacctaagggtaaatcagaatctagtgtacgagtctggctctttaaatttttccaagctggaaattcagagtcaggtggactctcagcatgtcggacactcggtgttgaccgccaaagggatggccctgttcggcgaaggtaaagccgagttcactggccgtcacgacgcccaccttaacggcaaggttattggcacactgaagaacagcctgttcttcagcgctcagccctttgagataaccgccagcacgaacaacgaaggcaacttgaaagtgagattccctctgcgtcttaccgggaaaattgactttctcaacaactatgcactttttctgagcccaagcgcccagcaagcatcatggcaggtgtcagcgcgtttcaaccagtacaaatataaccagaatttctctgcaggaaataatgagaatattatggaagcccatgtgggtatcaacggggaagcgaacctagactttcttaacataccgctaacaatcccggaaatgcgtctcccatacactatcattacaacacctcccctgaaggacttttccctctgggaaaaaacagggttgaaggagttcttaaaaaccactaagcaaagctttgacctcagcgttaaggcccagtacaagaagaataagcatcgccacagcataacaaatcctttagcagtcctgtgtgagtttatctcgcagagcattaagagttttgacagacacttcgagaagaatagaaacaacgccctggacttcgtcacaaaatcctacaacgagactaaaataaaattcgataaatacaaagccgaaaagtcgcatgatgaactgccccggaccttccagatcccaggctatacagtacccgtggtaaatgttgaggtgtcccccttcactatagagatgagtgcttttggatatgtgtttcctaaggccgtcagcatgccaagcttcagcatcctaggctcagacgtacgtgtgccttcttatacactgattttgccatcacttgagctccccgtgcttcacgtgcccaggaaccttaagctgagcttgccagatttcaaggaactttgtactattagccatatcttcatcccagcgatgggtaacatcacatatgatttctcctttaagagttcagtaataacactgaacaccaatgcggagctctttaaccagagtgatattgtggcccacctgctcagttcttctagttctgtcattgacgcgctgcagtataagctggagggaaccacaagattgacccgtaagaggggactgaagttggctactgcactctctttgtctaacaagttcgtggagggaagtcacaacagcaccgtcagcctgactactaaaaatatggaggtgagcgtggccactacaactaaggcccagatacctatcctccggatgaatttcaaacaagaactgaacggaaacacgaagtcgaaaccgactgtgtctagtagtatggaatttaaatatgactttaacagtagtatgttatattctacggccaagggggccgtcgaccataagcttagtctggagagcttgacatcctactttagcatcgagagctcgacgaagggggatgtaaaagggtcagtacttagccgggagtatagtgggacaattgcttccgaagccaacacttatctcaactctaaatccactcgcagctcggtgaaactgcagggaaccagtaaaattgacgatatctggaatctggaggttaaagaaaattttgctggagaggccaccctccagagaatttactccctgtgggaacacagcaccaagaaccacctgcaactggaggggctgtttttcaccaacggggaacacacctccaaggcaaccctcgagctgtccccttggcagatgtctgcccttgtgcaagtgcacgcctctcagcctagctccttccatgattttccagatctggggcaggaggtagctttaaatgctaatacgaaaaaccagaagattcgatggaaaaatgaggtgcggattcactccgggtcatttcagtcccaggttgaattatccaatgatcaggagaaggcccatcttgacatcgctgggagtttagagggacatctgagattccttaagaatatcattctccccgtgtacgacaaatccctgtgggatttcctgaagttagacgtgaccacttctatcggccgtaggcagcaccttagagtaagcaccgccttcgtgtatacaaagaatcctaacggttattccttctcaatccctgtgaaagtgcttgccgacaagttcatcattcctggactgaagctgaacgacctgaattccgtgctggtcatgccaacgttccacgtcccatttaccgatttacaggtgccctcgtgtaagctagacttcagggagatccagatttacaagaaactgcgaacatcgtcattcgccctcaatctgccaaccttgcctgaagtgaagttccctgaagtggacgtgctgactaaatactctcagccagaagattcgctaatcccctttttcgagatcaccgtccccgagagccaactgaccgtgagtcagtttaccctcccaaagtccgtatcagatgggatcgccgcgctagatctgaatgctgtggccaataaaatcgccgacttcgaacttcctactattatcgtgcccgagcagaccatcgaaattccctcaatcaaattctcggtgcccgctgggattgtgatcccgtccttccaggcgttaaccgcccggtttgaggttgattcccctgtctacaacgccacatggtctgctagcttgaagaataaagcagattatgttgaaaccgtattggacagtacgtgttcaagcaccgttcagttcctcgagtacgagttgaacgtgttagggacacataaaattgaggatgggaccctggcttcaaagacaaagggcaccttcgcccatagggattttagcgcagagtatgaggaggatggcaagtacgagggcctgcaggaatgggaagggaaggctcacctgaacataaaatcgcctgcatttacagatctgcacctccgatatcaaaaggataagaaggggatctcaaccagcgctgcatctccagccgtagggacggtgggtatggacatggatgaagacgatgacttcagcaaatggaacttttactactctccgcagtctagtccggacaagaagctaaccatctttaagaccgagcttcgtgttcgcgagagcgatgaagagacacagattaaggtcaattgggaagaggaggctgctagcggcctgctgactagcctcaaggacaacgtgccaaaggcgactggcgtgctgtacgactatgtgaataaatatcattgggaacatacgggcctcacactgcgcgaggtgagctccaagttgagacggaatctgcaaaacaacgctgagtgggtgtaccaaggcgccatccgtcagatcgacgacattgacgtcaggtttcagaaggctgcgtcagggaccacaggcacgtaccaggaatggaaagacaaggcccagaacttatatcaggaactattaactcaggaagggcaggcctccttccagggcctcaaagacaacgtgttcgacggcctagtcagagtaactcaggagtttcacatgaaggtcaagcatctcatagactccctgatcgactttctgaatttccctcgatttcagttccccgggaagccagggatttatacaagagaggagctgtgtacgatgtttatcagagaagtcggtactgtgctcagccaggtttactcgaaggtgcacaatgggtccgaaatcttattctcctacttccaggatctggttattacgctgccctttgagcttagaaaacacaagttgattgatgtgatttccatgtacagagagcttctgaaggatctgtccaaggaagcgcaggaagtctttaaggccattcagtcactgaagacaaccgaagtcctgcggaatcttcaggacctgctccagttcatcttccagcttatcgaggataacatcaaacagctcaaagagatgaaatttacctacctcatcaactatattcaagacgagatcaacacaatcttttcagattatataccctgcttttag

SEQ ID NO: 3585 - DNA, 798 bp, Artificial Sequence
  Description of Artificial Sequence: Synthetic coding sequence
atgaagaaggaggtgtgcagcgtggccttcctgaaggccgtgttcgccgagtttttagccacactgatcttcgtcttttttggcttgggcagcgccctgaagtggcccagtgccctgccaacgattttacagatcgcattagctttcgggttggcgatagggaccctcgcacaggctctgggtcctgtcagtggtggccatattaatcccgctattactttggcgttgttagtgggaaaccagatttctttgttaagggccttcttctatgtcgcagctcagcttgttggtgcaattgccggagctggaatcctatatggagtggcgcccctcaatgccagaggcaacctggctgttaatgcactcaataataatacgacccagggacaggctatggtggtggaactgatcctcactttccaactggctctgtgcatctttgctagcactgattctcgtcgaacttctcctgttggctcacctgccctgagcataggcctgagcgtgaccctcggacatctcgtggggatttacttcacgggatgctctatgaacccagcaaggagctttgggccagccgtcgttatgaacagattcagccctgcccactgggtgttttgggttgggcccatcgtcggggcagtgcttgccgccattttatatttctatctcctcttccccaattcactcagcttgagcgaacgggttgcaattatcaaaggtacttacgaaccagacgaggactgggaagagcaacgggaagagagaaagaagaccatggaattgaccacacggtag

SEQ ID NO: 3586 - DNA, 993 bp, Artificial Sequence
  Description of Artificial Sequence: Synthetic coding sequence
atgagcgccaagagccggaccatcggcatcatcggcgcccccttcagtaaggggcagcctcggggaggcgtggaagaaggacctacagtgctccgaaaggcaggcttactggagaagctaaaggagcaggttacgcaaaatttcctcattcttgaatgcgacgtgaaggattacggcgatctgccctttgccgatatccctaatgacagcccattccagatagtgaagaatccacgtagtgtggggaaagccagtgaacagttggctggaaaggttgctgaagttaaaaaaaacggacgcatttctctggtactggggggggatcactccctggccattggctctatctctggacatgctagagtgcaccctgatttaggcgtgatttgggttgacgcgcacacagatatcaatactcccctgactacaacgtccggcaacttgcacggccaaccagtttcctttctccttaaggagctgaaaggcaaaattcccgatgtcccggggttcagctgggtgacaccatgcatcagcgctaaggatatagtgtacattggactccgggatgtagacccaggggagcattatatactgaagaccctgggcatcaagtatttctccatgaccgaggtagatcgcctcggaatcggcaaggtcatggaggaaaccctgagctatttactgggtagaaaaaaaagacccatccatctgtcattcgatgtggatgggctcgatccgtccttcactccggctaccggtacaccagttgtaggcggcctgacatatagagaggggctatacattaccgaagagatatataagaccggcctgctgtcaggcctggacataatggaagtgaatccatctcttggcaagaccccggaagaggtcacacggacagtcaacactgcagtggctattacactcgcatgttttgggctcgccagagaaggcaaccataaaccgatagattacctgaatcccccgaagtag

SEQ ID NO: 3587 - DNA, 969 bp, Artificial Sequence
  Description of Artificial Sequence: Synthetic coding sequence
atgagcgccaagagccggaccatcggcatcatcggcgcccccttctccaaagggcaaccccggggcggcgtcgaagaggggcccaccgtgctgcgaaaggcaggcctacttgagaagctgaaggaacaagaatgtgacgttaaagactatggagatctgccattcgccgacatacctaatgactccccatttcaaatcgtaaaaaatcctagaagcgtcgggaaggcttcagagcaactggctgggaaggtggctgaagtcaaaaagaatggcaggatttccttagtactcggaggcgatcattctctggcaatcgggagcatcagcggacatgctcgagtacaccctgacttaggtgtgatttgggtggacgcccatacagatattaacactcccctgacaacaactagcggcaatttacacggccagccggtgtcatttctgcttaaggaactaaagggcaagattcctgatgttcctgggtttagttgggtgaccccgtgcatttctgccaaggatatagtctatataggacttcgtgatgtagaccccggcgaacactacatccttaaaacactagggatcaagtatttctctatgacggaggttgacagattggggattgggaaggttatggaagagacgctgtcttacctactgggaagaaaaaagaggccaattcacctctcttttgacgtcgatggtctagaccccagcttcacccctgcaacaggaacccctgtcgtgggtggtctgacttatagagagggactctacatcacagaagaaatttacaagacaggtctgcttagtggactggacataatggaggttaatccgagcctggggaagacgcccgaagaagttaccagaaccgtgaacacggctgtagccattactctggcctgctttggtctggccagggaaggtaatcacaagcccatcgattacctcaaccctcccaagtag

SEQ ID NO: 3588 - DNA, 711 bp, Artificial Sequence
  Description of Artificial Sequence: Synthetic coding sequence
atgagcgccaagagccggaccatcggcatcatcggcgcccccttctctaaaggacagccaagaggcggggtcgaggagggtcccaccgtactgaggaaagccggcctgctcgagaaacttaaggaacaggagtgcgatgtcaaggattacggcgatctaccctttgctgatatcccaaacgacagccccttccaaattgtaaagaaccctcgatctgtgggtaaggcctccgagcagctggccggaaaggtcgcagaggtgaaaaagaatggccggatttctttggtactgggcggtgatcatagtctagctattggctctatcagcgggcacgctcgagtccatcccgatctgggtgtaatctgggtggatgctcacaccgatatcaacacacccctcaccactacaagtggcaacctccatggccagccagtgagcttcttattgaaggagctgaaaggcaaaatacccgatgtgcctggcttcagctgggtcaccccgtgtatttctgctaaggatatcgtgtatattggattgcgggacgtcgatccaggcgaacattacatactgaaaaccctcggaattaagtacttctctatgactgaagttacccgcactgtgaacactgcggtggccattaccctggcatgctttgggctcgccagagagggcaaccataagcctatagattatttgaacccccctaaatag

SEQ ID NO: 3589 - DNA, 1395 bp, Artificial Sequence
  Description of Artificial Sequence: Synthetic coding sequence
atggccagcgagagcggcaagctgtggggcggccggttcgtgggcgccgttgacccaatcatggagaaattcaacgcctcgatcgcctatgataggcatctctgggaagtcgacgtccagggatccaaagcatatagccgcggactggagaaggccggcctgcttacaaaggccgaaatggaccagatacttcatgggctcgacaaggtcgctgaggagtgggctcaagggacattcaagctcaactcaaacgacgaggacattcataccgccaatgaacggagactgaaagagcttatcggggcaaccgctggtaagctgcacaccggccgaagccgaaatgatcaggtggttacagacctgcgactctggatgcgacaaacatgctccacgctgtccgggctgctttgggagcttattcggaccatggtggatcgagcagaggccgagcgcgatgtcctttttcccggctacacacacctgcagcgcgcccaacccattcgatggagtcattggatactgagccacgcagtagctctgacacgagatagcgagcggctgctggaagtgaggaaacggataaacgtgctcccactgggcagcggagccatcgccggcaaccccctgggagtagatagggaactgctgcgtgcggagttgaacttcggagccataaccctgaatagtatggacgctactagcgagagagacttcgtggcagagttcctgttctgggcttcgttatgtatgacgcatctgtccagaatggcagaggatctcattttgtactgtacaaaagaatttagctttgtgcaactgagcgacgcctacagtaccggtagctctctcatgccgcagaaaaagaaccctgactccctggagctcatcagatccaaagctggtcgcgtatttggacgatgcgccggccttctcatgacactcaagggtcttccaagcacttacaacaaagacttgcaggaggacaaggaggcagtgttcgaggtgtctgatacaatgtcggcggttttgcaggttgccacaggcgtgatctcaacactgcagattcatcaggaaaatatggggcaggcactgagccccgacatgttggcgacagacctagcctactacctcgtgaggaagggaatgccttttcgacaggcgcatgaggcttccggtaaggcggtctttatggctgagaccaaaggcgtcgccctgaatcaattatctctccaggaactgcagactataagccctctcttctcaggggatgttatttgtgtctgggactacgggcacagcgtggagcagtacggcgcgttgggcggcacagcccgctcttcagtggactggcaaattaggcaggtgcgggccctattacaagctcagcaagcctag

SEQ ID NO: 3590 - DNA, 1317 bp, Artificial Sequence
  Description of Artificial Sequence: Synthetic coding sequence
atggccagcgagagcggcaagctgtggggcggccggttcgtgggcgctgtcgatcccatcatggagaagttcaacgcctccattgcgtacgaccgacatctctgggaggtcgatgtacaaggtagcaaggcctattcaagaggtctggaaaaagctggcctgttgacaaaggcagagatggatcagattctccacggcctggacaaggttgccgaggaatgggcacaaggcacattcaaattgaactccaacgatgaggatatccataccgccaacgaaagaaggttaaaagaactcattggtgctacagcaggcaaactccatacagggcgtagccgaaacgaccaggtcgtgaccgacctcaggctatggatgcgtcagacttgttctactctgagcgggctgctgtgggaactgattagaaccatggtcgaccgggcagaggcagaaagagacgttttattccccggatacactcatttacaaagggcccagcccatccgatggtcccattggattttatcaggcgccatagcagggaacccactaggggttgatcgcgaactcctgagagccgaattgaattttggtgccatcacactcaacagtatggatgcgacaagcgagagagattttgtagccgagtttctgttttgggcttctctttgtatgactcaccttagtagaatggctgaggacctcatcttgtactgtacaaaggaattctccttcgtgcagctgagtgacgcatactcgacaggctcctccctcatgccccagaagaagaaccctgactcactggagttaatccgaagtaaggccggccgcgtgttcggcagatgtgcaggtttactgatgaccttaaaagggcttccaagcacctataacaaagatttgcaagaggataaagaggcagtatttgaagtgtcagatacgatgagcgctgtgctgcaggtggcaacaggagtaattagcactctgcagatacaccaggaaaacatgggtcaggcgctgtctcccgacatgctggctactgatctcgcctactatttagttcgcaaaggcatgccgtttcgccaggcacacgaggcctcgggcaaggccgtgttcatggccgagactaagggcgttgccctcaatcaattgagtctgcaagaactgcagaccattagtcccctgttcagtggcgatgttatttgcgtgtgggactacgggcacagcgtggaacagtatggcgctttagggggcacagccaggtccagcgtcgactggcagatccgtcaggtgagggccctcttgcaagctcagcaggcctag

SEQ ID NO: 3591 - DNA, 1335 bp, Artificial Sequence
  Description of Artificial Sequence: Synthetic coding sequence
atggccagcgagagcggcaagctgtggggcggccggttcgtgggcgcggtggacccaatcatggaaaagttcaatgcctccatcgcctatgaccggcacctgtgggaggtagacgtgcaggggagtaaggcatactcacgaggattggaaaaagctggcctgctcactaaggccgagatggaccagattcttcatgggctcgataaagtcgcggaggagtgggcacagggaacattcaagcttaactccaatgacgaggacatacacaccgccaacgagcgaaggctcaaagagttgataggggctacagcaggcaaactgcacacagggcgtagtcgaaacgaccaggttgtgacagacctgcggctctggatgagacagacatgttccaccctcagcgggctgctgtgggagctaatccgcaccatggtcgaccgagcagaagcagaaagagatgtcctctttcctggctacacacacctgcagcgggcacagccaatacgatggtcacattggatactgtcacacgccgtggccctcactcgcgacagcgaacgactcttagaggtaaggaagcggattaatgtgctgcctctcgggagcggcgccatcgctgggaaccctctgggggtcgaccgggagttacttcgcgcggagctgaacttcggagcaatcacattgaatagcatggacgccacatccgagagagacttcgtggccgagttcctcttctgggcatccctctgcatgacccacctttcccgaatggcagaagatttaattctgtactgtactaaagaattctctttcgtccagttgtcagatgcatatagtacaggcagctcattgatgccccaaaaaaaaaatccagattcgttggaactgatccgatctaaagccggaagggtgtttggacgcgaggataaggaagccgtttttgaagtgagcgacactatgtctgccgtgctgcaggtggcaacaggagtgataagtaccctccaaattcaccaagagaatatgggccaggcactctccccagacatgctggcaacagacctcgcgtactacttagtgaggaaggggatgccgttccgacaggctcacgaggcctccggaaaggcggtttttatggctgagactaagggggtggcgcttaatcaattgtctctgcaagaactacagaccataagtcctctgttctccggagatgtgatttgtgtttgggattatggccacagcgtggaacagtatggggcgcttggcgggaccgcccggtcatcagtggactggcagatccggcaagtgcgagcactgctgcaggctcaacaggcgtag

SEQ ID NO: 3592 - DNA, 1395 bp, Artificial Sequence
  Description of Artificial Sequence: Synthetic coding sequence
atggccagcgagagcggcaagctgtggggcggccggttcgtgggcgcagtggacccgatcatggagaagttcaacgcaagtattgcatacgatcgccacctttgggaggttgatgtacaggggagtaaggcatactcccgggggttagagaaagccggactgcttacaaaggctgaaatggaccagatactgcatggcctggataaagtggctgaagaatgggctcaggggacattcaagctgaatagcaacgatgaagacattcatactgcaaatgagcgccgattgaaggaactcatcggcgctaccgccggtaagctgcacacaggtaggagcagaaacgaccaggttgtgaccgatctgaggctgtggatgcggcagacttgctctactctcagcggtctgttgtgggaactgatacgaactatggttgaccgggccgaagcggagcgcgacgtcctgtttcctgggtacacacacctacagcgggcacaaccaatcagatggtcacactggatcctaagccatgccgttgccctcacccgggattccgaacgcttactcgaggtgagaaagcggatcaacgtgttgcctctcggatccggagctatcgccggaaaccccctgggggtcgaccgggaacttttgcgtgccgagctcaattttggagctattactctgaattccatggatgctacatcagagcgggattttgtggccgagtttctgttctgggccagtctttgcatgactcacctgtctcgaatggccgaagatctgatcctgtattgcaccaaggaattcagcttcgttcagctcagtgacgcctactctacaggaagttctctcatgccacagaaaaaaaacccagactcattggagttgattcggagtaaggccggccgcgttttcgggcgatgcgctggcctgctgatgactttaaaaggactgccttcaacttacaacaaggatcttcaggaggataaggaggctgtctttgaagtgtccgacaccatgtctgccgtgcttcaggtcgctaccggggtaataagtaccctccaaatccaccaggaaaacatgggccaggccctgtctcccgacatgctggccacagacctggcctattatctggtacggaagggcatgccgtttagacaggcccacgaagcgtcaggaaaggcggtgttcatggccgagactaaaggcgtggccttgaaccagctgtctctgcaggagctacagacaatatcccctctgttctccggagatgtgatatgtgtgtgggactacgggcattccgtggagcagtacggggccctcggtggaactgcccgcagcagtgtggattggcagatacgccaggtgagggctctcttacaggcacagcaggcctag

SEQ ID NO: 3593 - DNA, 297 bp, Artificial Sequence
  Description of Artificial Sequence: Synthetic coding sequence
atggagaagttcaacgccagcatcgcctacgaccggcacctgtgggaggtggatgtgcaggggtcaaaagcctacagccgaggacttgaaaaagctggcctgctgaccaaggctgaaatggatcagattctgcatggcctcgataaggtcgccgaagagtgggcccagggaaccttcaagcttaactctaacgatgaagatattcatactgcgaatgaacggcgacttaaagagctaataggagctacggcaggcaaacttcacactggccgctcacgcaacgaccaagtgctgtag

SEQ ID NO: 3594 - DNA, 1239 bp, Artificial Sequence
  Description of Artificial Sequence: Synthetic coding sequence
atgagcagcaagggcagcgtggtgctggcctacagcggcggcctggacacatcatgtatactagtgtggctcaaagagcaaggctacgacgtgatagcctacctggcaaacatcgggcagaaggaagattttgaagaagccagaaagaaggcgctcaagctaggtgcaaagaaggtttttatcgaggatgtctccagggaattcgtggaagaattcatctggcccgcaatccagtcaagtgccctgtatgaggatcgttatctcttaggtacaagtctggcgcggccctgtattgctcgcaagcaggtcgaaattgcacagagagagggggcaaaatacgtgagccacggggcaaccggcaaagggaatgaccaggtgcggtttgaactcagctgctactctttggcacctcagatcaaggtcattgcaccttggaggatgcctgaattttacaatcgatttaagggtagaaacgatctgatggaatatgccaagcagcatggaatcccgattccagttacacctaaaaatccctggtctatggacgaaaacctgatgcatatctcttacgaagccgggattttggaaaaccctaagaaccaagcccccccaggtctatacactaagactcaggatccagctaaggcgccaaacacccctgacatcctggagattgagtttaagaaaggagtgccggtaaaagtgaccaacgtgaaggatgggacaactcaccagactagcctagagttatttatgtacctaaacgaagtcgcaggaaaacatggagtcggcagaattgatattgtggaaaatcgcttcattgggatgaagagccggggcatttacgaaacaccggctggcaccatcctgtaccacgcccatttagatatcgaggctttcaccatggatcgcgaagtgcgcaaaattaagcagggactcgggctgaagtttgcagagttggtatacactggcttctggcactcacctgaatgcgagtttgtgcggcactgtatagctaaaagccaggaacgggtggaaggtaaagtacaggtttccgtactgaaggggcaagtttacattctcggcagagaatctccgctctccctgtataacgaggagttggtgtctatgaatgtgcagggtgattacgagcctaccgacgcaacgggtttcataaatatcaattccttacggctaaaagagtaccatcgcctgcagtctaaagtcacagcaaagtag

SEQ ID NO: 3595 - DNA, 1239 bp, Artificial Sequence
  Description of Artificial Sequence: Synthetic coding sequence
atgagcagcaagggcagcgtggtgctggcctacagcggcggcctggatacctcttgtatcctcgtttggctcaaggaacaagggtatgatgtgatagcctacctcgccaatatcggccaaaaggaggactttgaagaggcccgcaaaaaggcattgaaactaggcgcgaaaaaagttttcatcgaggacgtgagccgcgaattcgtagaagagtttatctggcccgccatacagtctagtgcactgtacgaagaccgctatctcttgggtaccagtctggctcgtccatgtatcgcccggaaacaagtggagattgcgcagagagagggcgctaaatatgtatcccacggcgccacagggaaggggaatgatcaggtaagatttgaactgtcatgttacagtctggccccacaaatcaaggtgatcgcaccttggcggatgccagagttctataaccgtttcaaaggcagaaacgacctcatggaatacgcaaagcagcacggtatccccatccctgttacccccaagaacccatggagcatggacgagaatctcatgcacataagctatgaggcgggaatactggagaatccaaaaaaccaagcaccaccggggctgtacaccaagacacaggaccctgccaaggcccccaatacacctgacatactggagatagagttcaagaaaggggttccggtgaaggttacgaatgtgaaggatgggactactcaccagacgtccctcgagctgttcatgtacctgaatgaggtagcagggaagcatggtgtcggccgcatagacatcgttgagaacagatttatcggcatgaaaagcagaggaatatacgagaccccagctggcacaatcctgtaccacgctcatcttgatatcgaggcctttacaatggaccgcgaggtgcggaaaatcaaacaggggttaggtctaaagttcgcagagctggtgtacaccggcttctggcattccccagaatgcgagtttgttagacactgcatcgcaaagagccaggagcgtgttgaaggaaaggttcaggtaagtgtgttaaaaggccaggtgtatatcctagggcgtgaatccccactcagtctgtacaacgaggaactcgttagcatgaatgttcagggtgactatgagcctacagacgctacagggtttatcaatatcaactcgctgcgcttaaaagaataccatcgcctgcaaagtaaggtcacggccaaatag

SEQ ID NO: 3596 - DNA, 510 bp, Artificial Sequence
  Description of Artificial Sequence: Synthetic coding sequence
gagcccggccccctgcagctgatggtggtggccgaggcccagggcggcaagcacggagttgggcgcatcgatatagtggagaacaggtttataggcatgaagtccagaggaatttatgagaccccggccggcactattctgtatcacgctcacctagacatcgaggccttcaccatggacagagaggtgagaaagatcaaacaggggcttggactcaaatttgccgagctggtgtacaccggcttttggcacagtcctgagtgtgaattcgtgagacactgtattgctaaatcccaggaacgagttgaaggaaaagtccaggtcagcgtgctgaagggtcaggtgtatattctggggagagagagtcccctgtccctttacaatgaagagttagtctccatgaacgttcagggcgactatgaacccactgacgcgactgggttcatcaacatcaatagcttgaggttgaaggaatatcataggctacagagcaaagttactgcaaaatag

SEQ ID NO: 3597 - DNA, 1239 bp, Artificial Sequence
  Description of Artificial Sequence: Synthetic coding sequence
atgagcagcaagggcagcgtggtgctggcctacagcggcggcctggacactagctgcatcctggtctggctcaaggagcaaggctacgacgtgatcgcctaccttgctaatatcgggcagaaggaagactttgaggaagctcggaagaaggctctgaagctgggggctaagaaggtctttatcgaggacgttagcagggagtttgtggaagagtttatctggccggctatccagagttcagcgctttacgaagacaggtacctcctggggacctcacttgcaaggccctgcatcgcaaggaaacaggtagaaatcgcccagcgggaaggcgcaaagtatgtatcacacggcgctaccggcaagggcaatgatcaagtcaggtttgagctgagctgctattctctggcccctcagatcaaagtgatagctccatggagaatgcctgagttctataatcgcttcaagggaagaaacgacctaatggagtacgctaaacagcacgggatcccaatccccgttactcctaagaacccatggagtatggatgaaaatctaatgcacatctcctatgaagccggaattctggagaaccctaagaatcaggctcctcccggactgtatactaagacccaagatccagcaaaggcaccaaacacacccgatattctggagattgagttcaaaaagggagtccccgttaaggtgacaaacgtgaaggacggaactacccaccagacatccttagaattgtttatgtatctgaacgaagtagcaggaaagcatggcgtggggagaattgatattgtggaaaataggtttataggcatgaaaagtagaggcatctacgaaacacccgctggaacgatcctgtaccacgcacacctggacattgaggccttcacaatggatagagaggtgaggaaaattaaacaggggctgggtctaaaattcgccgagttggtgtataccggcttttggcatagcccagagtgcgagtttgtgcggcattgtatcgccaaaagccaggagcgagtggagggcaaagtccaggtgagcgtgctgaaagggcaagtctacatcctgggccgcgagtcccccctctcattatataacgaggagctcgtttcaatgaacgtgcagggagactacgaacctacagacgcgaccgggttcattaacatcaattcgctgaggttaaaggaatatcaccggctgcaatctaaggtgaccgctaaatag

SEQ ID NO: 3598 - DNA, 1239 bp, Artificial Sequence
  Description of Artificial Sequence: Synthetic coding sequence
atgagcagcaagggcagcgtggtgctggcctacagcggcggcctggacacctcctgtatactggtgtggcttaaagaacaggggtatgatgtcatagcttatctagcaaatattgggcagaaagaggattttgaggaagccaggaaaaaggctctcaaactgggggctaagaaggtctttatcgaggatgtctcccgcgaattcgtcgaagagttcatttggccagccattcaatccagcgctctctatgaggatcggtacttacttggaactagtttggctcggccttgcatcgccagaaaacaggtcgagattgcccaacgcgaaggcgccaaatacgtcagccacggagcaacgggcaaagggaatgatcaggtgcggtttgagctgtcctgttactctctggctccacaaatcaaagtcatcgcaccctggagaatgcccgagttctacaatcgctttaagggcagaaacgatctgatggaatacgccaagcagcacggaattccaattccggtgactccaaagaatccgtggagtatggacgaaaatctaatgcatatctcctatgaggcggggattctggaaaatccaaagaaccaggcacctcctggtttgtataccaagacacaagaccctgccaaagccccaaataccccagatatcctcgaaattgagttcaagaagggggtgccagtgaaagtcacaaacgtgaaggatggcaccacccatcagacctcactggagttattcatgtatctgaacgaagtcgccggcaaacatggtgtgggccggatagacattgtagagaatagatttatcgggatgaagtctaggggcatttatgaaacgccggctggaaccattctttaccacgcccacctggatatcgaagcgttcaccatggatcgtgaggtacggaaaattaagcaggggctggggctcaagtttgccgagcttgtttacaccggtttctggcacagccctgagtgtgagtttgtccgtcattgcatagctaagagtcaggagagagtggagggaaaggtgcaggtgtctgtactgaaaggacaagtatacattctgggccgcgagagtcctctctcactctacaatgaagagctggtctcgatgaacgttcagggggattacgaaccaaccgatgcgacaggctttattaacataaactccctgaggttgaaggagtaccaccgtctgcagagcaaggtgaccgcaaagtag

SEQ ID NO: 3599 - DNA, 597 bp, Artificial Sequence
  Description of Artificial Sequence: Synthetic coding sequence
atgagcagcaagggcagcgtggtgctggcctacagcggcggcctggacacatcttgcattctcgtttggctgaaagaacagggttacgatgtgatcgcctatttggcgaatattgggcagaaggaagactttgaggaggcccgcaaaaaggcccttaaactgggtgccaagaaggtctttattgaggacgttagtagagagttcgttgaggaattcatctggcctgccatccagtccagcgcgctctatgaggatcggtacttgctcggcaccagtctggctcggccttgtatcgctcggaaacaggtcgagatagcacagagagagggagccaagtatgtctcacacggcgcaacgggaaagggaaatgatcaggtgcgatttgagctctcttgctatagcctggcacctcagattaaggtgatcgccccttggcgcatgccagagttctataacagatttaagggtagaaatgacctgatggaatacgctaagcagcacgggatccctatacctgtaacccccaaaaacccctggagtatggatgaaaatttaatgcacatctcctatgaagccggcatcctggagaacccatag

SEQ ID NO: 3600 - DNA, 540 bp, Artificial Sequence
  Description of Artificial Sequence: Synthetic coding sequence
atgagcagcaagggcagcgtggtgctggcctacagcggcggcctggacacatcttgcattctagtgtggcttaaagaacagggatacgacgttattgcgtacctggcaaatattggccaaaaagaagactttgaggaggcccgcaagaaagcgctgaaactgggcgcgaaaaaagttttcattgaagatgtgagtcgcgaatttgtggaggaattcatctggccagccattcaatcatccgctctctatgaggacaggtatctcctcggcacaagcctggcccgcccctgtatagccaggaaacaggtggaaattgcgcagcgcgaaggggccaagtacgtctctcatggcgccaccggcaaagtgatagcgccctggaggatgccagaattttataatcgcttcaagggaagaaacgatcttatggagtatgccaagcagcacgggattcctataccagtgactccgaaaaatccatggagtatggacgagaacttaatgcatatcagttatgaagcaggcatactggagaacccttag

SEQ ID NO: 3601 - DNA, 663 bp, Artificial Sequence
  Description of Artificial Sequence: Synthetic coding sequence
atggagctgggcctgggcggcctgagcaccctgagccactgcccctggccgaggcaacagcccgccctttggcccacgctggccgctttagccctactttcgtcggttgctgaggcaagtctgggatcggccccaagatcccctgcaccaagagaaggcccaccccctgtcctggccagccccgcggggcatctgcccggtgggcgaaccgctaggtggtgttctgggagagcccgtagaccaccacctcagccaagcaggcccgcccctccaccgcccgctcccccatccgctcttccacggggtggacgagcagctcgtgccggaggccccgggtctcgggctcgggcagcgggcgctcgcggatgccggctgcggtcacagcttgtgcctgtcagggctctgggattaggccaccgctcagacgagttagtgcggtttcgtttctgcagcggaagctgccgccgggctagaagccctcacgacctcagcctcgccagtctgttgggagccggggccctgcggcccccaccaggcagccgccctgtgtctcagccttgctgtagaccaacaaggtatgaggcagtcagctttatggatgtcaactccacctggaggacggtcgacagactctcagccaccgcttgtgggtgcctggggtag

SEQ ID NO: 3602 - DNA, 663 bp, Artificial Sequence
  Description of Artificial Sequence: Synthetic coding sequence
atggagctgggcctgggcggcctgagcaccctgagccactgcccctggccccgacagcagcctgcgctctggccaaccctagccgctcttgctcttctctcaagtgtcgccgaagcaagtctgggatcggcccctcgcagccctgcgccacgtgaagggcccccccctgtgctcgcctctccggccgggcatcttcctgggggacgtacagctaggtggtgttccggaagagcccgcagaccacccccccaaccatctagacccgctccacctcccccagccccaccaagtgccttacccagaggggggcgcgccgctcgggccggagggccaggaagtcgagctagggcagcaggcgctagaggctgtaggctgcggtcccagttggtgccggttagggctctgggactcgggcatcgctcagatgaattagtgcgcttccgcttttgtagtggcagctgtcggagagcaagaagcccccacgatctatctctggcctctctgctgggggccggagctctgcggccccccccaggatctcgacctgtgtcacagccatgctgcaggcccacaagatatgaagccgtgtcatttatggacgtgaattcaacctggagaaccgtggatagactgtctgcgactgcctgcggctgcctgggttag

SEQ ID NO: 3603 - DNA, 687 bp, Artificial Sequence
  Description of Artificial Sequence: Synthetic coding sequence
atggagctgggcctgggcggcctgagcaccctgagccactgcccctggcctaggcaacaagccccactgggtctatccgcccagcccgcactgtggcctaccctcgctgccttggctttgcttagcagtgtggccgaggcctccctgggctctgcgccccggagtcccgcccctcgggaagggcccccgccggtgctagctagcccggcgggtcacctaccaggcggccgaaccgccaggtggtgctccggacgagccagacggcctccacctcagccatcccgccctgcccctccaccccccgcccctccgagcgccctcccgcgcggtgggagggcagctagggccggcggcccggggagccgtgcacgtgccgctggcgcaaggggctgtaggctgcgcagccaactcgtgccagtccgcgcactcgggctggggcacaggtccgatgagctcgtgcgctttagattttgcagtgggtcatgtcggcgtgccagatcaccccacgacttgtcccttgcaagtctgcttggagccggcgcgcttaggccgcctccagggagccgtcccgtctcacaaccttgctgccgccccacaaggtacgaagccgtgagttttatggacgtcaactctacatggaggaccgtggatagactctccgcgacggcttgtggatgcctcggctag

SEQ ID NO: 3604 - DNA, 201 bp, Artificial Sequence
  Description of Artificial Sequence: Synthetic coding sequence
atggagctgggcctgggcggcctgagcaccctgagccactgcccctggccccggcaacaacccgcactttggcccaccctcgctgcccttgctctgctttcctcggttgcggaggcctccctgggaagcgctcctaggtcgcctgctccacgcgaaggtcctccccccgtgctggcaagcccggcaggacacctcccgtag

SEQ ID NO: 3605 - DNA, 270 bp, Artificial Sequence
  Description of Artificial Sequence: Synthetic coding sequence
atggagctgggcctgggcggcctgagcaccctgagccactgcccctggcctaggcagcaggcccctctcggcctgtcagctcagccggcactgtggcctacactcgctgctctcgcccttctctcatcagtggctgaggcaagccttggctcagccccaagaagccctgctccacgcgaaggaccgcctccagtactcgcatcacctgccggccacctgcctggaggccgcaccgcgcgctggtgttccggaagggcccggaggccctag

SEQ ID NO: 3606 - DNA, 201 bp, Artificial Sequence
  Description of Artificial Sequence: Synthetic coding sequence
atggagctgggcctgggcggcctgagcaccctgagccactgcccctggccccgtcaacagccagcactgtggccaacattagctgcgttggctctgctctcgagtgtggccgaagcaagtcttggctctgctcccagatcccctgcacctagagaaggacctcctccggtgctcgcaagcccagccggccatctgccctag

SEQ ID NO: 3607 - DNA, 270 bp, Artificial Sequence
  Description of Artificial Sequence: Synthetic coding sequence
atggagctgggcctgggcggcctgagcaccctgagccactgcccctggccccggcagcaagcacctctcgggctatctgcacaaccagctctgtggcctactttggcggccttagcactcctcagtagcgttgccgaggctagtctagggtctgctcctcgctccccagcccccagggagggccctcctccagtcctggccagccccgctgggcatttgcctgggggaagaactgcccgatggtgctccggtagagcccgcaggccatag

SEQ ID NO: 3608 - DNA, 687 bp, Artificial Sequence
  Description of Artificial Sequence: Synthetic coding sequence
atggagctgggcctgggcggcctgagcaccctgagccactgcccctggccccggcagcaggcacccctgggactgagcgctcagccagctctgtggcctaccctggctgctctggctctactcagttcagttgccgaggctagcctaggaagcgctccccggagtccagctccccgcgaagggcctcctcctgtgctcgcctcacctgcgggacatctgcccggaggtagaactgcacggtggtgttcaggcagagcacgccgaccccctccgcaaccatcccgaccagcacctcccccaccagctcctcccagcgccctcccacgcgggggccgcgcagctcgcgccggcgggcccggaagccgcgcacgcgccgccggggccagggggtgcagattgcgctcccagctcgtccccgtgcgcgcattaggactaggacaccgctccgacgagctggtaagatttagattctgttccggcagctgcaggagggcacgctccccccacgacttatctctcgcaagcctgctgggtgcaggcgccttgcgtcccccaccaggatcccggcctgtctcccaaccatgctgtagaccaactaggtatgaggctgtgtcattcatggacgtaaactcgacttggcgcaccgtggaccggctgagtgccactgcctgtgggtgcctcgggtag

SEQ ID NO: 3609 - DNA, 1602 bp, Artificial Sequence
  Description of Artificial Sequence: Synthetic coding sequence
atgggcccccggggcgccgccagcctgccccggggccccggcccccgccggttgctgttacctgtggtacttccgctgctcttgctacttctgctggcaccgccagggagtggggccggagcctccagaccaccccacctggtgttcctcctcgcggacgatctgggctggaacgatgtggggttccatgggagtaggattcgaactccccaccttgacgcgcttgccgccgggggcgtgctgttagataactactacacccagcctctctgcacgccctctagaagtcaactcctcaccggacgctatcagattaggactggcttgcaacatcagatcatttggccctgccagcccagttgcgttccactcgacgagaagctgcttccccagctgcttaaggaggctggctacaccacgcatatggtcggcaagtggcacctgggcatgtataggaaagagtgtctgcccacccgtcgtggatttgacacatatttcggctacctgctggggtcagaagattattattcgcacgaacggtgtacgctcattgacgccctaaatgtcacacggtgtgcccttgattttagagatggcgaggaggtcgccaccgggtacaaaaatatgtatagtaccaacatcttcacaaagagggcgatcgcactcatcactaatcatccccctgaaaagcccctgttcctgtatctggccctccaaagcgtccacgaaccacttcaggtccccgaggagtatctgaagccttacgactttatccaggataagaaccggcatcattatgccggaatggtcagtctgatggacgaagctgtgggtaacgttactgcagccttgaagagctctggtctgtggaataacaccgtcttcatttttagcacggataatggcggacagaccttggcaggaggaaataactggcccctgagaggcaggaagtggtccctctgggaggggggggtcagaggagtcggcttcgtcgcctctccgctccttaaacagaagggtgtgaagaaccgggaattaatccacattagcgactggcttcccacactggtgaagttggccagaggacacactaacgggacaaagccacttgacggattcgatgtatggaagacgatttccgaaggtagcccttccccccggatagagctgctacataacatagatcctaatttcgtagatagcagtccatgccctaggaacagcatggcgccagctaaagacgattctagtctgccggagtactcggcattcaacaccagcgtacatgccgcaattcggcacggtaactggaaactcctcaccggatatccgggttgtggttactggttccctcctccttcccagtataacgtgagcgagatccccagctctgatccgcctacaaaaaccctctggctgttcgatattgatagggaccccgaggagagacatgatttgtcacgcgagtacccccatattgtgaccaaactccttagccgcctccagttctatcacaagcactctgtccccgtttacttccccgctcaggatcctaggtgcgatcctaaagcaactggagtgtggggaccctggatgtag

SEQ ID NO: 3610 - DNA, 1602 bp, Artificial Sequence
  Description of Artificial Sequence: Synthetic coding sequence
atgggcccccggggcgccgccagcctgccccggggccccggccccagacggcttttgctgcctgttgtcctccccctcctgctactgctgctgctggctccaccaggctccggagccggagcaagtaggccaccccatctagttttccttctggcagatgatctggggtggaacgatgtcgggttccatggctcgaggatccgcaccccccacttggacgctctagctgccggcggcgtcctgttggacaattattacacacagccactgtgtacgcccagccggtctcagttactgaccggccggtatcagattcgcaccggtctccagcaccagatcatctggccctgccagccttcttgcgtgccactggatgaaaaactgcttccccagctgttgaaggaggcaggttacacgacacacatggtgggcaagtggcacttaggaatgtacaggaaagagtgtcttcccactagaaggggttttgatacatatttcggttaccttctgggaagcgaagactattactctcatgaacgctgcacgcttatcgacgcccttaacgtgactcggtgcgccttggactttcgtgatggtgaagaagtggccactggatacaaaaacatgtacagcaccaatatcttcacgaagcgcgccattgctctgataacaaatcacccacctgagaaaccactcttcctgtacctcgccctgcagtctgtccacgagccactgcaggtgccggaagagtatctcaagccttacgacttcatacaggataaaaatcgtcatcattacgccggcatggtgagtttaatggatgaagccgtcggcaacgttactgccgccttgaaatctagcggcttgtggaacaatacagtctttatcttttctactgacaacgggggtcagactttagctggaggaaataattggccccttcgaggccgaaagtggagcctctgggagggcggagtccgcggtgtcggctttgtggcaagccccctgctgaagcaaaagggtgtgaaaaatcgagaattgattcatatatcggactggctgccgacactagtgaaactagcccgcggacacaccaacggcacaaaacctctggatgggtttgacgtgtggaagacaatcagcgaagggagcccgtcaccaaggattgaactcctccacaatatagaccctaatttcgtcgactcaagcccctgccccagaaacagcatggctcccgccaaggatgatagcagtttgcctgaatacagcgcatttaacacttctgtccatgccgccatccgccacgggaattggaaattgctcaccggatatcctggctgtggttactggttcccacccccttctcagtacaacgtctcagaaatcccttcctctgacccccctaccaaaacgctgtggctatttgatatcgatagagatcccgaggaaagacatgatctctcaagagaatatccgcacatagtcaccaagctcctttcacgtctccagttctaccacaaacactctgtgccagtgtacttccctgcacaggatccacggtgcgatcctaaggccacgggcgtctgggggccatggatgtag

SEQ ID NO: 3611 - DNA, 1242 bp, Artificial Sequence
  Description of Artificial Sequence: Synthetic coding sequence
atgggcccccggggcgccgccagcctgccccggggccccggccccagaagactgctgctcccggtcgttctgcctctgttactgctcctgttgctggctccgccaggcagcggagccggggcttcacgaccacctcatctggtctttttgttggctgacgacctgggttggaacgacgtgggatttcatggcagccgcatcagaacccctcacctggacgcactggcagcggggggagtgcttctagataactactatactcaacccctgtgcacccctagccggagtcagctgcttacaggtcgctatcagatacgaactggcctgcagcaccagataatttggccctgccagccctcctgcgtgccactagacgagaagctgctcccccagcttcttaaggaagccggctatacaacccatatggtgggtaagtggcacctcggaatgtaccgaaaagaatgcctccccactaggcgggggttcgatacatacttcggttatctcctgggctcagaggattattacagccatgagcggtgtactttgattgatgccctcaatgtgacccggtgcgcactggatttccgggatggggaggaagtcgctacagggtataagaatatgtactctacaaatatattcaccaagcgagcgatagccctgatcaccaatcatccacccgaaaaacctctcttcttgtatctggctttgcagagtgtgcacgagccgctgcaggttcctgaagagtacctgaagccatatgacttcatccaggacaagaacagacaccactacgcggggatggtgagccttatggacgaagcggtgggcaacgtgaccgcggcacttaaaagctcaggtttgtggaacaacactgtctttatcttcagtactgataatggaggccagacactggctggtggtaacaactggccacttcgaggccgcaaatggagcctgtgggaaggcggcgtgagaggcgtggggtttgtggccagccctctgttaaagcagaaaggggtgaagaacagagaactgatccacatcagtgattggctacccactcttgtcaaactggcccggggtcatactaatggtacgaagcccctggacggatttgatgtgtggaaaacgattagtgagggctctcctagcccgcggatcgagttgctccataacatcgaccccaattttgtggattcaagcccatactggccggaatgctcactgctcctgtag

SEQ ID NO: 3612 - DNA, 138 bp, Artificial Sequence
  Description of Artificial Sequence: Synthetic coding sequence
atgggcccccggggcgccgccagcctgccccggggccccggcccccgccgactgctgctgccagtggtgcttcctttgctactcctgcttttgctcgcgcctccaggcagtggggctggggcatctaggcctccatag

SEQ ID NO: 3613 - DNA, 1788 bp, Artificial Sequence
  Description of Artificial Sequence: Synthetic coding sequence
atggccggccccagcccccccctgcgggccggcgtgggccggcggcttcttggggtagcccacccggacctgagaccatgcttgtgcggtgaactgcaggtggagggaggcccgggccccgtccctggcatgttgcgaacgtgctatgtgagatcgccgtggaggagaggacctagttcagctcgtggcgaacagtctggctctggtcaccttgagcaggaggaagtacagtccggctctctgttgtttagacttctcctcttcttgagcagaagccccgcgtccagaaaccagcgaatcttgtacaccgtgttggagtgtcagcctctgttcgatagctctgacatgaccattgccgagtgggtatgcttggcacaaacaatcaaacggcattatgaacagtaccacgggttcgtggtaattcacgggacagataccatggcttttgcagcaagcatgttgtcattcatgttagaaaacctgcagaaaactgtgatcctgacaggcgcacaagttcctattcacgccctgtggtcagatggcagggagaatttgctaggggccttattaatggctggccagtacgtaatcccagaggtgtgtctattcttccagaatcagctcttcaggggaaaccgggccactaaagtcgacgcacgcaggttcgctgctttctgttcacccaacctcctccccctagccacagtgggagctgacataactatcaaccgagagctggtcaggaaggtagatggcaaggccggtttggtggtccattctagcatggaacaggacgtcgggctcctgaggctctaccctggaatacccgccgcacttgttagagcattccttcagcccccactgaaaggtgtcgttatggaaacttttggctcaggcaatggacccaccaagcctgacctgctccaggagctgcgggtggcaaccgaaaggggtctagtcattgtcaattgcacccactgcctgcagggtgcggtgacaaccgactatgccgccgggatggctatggcgggtgcaggagtcattagtggtttcgacatgacaagcgaggcagcattagccaagctctcctatgtactcggacagcccggcctctcgttagacgtcaggaaggagctactgacgaaggatttgcgcggcgagatgacccctccttccgtcgaagagagacgtccatcacttcaaggcaacactcttggcggcggtgtgagttggttactcagccttagcggatcacaggaagccgatgccctcagaaatgccctggtcccgagtctagcttgtgcggctgcccatgccggtgatgtggaggcacttcaggcactggtggagttgggcagtgatctgggcctggtggacttcaatggtcaaacaccgctgcacgcggcagctagaggaggacacacagaggccgtaacaatgctattacagagaggagttgacgtaaacactcgggacacagacggtttctcacccttgctgctagcagtgaggggtcgtcatccaggcgtgatcggactgttgagagaagctggtgctagcttgtctacacaggagctggaggaggccggcaccgagctgtgccgcctagcctacagggccgacctggaggggttgcaagtttggtggcaagctggagccgacctgggccaacccggctacgatgggcattccgctctccatgttgccgaggctgccggtaatctggctgtcgtggcctttttacagtctctggaaggtgctgtcggagcacaggccccttgtccctag

SEQ ID NO: 3614 - DNA, 1740 bp, Artificial Sequence
  Description of Artificial Sequence: Synthetic coding sequence
atggcccgggccgtgggccccgagcggcggctgctggccgtgtacaccgggggcaccattggcatgaggagtgaactgggagtgctcgtcccgggtaccggacttgccgccattctgagaactctgcccatgttccatgatgaggaacatgccagggctcgtggattatcggaggatacccttgtgctgccaccagcctccaggaaccaacgtatactctacaccgtgctggaatgccagcctctgtttgattcgtcagacatgacgatcgctgaatgggtgtgtttagcccagactatcaaacgtcactacgaacagtaccatggcttcgtggttatccacggaacagatacaatggcgttcgccgcctcgatgctaagtttcatgttagagaatctacaaaaaacggtgatcttgacaggcgctcaggtaccaatccatgctctgtggtcagatggccgagagaacctgttgggagcccttctgatggcaggacagtacgtcatccctgaggtctgcctgtttttccagaatcagctgttcagggggaatagagcgacgaaagtggatgccaggaggttcgccgcgttttgcagcccgaaccttctcccgctggccacagtgggggccgatatcacgattaacagagaactcgtgaggaaagtggacgggaaggctggtctggttgtccatagttctatggagcaggacgtggggctgctacggctataccccggtatcccggccgccctggtacgggctttcttacaaccgcccctgaaaggggtcgtgatggagacttttggctccggcaatggccccacaaaacctgatctccttcaggaactgcgcgtagctacagaaagaggactggtcatagttaattgcacgcactgtctacagggcgcggttacaaccgactacgccgccggaatggccatggcaggcgctggggtgattagcgggttcgatatgacaagcgaggccgccctcgctaagctctcgtacgtgctaggccagccggggcttagcctagatgtccgcaaagaactcctgactaaggacctcaggggcgagatgacaccccccagcgtcgaagagcggcggccctccctgcagggcaataccctaggcggtggagtgagctggcttttatctttgagcggatcacaggaggccgatgcccttcgaaacgccctggttccctccctggcctgcgccgctgcacacgcgggtgacgtggaggcgttgcaggccctggtcgaattggggtccgacctgggactggtcgattttaacggacagacaccactccacgcagctgcccgggggggccatacggaagctgtcacaatgctgctgcaacggggtgtcgacgtcaatacacgcgatactgacgggtttagccctttgctactggctgtgcgggggcgccaccctggtgttatcggactgctgagggaagcgggtgcatcactatctacccaggagctcgaagaagctggcaccgagctgtgtcgccttgcctaccgtgccgacctggagggactgcaggtgtggtggcaggcgggagcagatctggggcaacctggctacgacggtcactccgcgctgcacgttgcagaagcggccggaaatctcgccgttgtggcctttctccagagcctcgaaggcgctgtgggggcacaggcaccctgcccagaaccatcgtgctttcaagaggtcctcccaggtgtctag

SEQ ID NO: 3615 - DNA, 423 bp, Artificial Sequence
  Description of Artificial Sequence: Synthetic coding sequence
gccgccgcccggggcggccacaccgaggccgtgaccatgctgctgcagcggggagtggatgtcaacacccgtgacacagacggattttccccactcctgctggccgtgcgtggaagacatcctggggtcattgggctgctgcgcgaggcgggcgcatccctctctacccaagagctcgaggaggcagggacagaactttgtagactggcttaccgggctgacctcgaaggactgcaggtgtggtggcaggccggagccgacctcggccagcctggctatgatggccactcggctttgcatgtggccgaggcagcgggaaacctcgctgtcgtggccttcctgcagagcttggagggcgccgttggggctcaggcaccatgcccagagccgagctgctttcaggaggtgttaccaggtgtgtag

SEQ ID NO: 3616 - DNA, 1722 bp, Artificial Sequence
  Description of Artificial Sequence: Synthetic coding sequence
atggcccgggccgtgggccccgagcggcggctgctggccgtgtacaccggtgggaccattggaatgcggtccgagcttggcgtgctcgtgccaggtacaggtttggcagcaatactgagaaccctgccaatgtttcacgatgaagaacacgctcgagctcgcggcttatctgaagacactctggtccttccccctgcctcccggaaccagcggattctgtatacggtcttagaatgtcagccactgttcgattcatccgacatgaccattgcagagtgggtgtgcctcgctcagacaatcaaacgccattatgagcaatatcacgggttcgtggtgattcatggcaccgacacaatggcttttgcagcctcaatgctgagttttatgctggagaatttacagaagacagtgatcctgacaggtgcccaggtgcccatccacgcactgtggagcgacggccgcgagaacctcctgggggccttactgatggctggccaatatgtcattcctgaggtgtgcttgttctttcagaatcagctcttccgcggtaaccgcgcgacaaaagtggatgcccgccgattcgctgccttctgttcccctaatctgctaccgttggcaactgtcggagcagatatcacaataaacagggagctcgtgagaaaagtcgacgggaaggctggactggtggtccatagctctatggaacaagacgttggccttcttagattgtatcccggcatccctgccgccctcgttcgggcctttttgcaacctcctctgaagggagtggtcatggagacatttgggagcggcaatggacctacgaagcctgaccttttgcaagagctccgagtggccacagagagggggctggtgatcgttaattgtacacattgcctgcagggggcagtgaccaccgattacgccgccggaatggctatggctggagcaggtgtaatctctgggttcgacatgaccagcgaggctgctctcgctaaattgtcttacgtgctggggcagcccggattgagccttgacgtcaggaaagagctgctgactaaggacctccgaggcgagatgaccccacccagcgtggaagagcgcagaccatccctgcagggcaacacgttgggaggcggcgtcagttggctcctttccttgtcgggcagccaagaagccgacgccctcaggaacgcacttgtaccatccctggcctgtgcagccgcccacgctggtgacgtggaggcattacaggcactagtggagctaggaagcgacctgggcctagttgattttaacggccagacacccctgcacgctgccgcccgcgggggacacacagaggcagttacaatgctgttacagcggggcgtggacgtcaacactcgcgatacagacggcttttccccactgctgctggccgtgcgaggacgtcatcctggggttattgggcttcttagagaggcgggcgccagtctcagcacacaagagctcgaggaagctggcacagagttatgtagactggcatacagggccgatctagagggtctgcaagtgtggtggcaagccggcgcagacttagggcaacctggttacgatggacattcagcgctgcatgtggccgaagctgccggaaatctggctgtagttgcgttcctccagtctcttgaaggcgccgttggcgcccaggccccatgtcctgaggtgctcccaggcgtgtag

SEQ ID NO: 3617 - DNA, 942 bp, Artificial Sequence
  Description of Artificial Sequence: Synthetic coding sequence
atgaccagctgccacatcgccgaggagcacatccagaaggtggccatctttggaggaacccatggtaatgagctaactggcgtgttcctagttaagcattggttagaaaatggagcagaaatccagagaactgggcttgaggtgaaacccttcatcaccaatcctcgcgccgtgaaaaagtgcactagatatatcgattgtgatctgaaccgtattttcgacctggagaacctcggcaaaaagatgagcgaagatctgccctacgaggtgcgtcgcgcccaggagattaaccacctcttcggccctaaagactccgaggatagctacgatataattttcgacttgcataacacaacatccaacatggggtgcaccctaatcttggaggacagtcggaacaatttcttaatccagatgttccattatataaagacctctcttgctccactaccctgttatgtgtacctgatcgaacaccccagccttaaatatgccaccactagatccatcgcaaaataccccgtggggatagaagtgggcccacaacctcagggggtcctgcgtgctgacattctggaccagatgcgtaaaatgattaaacacgctctggattttatccaccatttcaatgaaggaaaggaatttcctccctgtgccatcgaggtatacaaaattattgagaaggtcgattatccgagggatgagaacggggaaattgctgctataatccacccaaatctgcaagaccaggactggaagccattacatcctggagatccgatgttcctcactctcgatggtaagactatccctcttggcggcgactgcacagtgtatccggtctttgtgaatgaggccgcgtattatgagaagaaagaagccttcgctaaaaccacaaagctcaccctcaacgctaagagtatccgctgctgcctacattag

SEQ ID NO: 3618 - DNA, 942 bp, Artificial Sequence
  Description of Artificial Sequence: Synthetic coding sequence
atgaccagctgccacatcgccgaggagcacatccagaaggtggccatttttggcggcacacatgggaacgagttaactggggtgtttctagtaaagcactggttggagaatggggccgagattcagagaaccgggctggaagtgaaaccctttattactaacccgcgtgctgtgaagaagtgtacacgctacatcgattgcgacttgaacaggatcttcgacctggaaaatttagggaagaaaatgtcagaagacctgccctatgaggttagaagggctcaggagataaatcacttatttgggccaaaagactccgaggactcctacgacataatatttgacctacataacacaacatcaaacatgggatgcaccttgattctagaggactcacggaataatttcctcattcagatgtttcactatattaagacaagtctggcccccctgccctgctatgtgtacctgattgagcacccaagccttaagtatgctaccacaaggtcaattgcaaagtatccggtcggaatagaagtaggtcctcagccccagggtgtgctgcgggcagacatattggaccagatgcggaaaatgattaagcacgctcttgattttattcaccacttcaacgaaggtaaagagttccctccatgcgcgatcgaggtgtataaaataatcgaaaaggtggattaccctcgcgatgagaatggtgaaattgcggctattatccaccccaatctgcaggaccaagactggaaaccactgcatcccggggaccctatgtttctcactcttgatgggaagacaattcctctcggaggggattgcaccgtgtaccctgtgttcgtgaatgaggccgcttactatgagaagaaggaggctttcgctaagactacaaagttgactctgaatgctaaaagcatcagatgctgccttcattag

SEQ ID NO: 3619 - DNA, 3756 bp, Artificial Sequence
  Description of Artificial Sequence: Synthetic coding sequence
atgagcaccgagcgggacagcgagaccaccttcgacgaggacagccagcccaacgatgaggtcgtaccatattccgatgatgagacggaggacgagctggacgaccaaggctcggccgtcgagcctgagcagaacagggtcaaccgcgaggccgaggagaatcgagagccgttccggaaggaatgcacttggcaggtcaaagccaatgaccgcaagtaccacgagcagccacattttatgaacactaagttcctctgtatcaaggaatctaagtatgccaataatgcaattaagacctataagtataatgcctttacgttcatacccatgaacttatttgaacagttcaagcgggcagccaacctttattttttggcgttattaatactccaggcagtgcctcagatcagcactttggcctggtacaccaccctggtgccactactggttgtactgggggtcaccgcaataaaagacttggtggatgacgtggccagacacaagatggacaaggaaataaacaaccgaacctgcgaagtgattaaggacggcaggtttaaggtcgccaaatggaaagagatccaggtgggagacgtgatccgcctgaaaaaaaatgatttcgtacccgctgacatacttctgttaagctccagcgagcctaattccctgtgctacgttgagaccgccgagctcgatggggaaaccaatttgaagtttaaaatgagcttggagattaccgaccaatacctgcagcgggaggataccttggctacgtttgatgggttcatagagtgtgaagagccaaacaaccggttggacaagtttacgggtacccttttctggaggaataccagtttccccctcgatgccgacaagatcctcttacgaggctgtgtaatcaggaatacagatttctgtcacggcctcgtcatattcgctggtgccgataccaagatcatgaagaactctgggaaaacacgcttcaaaagaacaaagatagactacctgatgaactacatggtgtacacaatttttgtagtgctgatcttgttaagtgcagggctggcgatcggccatgcctactgggaggcacaggtaggcaactcttcatggtacctctatgacggcgaggatgacacaccgagctacagaggctttctcattttctggggctacatcatagtgcttaacacgatggtgcccataagcctgtacgtgtctgtggaagtcatccggttaggacagagtcacttcatcaattgggacctacagatgtactacgcggaaaaagatacccctgcaaaagcaaggactaccaccttaaacgaacagcttggtcaaatccattacatatttagcgataagactggaactttgacccagaacatcatgacattcaaaaaatgctgcatcaacggccagatctacggtgatcatcgcgatgcatcccagcacaaccataacaagatcgaacaggtcgacttctcttggaatacgtacgccgacgggaagctggctttttatgaccactatctcatagagcagatacagtcagggaaagagccagaggtgcggcaattttttttcttattagcagtatgccatacagtcatggtagaccgtactgacggacaactgaactatcaggccgcttctccggatgaaggagcgcttgtcaatgctgctagaaacttcggcttcgccttcctggcacgcacccagaacaccatcactattagcgagctgggaacagaacgaacatataatgtactggccatactcgactttaacagcgaccggaaacggatgagcatcattgtgcgtacgcccgaagggaacattaagctgtattgcaaaggcgccgacacagtgatctatgagagattgcatagaatgaacccaactaaacaggaaacacaggacgctctggatatttttgctaatgaaacccttaggaccctatgtctctgttataaggagattgaggagaaagagttcactgagtggaacaaaaagttcatggctgcatcagtcgcttcaacaaacagggatgaagctctggacaaagtttatgaagaaatcgagaaggacctcatcttattgggagctacagctatcgaggataagctccaggacggtgtgccagagactatttccaagctcgctaaagcggatatcaagatttgggtgctcacgggcgataagaaagaaacagccgaaaatattggtttcgcttgtgaattgctgacagaagacaccaccatctgctatggagaggatattaattccctgcttcatgcccgcatggagaatcagcggaaccgaggcggcgtgtacgccaagtttgctccaccagtgcaagaatcattcttccccccaggcggcaatcgtgctcttatcatcacggggtcctggctcaatgagatcttgctcgagaaaaagaccaagaggaacaaaatactcaagctcaaatttccccggactgaggaggagcgaagaatgaggacacagtcgaagaggcggcttgaggctaaaaaagaacaaagacagaagaacttcgttgacctcgcctgcgagtgctcagctgtgatttgctgtcgcgtgactccgaagcagaaggctatggttgtcgatctggttaaaaggtacaaaaaggccattaccctcgcgattggcgatggcgccaatgatgtcaacatgatcaagaccgcccatatcggtgtggggatctctgggcaggaagggatgcaggccgtaatgagcagcgactattcatttgcccaattcagatacctgcaacggttgctcctcgtgcatggaagatggtcttatatcaggatgtgtaaattcctgcggtacttcttctacaaaaattttgccttcactctggtgcacttttggtacagtttcttcaacgggtactcggcccagactgcatatgaggattggtttatcacgctgtacaatgtattatatacctctctgcccgttttgctaatgggccttctggatcaggacgtctctgataagctgtccctgcgcttcccaggtctgtatattgtgggacagagagatctcctgttcaactataagcggttttttgtgtcactgttacatggcgtgctgacgtcaatgatcttattcttcatccctctgggcgcatacctccagaccgtgggccaggatggagaagctcctagcgactatcagagcttcgctgtgacaattgcctctgctctggtaatcacagtaaattttcagatcggactggacacaagctattggacattcgtgaacgcattcagtatttttggcagtatcgccctctattttggcataatgttcgactttcattctgccggaatacatgtactgttcccatccgccttccagttcacaggcactgcctctaacgccttgcgtcagccgtacatttggctcacgatcatcctagccgtcgcagtctgtttgctgcccgtagtggctataagatttttatcaatgaccatctggcctagcgaatccgacaagattcagaaacatcggaagcgactgaaagccgaagagcagtggcagaggcggcaacaggtgtttcggagaggagtgtcaacccggcgtagcgcttatgctttttcccatcaaagaggttacgctgacctgatctcttctggacggagtatacgcaagaagaggtcacccttagacgcaatcgtcgccgacggtaccgcagaataccgcaggacaggagatagctag

SEQ ID NO: 3620 - DNA, 3756 bp, Artificial Sequence
  Description of Artificial Sequence: Synthetic coding sequence
atgagcaccgagcgggacagcgagaccaccttcgacgaggacagccagcccaatgatgaagtggtcccgtacagcgacgacgagacagaggacgaactcgacgaccagggcagcgcagtggaacccgagcagaaccgggttaaccgggaggctgaagaaaaccgcgaaccctttaggaaggaatgtacctggcaagtgaaggcaaacgatcgcaagtatcacgagcagccacatttcatgaacactaagttcctgtgtatcaaggaaagcaagtacgcaaataacgctatcaagacatataagtacaacgccttcactttcataccgatgaacctatttgagcagttcaaaagggccgccaatctgtattttctggccctgttaatcctccaggctgtgcctcaaattagcactctggcgtggtacactacgctggttcctcttcttgtggtccttggggtcaccgctatcaaagaccttgtggatgacgtcgccagacacaaaatggacaaggaaattaataatcggacttgtgaagtcattaaagacggacgtttcaaggtagccaagtggaaagaaattcaggtcggcgacgtgattaggctcaaaaaaaatgacttcgtacctgctgatatccttttactgtccagctccgagccgaatagtttatgctacgtggagactgccgagttagacggcgaaaccaatttgaagtttaagatgtcacttgaaattaccgatcagtatctgcaacgggaagacacactcgccacgtttgatggctttattgagtgtgaggagcctaacaacaggctggacaagttcacgggcacacttttttggcgaaatacttcgttcccactggacgcggacaagatccttctccggggttgtgtgatcagaaacactgacttttgccacgggttggtaattttcgcgggagctgacacaaagatcatgaagaatagcggcaaaactcgatttaagaggactaagattgattacctcatgaattatatggtatacaccatctttgttgtgctcatcctgctgagcgcaggtctggcaatcgggcacgcctattgggaggcacaggtcggcaactcctcttggtatctatatgacggagaggacgacactccttcgtacagaggttttttaatattttggggctacattatcgtacttaacacaatggtccctatcagcctctatgtcagtgtagaggttattcggctgggacagagtcatttcataaattgggacttacagatgtactacgcagagaaggacacacccgcaaaagctcggactaccaccctcaacgaacaactggggcagatacattatatttttagtgacaagaccgggacattaacccagaacattatgacttttaagaagtgttgcattaatggccagatatatggtgaccaccgcgatgcttctcagcacaaccataacaagattgagcaggttgactttagctggaacacatatgccgacggcaagctcgccttttacgatcactatctgattgagcagatacagtccggcaaagagcctgaagttcggcagttcttcttcctcttggccgtgtgtcatacggtgatggtcgaccggacagacggccagttgaactatcaggctgcctctccggatgaaggcgccctggtcaacgctgccagaaatttcggattcgcgttcctcgcaagaactcagaatacaattaccatttctgaactcggtaccgaaaggacttataacgtgttggccatcctggacttcaatagcgatcgcaagcgaatgtcaatcatcgtacggacacctgagggaaatataaagctttactgcaagggcgcggataccgttatctatgagagactccatcgcatgaacccaaccaaacaggaaacacaggatgccctcgatatttttgccaacgaaaccttgcgtactttgtgcctttgctacaaagagattgaggaaaaagagtttactgagtggaacaagaaatttatggccgcctctgtggcttctactaaccgtgacgaggctcttgacaaggtgtatgaggagatcgaaaaagatctaatactgctgggagcaaccgctattgaagacaagttacaggatggggtgcctgagaccatcagtaagttggcaaaggccgacatcaagatctgggtgctgacgggcgacaagaaggaaactgccgaaaatataggtttcgcgtgcgagcttctgactgaggatacaaccatctgctacggcgaagacattaactcacttcttcacgcccgaatggagaaccagcgtaatagaggtggggtttacgctaaattcgcccctcccgtgcaggaatcattctttccaccggggggcaacagggccctcatcatcactggatcctggctgaatgaaatcctgctggagaagaagacaaagagaaacaaaattctgaagctcaaattcccaaggactgaggaggagcggcgcatgagaactcaatcgaaaagacggctcgaggctaagaaagagcaacgtcagaagaattttgtggacctggcctgtgagtgttctgctgtaatctgctgccgcgtcactcctaagcagaaggctatggttgttgatttggtcaagaggtacaaaaaggccattaccctcgcaataggcgatggcgccaacgacgtaaatatgatcaagaccgcccatattggcgtcggaattagcgggcaggagggcatgcaggcggtgatgtctagcgattattcctttgcacagttcaggtacctacagcgactgctgctggtgcatgggaggtggtcctatattcgtatgtgtaaattcttgcgctactttttttacaagaatttcgcgtttactctggtacacttctggtatagctttttcaatggctactccgctcagacagcatacgaggattggttcatcacgctgtacaatgtcctgtacacctcgctgcccgttttactcatggggttgctggatcaggacgtgtctgacaaactgtcgctgcgtttccctggcctgtacattgtggggcagagagatttattgtttaattacaagcggttctttgtatctctcctgcacggagtgctgacatcgatgatcctgttttttatccccctgggcgcttacttgcagactgtgggccaagacggagaagcaccaagcgactaccagagctttgctgtaaccattgcttccgcactcgtaatcaccgtgaacttccagatcgggcttgacacttcttactggacttttgttaacgctttcagcatatttggttccatcgccctttatttcgggatcatgttcgatttccatagcgccggaattcacgttctctttccatccgccttccagttcacaggcacagcatctaacgccctacggcaaccttacatatggctcacaataatcctggctgtggccgtgtgcctcctcccggtagttgcaattcggttcctgtccatgaccatatggccaagtgagtctgataagatacagaagcatcgcaaacggcttaaggctgaggagcagtggcagcgccgtcagcaagttttccgaagaggcgtttcaactagaaggagcgcatacgcctttagccatcagaggggctatgctgatctcatttccagcggccgaagcatcaggaaaaaaaggagccccctcgatgcaatcgtggcagacggcaccgccgagtatcggagaacaggcgactcctag

SEQ ID NO: 3621 - DNA, 4398 bp, Artificial Sequence
  Description of Artificial Sequence: Synthetic coding sequence
atgcccgagcaggagcggcagatcaccgcccgggagggcgccagcagaaaaatactgtctaaactcagtctgcctacgagagcatgggaacctgcgatgaagaagtctttcgcattcgacaacgtcgggtatgaaggcggcttagatgggctcggtccatctagccaggtcgcgacttcaaccgtgcgcattttgggtatgacctgccagtcttgcgtgaagtcaatcgaggaccgcatttctaacctcaaggggatcatcagcatgaaggtaagtctcgaacaagggtctgcaacagtgaagtacgttccctctgtagtctgcctgcagcaggtctgccatcaaataggtgatatgggctttgaggctagtatcgcagagggcaaggccgccagctggccatcccgctccctgcctgcccaagaagctgtcgtgaaactgagagtggaggggatgacttgtcagtcttgtgtctcaagtatagagggcaaagtgcgtaagctccagggggtagttcgagtcaaagtctcactgtccaaccaggaggccgtgattacttaccagccttatttaattcaacccgaagatctgcgggatcacgtcaatgacatggggttcgaggcggccattaagtctaaggttgcacctctgtcactggggcccatcgatatcgagcgcctgcaatcaaccaatcccaagagacctctctcttctgcaaaccagaactttaacaattccgagactctggggcatcaggggtcacacgtggttaccctgcagctgaggattgacggcatgcattgtaagtcctgtgttctgaacattgaggagaatatcgggcagcttttgggcgttcagagtattcaggtgagtctggagaacaagacagctcaggttaagtatgacccatcctgcacatctcccgtggctctgcaacgagccatcgaggcactgcctcctggcaattttaaggtgtccttgccagacggggcggagggttcaggcaccgatcatcggtccagtagctcccattctccagggtcaccaccccggaaccaagttcaaggtacgtgtagcacaactctcattgcaatcgctggcatgacttgtgcctcttgcgtacactctatcgaaggaatgatttctcaattggaaggcgtgcagcagatctccgtctcactggccgaaggcaccgcaaccgttctgtacaatccttcagtgatcagtcccgaagaactgagagccgcaattgaagatatgggctttgaagcctcagttgtgtccgagtcatgcagcaccaacccccttggaaatcacagtgctggcaacagtatggtgcagaccactgacggaacaccaaccagtgttcaagaggtagcacctcatacaggtcggcttcctgctaaccacgctcctgatatattagcaaagtctccccagtccacccgcgctgttgctccccagaaatgtttcctccagataaaagggatgacttgcgcaagctgcgtttccaatattgagagaaatctgcaaaaggaggcaggagtcctgagcgtactcgtggcactaatggccgggaaggcggaaattaagtatgatccagaagtgatccagccactggaaattgcccagtttatccaggatctgggctttgaggccgccgtgatggaagattacgcggggtccgacggcaatattgaactgacgatcaccgggatgacatgcgcaagctgtgtccacaacatcgaatccaagttaactcggacaaacgggatcacttacgcctccgttgcgcttgccactagcaaagctctggttaagtttgacccagagataattggcccaagagatattataaagatcatagaagaaatcggctttcacgcctcgttagcacaacgcaaccctaacgctcaccatctggaccacaaaatggaaattaaacagtggaagaaatcattcctctgttcccttgtcttcggtattcccgtgatggcgctaatgatatacatgttaatcccttctaatgagccacatcagtctatggttctggaccacaacattatcccaggactgtctattctgaatctgatctttttcatcctctgcacattcgttcagttgctcggggggtggtatttctacgtacaggcttataagtccctgcgacacaggagcgctaacatggacgttttaatcgtgcttgctacaagtatcgcttatgtctattctctagttatactcgtcgtggccgtggcagaaaaggctgagcgctctcccgtaaccttcttcgatacacccccaatgctgtttgtctttatcgcccttggccgttggctggagcatctggctaagtcgaaaacctccgaagccctcgccaaactgatgagcctacaggctactgaagccacagttgtgaccctcggtgaagacaatctcattattcgcgaagagcaggtgcccatggagttggtccagaggggggacatcgtcaaggttgtgcccggggggaagttccctgtggacggcaaagtgcttgagggtaacaccatggctgacgagtcccttataactggcgaggccatgcccgttactaagaagcccgggtctactgtgatagctggtagcattaatgcccacggctcagttttgataaaagcaacccacgttggcaacgataccactctggctcagatcgtgaagctagtcgaagaggctcagatgagcaaagcccccattcagcaactcgccgaccggtttagcggatatttcgtaccattcattatcattatgagtactctgactctcgtggtgtggattgtcataggtttcattgatttcggcgtcgtgcagagatacttcccaaatcccaacaagcacataagccagaccgaggtgatcatcagattcgcattccagacgtctatcacagtattatgcattgcttgtccttgcagtctgggactggcaacgcccaccgctgttatggtagggacgggcgtcgcagcacaaaatggtatactgataaaagggggcaagcctctagaaatggcccacaaaatcaaaacggtgatgttcgataagacaggaaccataactcacggggtccctagggtgatgcgagtactcctcctcggggatgttgcgactctgcccctgcgcaaagtgttagctgttgtggggaccgcagaggcatcctctgaacatccactgggagttgcagtcaccaaatattgcaaagaagaactcggaaccgagaccttggggtactgcactgatttccaggccgtgccaggctgcggaatcgggtgcaaggtatcaaacgtagagggcattttggcccattctgaacgacccctgtccgcccccgcaagtcacctaaatgaagcaggcagccttcccgcagagaaggacgccgtgcctcagactttctccgtcctcatcggtaatagggaatggctccgaagaaacggactcaccatatcatccgatgtgtccgacgctatgactgatcacgaaatgaaagggcagacagccatacttgtggctatcgatggagtgctctgcggcatgatcgccatagctgacgccgtgaagcaggaggccgccctagcagttcacacattacagagtatgggcgtcgatgttgtgctgatcaccggagataaccgaaagacggctagagcaatagcgacacaggtcgggattaataaagtcttcgccgaggtcctgccttcccataaggtcgctaaagttcaggagctccagaataagggcaaaaaagtggctatggtaggagatggggtaaacgactcccccgctctggctcaagccgatatgggtgtcgcaattggaacagggactgacgttgctatcgaggccgctgacgtggtccttatacgaaatgacttgctcgacgtagtggcaagcattcatctgtccaaacgaaccgtgcgcaggattcgaatcaacctggtccttgccctgatttataacctggtgggcatccccatcgccgcaggcgtctttatgcccataggtatcgttcttcaaccttggatgggctcagcagctatggcggcttcatcggtgagcgtagtcctctcaagtctacagcttaaatgttataagaaacctgatctggagcgatatgaggcgcaggcgcatggtcacatgaaacctttaacagccagtcaagtctccgtgcatattgggatggatgaccgctggcgcgacagtccacgtgcaacaccctgggaccaagtatcctatgtcagtcaggtaagcctttccagcctgaccagcgataaaccaagccgacatagtgccgcggctgatgatgacggagataagtggtcactactgcttaatggtagggatgaggagcagtatatctag

SEQ ID NO: 3622 - DNA, 3777 bp, Artificial Sequence
  Description of Artificial Sequence: Synthetic coding sequence
atgcccgagcaggagcggcagatcaccgcccgggagggcgccagccggaaaatcctctccaaactttcgctgccaacccgggcctgggaacccgccatgaagaagtcttttgcgttcgacaatgtgggttatgaaggcggcctggatggcctgggcccttcatctcaggtcgctacaagtactgtgcgaatacttgggatgacatgccaaagctgcgtgaaatcaatcgaagatcggatatcaaatctgaagggtattatctcaatgaaagttagtcttgagcaggggtccgctacggtcaaatacgtcccgagcgtggtgtgcctgcagcaggtgtgtcatcagattggcgatatggggtttgaggcttctatagctgaggggaaagcagcaagttggcccagccggtcattgccagctcaagaggccgttgtgaaactgagagtcgaagggatgacatgccagagctgtgtttcttccatagaggggaaagtgaggaaacttcagggagtggtgagagtgaaggtgagcttgagtaatcaagaagcagtgatcacctatcagccctatctgatacagcccgaggaccttagagaccacgttaatgatatgggattcgaggccgcgattaagagcaaagtggctccgctcagcctggggcctatcgacatagaaaggcttcagagcactaatccaaaacggcctctgtcatctgcgaatcagaactttaacaacagcgaaacacttggccaccagggcagtcatgtggtcactctgcaactgcgtatcgacggcatgcattgcaaaagctgtgtgctgaatatagaggagaacatagggcagctgttaggggttcagagtatccaggtttcgctggagaacaagactgctcaggttaagtatgatccgtcttgtaccagtcccgtggctttgcaacgggctatcgaggccctgccccccggcaacttcaaggtatcattgccggacggggcagaggggtccgggaccgaccataggtctagcagttcacactctccaggcagcccaccaagaaaccaagtgcagggaacttgctctactacccttatagccattgccggcatgacttgcgcttcgtgcgttcacagcattgaaggtatgattagccaattggagggggtgcaacagatcagcgtcagtttagcagagggaactgcaaccgtgctttacaatccaagtgtcatcagccccgaggaattgagagctgccattgaagacatgggatttgaggcctccgtggttagtgaatcctgttcaactaacccgctggggaaccacagcgccggtaacagtatggttcagaccactgacggtaccccaacctccgttcaggaggtggccccccatactggtaggctgccggccaaccatgctccggatatactcgccaagtcacctcaatccactcgggctgttgcccctcagaagtgcttcctgcaaatcaagggcatgacctgtgcgagctgtgtaagcaacatcgagcgcaatctccagaaggaggcaggggttctgtccgtgctggtcgctctgatggccggtaaggccgagatcaagtacgatcccgaagttattcagcctctggagatcgctcaatttattcaggatttgggcttcgaagccgccgttatggaggactacgcagggagcgacgggaatattgaattgacaatcacgggcatgacctgcgccagttgtgtgcataatattgagtccaagcttactcgcacaaacggcatcacgtacgcatccgttgcactggctacatcaaaagctctggtcaagtttgacccagagatcatcggccctcgtgatataatcaagatcatcgagagcaagacatctgaggcactggcaaaattaatgagcctgcaagccaccgaagccactgttgtgacactaggggaggataacctgatcatacgggaggagcaagtgccaatggaactggtgcaaaggggagatatcgtcaaggtggtcccagggggaaaattccctgtcgacggcaaagtgctcgaggggaatactatggcagacgagtctttgatcactggggaagcaatgccggtgaccaagaagccggggtccacagtgatcgccggtagcataaacgcccacgggagtgttctaattaaggccactcatgtgggcaacgatacaaccctcgctcagatcgtgaaactggtcgaagaggcccagatgtccaaaaacccgaataaacatatttctcaaacagaagtgatcattagattcgcgtttcagacgagcattacagttctgtgtattgcctgcccttgtagccttggactggccacgcccacagccgtgatggtggggacgggtgtcgcagcacagaatggaattctcatcaagggcggtaagccactagagatggcccacaagatcaaaactgtgatgtttgataagactggcactatcacgcacggtgttcctcgggtaatgagggttctcctgctaggcgacgtcgccacactgccgttgagaaaggtgttagcggttgtcggaacggcggaggcctcgagtgaacatcctctgggcgtagccgtgaccaagtactgcaaggaagagcttggcacagagactctgggctactgcactgatttccaagctgttcccggctgtgggatagggtgcaaggtgagcaacgtggaaggtattctcgcgcatagcgaacgacctctctcagctcctgcttctcatctcaacgaggccggcagcttaccagcagagaaagacgccgtgccgcaaaccttttctgtactaatcggcaatcgtgagtggttgaggcggaatggtctgacaatctcttccgacgtgagcgacgcaatgaccgatcacgagatgaaggggcaaaccgctattctggtagctattgatggggtgctgtgtgggatgattgccatcgcagatgctgttaaacaggaggcggccctagcagttcacaccttgcagtcaatgggggttgatgtagtgctcatcactggggataaccgtaaaaccgcccgggcaatagccacccaagtggggattaataaagtgtttgccgaggtgctcccctctcacaaagtagctaaagttcaggagcttcaaaacaaggggaaaaaagtggccatggtaggggatggggtcaatgactcacccgcccttgcgcaagctgacatgggtgtggccatagggaccgggacagacgtggctatcgaggcagccgacgtcgtgctcatccggaacgacctgctggatgtggtggcaagcatccacctgtcaaaacgtaccgtccgaagaatacggatcaatctcgtactagcgctgatctacaatctggttggaatccctatagctgctggggttttcatgccaattggcatcgtactgcaaccttggatgggcagcgccgccatggccgcgtcctccgtgagcgtggtgctgtctagcctgcaactgaagtgttataagaagccagatcttgagcgctacgaggcacaggcccatggccatatgaagccactgacagcatcgcaggttagcgtgcacatcggtatggacgatcgctggagggactcgcctagagcaaccccctgggaccaggttagctatgtcagccaagtttcactgtcaagtttgacatcagacaagccttctaggcattctgccgctgctgacgatgacggagataaatggtcattgcttctaaatgggcgggatgaggaacaatatatctag

SEQ ID NO: 3623 - DNA, 4065 bp, Artificial Sequence
  Description of Artificial Sequence: Synthetic coding sequence
atgcccgagcaggagcggcagatcaccgcccgggagggcgccagccgcaaaatactgagcaagctctcactcccaactagagcatgggaacccgcgatgaagaaatcgttcgcattcgataatgtgggctatgaaggggggctggatggacttggcccaagctcacaggttgccacatctaccgtacgcattctcggaatgacatgccagtcctgtgtcaagtccattgaagatcggatatcaaacttgaagggaatcatatcaatgaaagttagcctggaacagggctcagccaccgtaaagtacgtaccttctgttgtctgcctccagcaggtttgccaccagataggtgacatgggatttgaagcctcaatagccgagggtaaggcagcctcttggccttcacgctccttgcccgctcaggaggcggtggtaaagctgagagttgagggaatgacctgccagtcttgtgtcagctcgattgaaggcaaagttaggaagctgcagggcgtggtccgcgttaaggtctcactgtcaaaccaggaggctgttatcacataccagccatacctgattcaaccagaagaccttagagatcacgtcaacgacatgggctttgaagcggctattaagagcaaggttgcacccttatccctggggccaatcgacatcgagaggctccagtccactaatcctaaacgacctctatccagtgctaaccagaacttcaacaatagcgagactctgggtcatcagggtagccatgtggtgactctccagcttcggattgatggtatgcattgtatgatcagtcagctcgaaggtgtgcaacagatttctgtcagcttggctgaggggacagccacggtcctctataacccctccgtgattagccctgaggagctgcgtgctgcaatcgaagacatgggtttcgaggcatcagtcgtctccgaatcctgttctacgaatccattgggcaaccattcggcaggaaactcaatggtgcagactacggatgggacacctacgtccgtccaggaggtggccccccatacagggcgcttacccgcaaaccacgcacctgacatactcgccaaatccccgcaaagtacgagggctgtcgcccctcagaaatgtttcctccagatcaaaggaatgacatgtgcatcgtgcgtgtccaacattgaacgtaatctgcagaaggaggcgggggtcctgtctgtcctggtggccctgatggctggtaaagctgaaatcaagtacgatccagaagtgattcagcccctcgaaatcgctcagtttattcaggacttaggctttgaagcagcagtgatggaagactacgctggcagtgatggaaacatcgagcttaccattaccggaatgacatgtgccagctgcgtgcataacattgaatccaagctgaccaggaccaatggtatcacgtatgcgagcgtggctctagctacttcgaaagctctcgtcaagttcgaccccgagattatcgggccccgagacatcattaagattatcgaggagatcggatttcatgcctctttggctcagaggaatcctaatgcccatcacttggatcacaagatggagatcaagcagtggaaaaagtcatttctgtgctccctggtgttcggaatcccggtgatggcactgatgatttacatgctcataccttctaacgagccccatcaaagtatggttctggatcataacataatacctggcctctcaattctaaacctcatctttttcatactctgtactttcgtccaactcttgggcggatggtatttttacgttcaggcgtacaagtccctgcgccacagaagcgcaaatatggatgttcttattgttctagctacttcgatcgcatacgtctatagtctggtgatactggtcgttgccgtggctgaaaaggctgagcgctctcccgtcactttctttgataccccgccgatgctctttgtatttatcgccctgggaaggtggctcgagcatttggccaaaagcaagacatctgaagccctagctaaacttatgtctctgcaggccactgaagctactgtcgtgaccctgggagaggataacctgatcatacgggaagagcaggttccaatggagctggttcagagaggggatatcgttaaagtggtgcctggaggaaagtttcccgtagacgggaaagtcttagagggcaataccatggccgatgaatcactaatcactggcgaggccatgcccgtgactaagaagcctggctcaacagtcattgcaggctctataaacgcccatggaagtgtcctcatcaaagccacacatgtggggaacgacactaccttggcccagatcgtcaagctggtggaggaggcccagatgtccaaggcacccatacagcagctcgctgaccgcttctcgggatactttgttccctttattatcatcatgagtactttgaccttagtagtatggatcgttattgggtttattgacttcggcgtggtccagcgatacttccccaaccctaataaacacatcagtcaaacagaggttatcattcgatttgcattccagacttccatcactgtgctgtgcatagcctgtccttgctccctgggtctggctacccctaccgcggtgatggtggggacaggtgtggctgctcagaacggcatcctcattaaagggggaaaaccgttagagatggctcataagatcaagactgtgatgttcgacaagaccgggacaatcactcatggagtgccccgtgtcatgcgggttcttctgctgggggatgtagcgaccctgcctctgagaaaggtgctggcagttgtgggcacagctgaggcaagctctgagcatccactgggagtagctgtcacaaaatattgcaaagaagagctgggaaccgaaactctcgggtattgcaccgattttcaggctgtacctggctgtggaatcggatgcaaagtatcgaatgtagaaggcatcctggcacattcagagaggcctcttagcgcacccgcctctcatctaaacgaggccggatctctgcccgctgagaaggacgccgttccccagacattttcagtacttataggcaatcgcgaatggctgcgcaggaacggtctgacgattagcagcgatgtgagtgatgctatgactgatcacgagatgaaaggccagaccgcaatactggtggctatagatggtgtgctatgcgggatgatcgctatagctgatgcggtgaaacaggaggcggcactggctgttcataccctgcaaagcatgggcgtcgatgtggtgcttattaccggagacaaccggaagactgctagagcaatagccacacaggttggcatcaataaagtgtttgccgaagttctgcccagtcacaaggttgctaaggtccaggagcttcagaacaagggaaagaaagtcgctatggtaggcgatggggttaacgatagtcctgctttagcccaggcggacatgggagtcgccatcggaacaggaactgatgtagctattgaagccgcagatgtagtgctaattcgcaatgacttgctggacgtggtggcttctattcacctatctaaacgcacagtaagacgcattagaattaacctcgttctcgcacttatctacaacttggttgggatacctatagccgccggtgtctttatgccgattggaatcgtcttgcagccctggatgggctccgcagccatggccgcctcgtcagtgagcgtggtactctcctcactgcaactcaaatgctacaagaagcccgacttggagcgttacgaagcgcaggcacatggccatatgaagccactgaccgcgtcccaggtgagcgtgcacattggtatggacgatcggtggcgtgattctccaagggccactccctgggatcaggtgtcttacgtgagccaggtttctttatcctcgttaacgtctgacaagccttcccgccattccgccgccgccgatgatgatggcgataaatggtcgctgctgttgaacggcagggacgaggagcagtacatatag

SEQ ID NO: 3624 - DNA, 3108 bp, Artificial Sequence
  Description of Artificial Sequence: Synthetic coding sequence
atgcccgagcaggagcggcagatcaccgcccgggagggcgccagccggaagattctgagtaagctctccctgccaacccgggcctgggagcctgctatgaaaaagagctttgcgtttgataatgtgggttatgaggggggcttggacgggctgggcccctcaagccaggtggccacctctactgtccggattctggggatgacgtgtcaaagctgtgtcaagtcgatcgaggatagaatctcgaatctaaagggcattatttctatgaaagtgagcttagagcaagggagcgccaccgtgaaatacgtgccgtccgtcgtctgtctccaacaggtgtgccaccagattggagatatgggattcgaagcaagtatcgcagaaggtaaggccgcgagttggccaagcagaagcctcccggcccaggaagcagtagtaaaactgagagtcgaaggaatgacttgtcaaagctgcgtatccagcattgaagggaaggtgagaaaactgcaaggggtggtacgagtaaaagtgtccttgtcaaaccaggaggccgtcatcacctatcagccctatctgattcagcctgaggacctgcgggatcacgtgaatgatatgggcttcgaagccgctataaagagtaaagtcgccccgcttagcctcggccccattgatatcgagagactgcagtctaccaatcctaagagaccactctcttcggctaaccagaatttcaacaattccgaaaccttaggacatcagggctcccatgtcgttacactgcaactgcgaatcgacggtatgcactgcaagtcttgtgtgctcaatatcgaggagaatataggccagctattaggggtgcagtctatccaagtcagtctggaaaataaaactgcccaagtgaagtatgaccctagttgtacttcgccggtggctctccagagggcaatcgaagcactgccgcccggaaacttcaaggtgtccctgcctgatggcgcagaaggctcaggtactgatcaccgaagctcctcttcgcactctccgggcagtccacctagaaatcaggtgcaagggacatgcagcacaacacttattgccatagcggggatgacctgtgcatcctgcgtgcacagtatcgaaggtatgatctctcagctcgaaggcgtgcagcagatcagtgtctctttggcggaaggtactgctactgtgctgtacaatccctcagtaatcagtcccgaggaactaagagccgccatagaggacatgggattcgaagcttctgtcgtcagcggtgaggctatgccagtgaccaaaaaacctggttccactgtgatcgctggatctattaacgcacacggcagtgtcctgataaaggcaactcatgtcgggaatgatacgactctcgctcagatcgtgaagctcgttgaggaggcccagatgtctaaagcccccatccagcagttggccgaccgctttagtggctacttcgttccatttatcatcatcatgtcaactcttaccctggtggtttggatagtgatcggctttattgactttggcgtggtgcagcggtacttccccaatccaaacaaacacatttcccaaaccgaagtaatcatccgatttgcgttccagacatcaattaccgttctctgcattgcctgcccctgcagtctcggactggccacaccaacggccgtcatggttggaactggagttgccgcgcagaacggtatcctcattaaggggggtaagccactggagatggcccacaaaattaagactgtgatgttcgacaagaccggtactataactcacggagtccctagagtgatgcgggtgctgctgttaggagacgttgccactttaccgttgagaaaagtgctggccgtggtcggcacagcagaggcttcctctgagcatccccttggagtggccgttaccaagtactgtaaggaggaacttggtaccgagactctcggttattgcaccgacttccaggccgtgcccggatgcggcatagggtgcaaagtttcaaacgtcgagggcattctggctcactctgagcgcccgctctctgcccctgccagtcacctcaatgaagctggatccctgcccgccgaaaaggacgccgtgccacagaccttttcagttttgatcggcaatagagaatggcttcgacggaatgggcttacaataagcagcgacgtcagcgacgctatgactgatcacgaaatgaagggccagaccgcaatcctcgtggccatcgatggggtactgtgtggcatgatcgcaatcgctgatgccgtgaaacaggaggccgccctcgcagtgcatacccttcagagtatgggagttgacgtcgttctgatcaccggagataaccgaaagacagccagagccattgctacgcaggtcggcataaataaggtattcgccgaagtgctcccctcacacaaagtggccaaagtccaggagctgcagaataaggggaaaaaggtagctatggtcggcgacggagtcaacgattcacccgccctcgcacaggcagatatgggcgtggcgattggcaccgggacagatgtggcaatcgaggccgcagacgtggtgctcataagaaatgaccttcttgacgtggtggcaagtatccacctatctaagcgaacagtgagacgcatccggattaatctggtactggcacttatttataatctcgtgggaatccctattgctgctggcgtcttcatgcccattggcatagtgctgcagccctggatgggatctgccgccatggctgctagctccgtctctgtggtgctgagttccctacagctcaaatgttataaaaagcctgacctggagagatacgaagctcaagcccatggccacatgaaaccactcactgccagccaggtttcggtgcatatcggaatggacgaccggtggcgcgacagtccccgcgcgactccgtgggaccaggtgtcatatgtgtcccaagtttcattgtcgtctcttacgtcagataagccctccaggcatagcgcagcagctgacgatgatggcgacaagtggagccttctcctgaatggccgcgacgaggaacaatatatttag

SEQ ID NO: 3625 - DNA, 2031 bp, Artificial Sequence
  Description of Artificial Sequence: Synthetic coding sequence
atggacgtgctgatcgtgctggccaccagcatcgcctacgtgtactcactcgtcatcctcgtcgttgcggttgcagagaaagctgaacgaagtccggtcacattttttgacacccccccaatgcttttcgtattcatcgctctgggacgatggttagagcatttggcgaagtccaagacgtctgaggccttggccaagctgatgtctcttcaggctactgaagctacagtcgtgaccctcggcgaggacaatttgatcattcgcgaagaacaggtgcctatggagttggtgcagcgaggtgatatagtgaaagtggtgcctggaggcaaattcccggttgatgggaaagtcctggaaggaaataccatggccgacgagtccctcatcacaggcgaggctatgcctgtgaccaagaagcccggtagtactgttatagccggcagcatcaacgctcacggctccgtactgatcaaagccactcatgtcgggaatgatacaacattggcccagattgtgaaactggtcgaagaagcccagatgtctaaagcacccatccaacagctggccgacagattcagcggttatttcgttcccttcatcatcattatgtcgactctgacgctggtcgtttggatagtcattggctttatcgacttcggagtcgtgcagcgttacttccctaatcctaataagcacatatcacagacggaagtaattatacggtttgcgttccagacttccatcacagtgctgtgcattgcctgcccatgcagtctgggcctggcaactcctacagcagtcatggtgggcactggggtggccgcgcagaatggcattctcattaaaggagggaaaccactcgagatggctcataaagagcttggcactgagactctcggatattgtacagactttcaggctgtgccagggtgtggtatcgggtgcaaggtatctaatgtggaaggcatactagctcacagtgaaaggcctctgtctgctcctgccagccacctcaatgaggccggatccctgccggccgagaaggacgccgtgccacagaccttcagcgtcttgataggaaacagggagtggctgagacgaaatgggctgacaataagctcggacgtgtcagatgcgatgaccgatcatgagatgaaagggcagaccgccattctggtcgcgatagacggcgttttgtgcggcatgatcgctatagcggacgcggttaaacaagaggccgctctagccgtgcatacccttcagtccatgggagtggacgtcgtcctgattacaggggacaacagaaaaactgcacgtgctatcgcaactcaggtgggaataaataaagtgttcgctgaagtgctgccttctcataaggttgccaaggtccaagaactgcagaataagggcaagaaagtggccatggtcggcgatggagtcaatgactcacctgcactggcacaggccgatatgggcgtcgctatcggaaccggcaccgatgtggctattgaggccgccgacgtggttctgatccgtaacgatctgctggacgtggtagcctcaatacacctgtccaagcgcacggttagacgcatcagaattaatctcgtgttggctttgatctacaacctcgtgggcatccccattgctgccggggtgtttatgccaattgggattgttctgcagccttggatggggtctgcagctatggccgctagttcggtatccgttgtgctatctagcctccagttgaagtgctataagaagccagacctggaaaggtatgaagcgcaggcgcacgggcacatgaagcccttgaccgcaagtcaggtctcagtgcacatcggcatggatgatagatggcgcgattctcctcgcgccacaccttgggatcaggttagctacgtgagccaggttagcctatcgtcactgacttctgataaaccaagtagacattcagctgccgcggatgatgatggggataaatggtccctgctgctcaacggccgagacgaggagcagtatatttag

SEQ ID NO: 3626 - DNA, 4203 bp, Artificial Sequence
  Description of Artificial Sequence: Synthetic coding sequence
atgcccgagcaggagcggcagatcaccgcccgggagggcgccagccgaaagattctgtccaagctttcgctgccaacccgggcttgggagccagccatgaaaaaatccttcgcttttgacaatgtcgggtacgagggagggctggacggcctgggccctagttcccaagtagcaacttccacggttcgaattctgggaatgacatgtcagagttgcgtgaagtctattgaagaccgcattagcaacctgaaagggatcatatctatgaaagtcagtctcgagcaggggagcgcaaccgtcaagtacgtgccctctgtagtttgcctgcagcaggtctgtcaccagataggggatatgggttttgaggcttctattgctgagggcaaggccgcctcttggccctcacgctcactaccagcccaggaggcagtagtcaagctgagggtcgagggaatgacctgtcagagttgcgtctcctcaattgaagggaaagtgcggaaattacagggggtggttagagtcaaggtgtccctttccaatcaagaagccgtgatcacttaccaaccatatctgattcaacctgaagatctgcgagatcatgtaaatgatatgggattcgaagccgccattaagtcaaaagttgctcccttgagcttgggcccaatcgatatcgagaggctgcaatcaacaaacccaaagcgacccctatcaagtgccaatcagaactttaataactccgagacactgggccatcagggaagccacgtggtgacactgcagctccgtattgacgggatgcactgtaaatcatgtgtattgaatattgaggaaaatataggccagctcttgggtgtgcagtcaatccaagtttccttggagaataagactgctcaggttaagtacgatccctcgtgtacctctccggtggccctacagagggcaatcgaggcccttccccctgggaatttcaaagtctccttgcccgatggtgctgagggctccggaaccgaccaccgcagcagcagctctcattctcccggttctcctcctcgcaaccaggtacagggaacttgttcaaccacattgatcgccatcgctggaatgacctgcgcctcctgcgttcacagtatcgaaggcatgatctcccagctcgaaggagttcaacaaatatcagtgtctttggccgaaggcaccgcaacagttctgtataatccaagcgtgatttcccccgaggagcttagggccgctattgaggatatgggcttcgaagcctcagtggtgagtgaaagttgcagcactaacccactaggcaaccatagtgcgggaaatagcatggtgcagacaactgatggaacacccacttccgtgcaggaggtcgccccccacactggcaggttgcctgctaaccatgcacctgacatacttgccaagtcaccacagtccacccgggccgtggcgcctcagaagtgcttcctgcagatcaaggggatgacatgtgcttcttgtgtttccaatatcgagaggaatcttcagaaggaggcgggcgtgctgagtgtgcttgtggccctgatggcaggcaaggccgagattaagtacgatccagaggtgatacagccacttgagatagcccagttcattcaggacttgggcttcgaggctgccgtaatggaggactatgcaggtagtgacggcaacatcgaacttacaatcaccggcatgacatgcgcgtcatgcgttcataacatcgagagcaaacttaccaggaccaacggaatcacatacgcttctgttgccctagccacatcaaaagcccttgttaagtttgatccagaaatcataggacctagagacattataaagattattgaggaaatagggttccacgcatcgttggctcagagaaaccccaatgcacatcatctcgatcataaaatggaaataaagcagtggaaaaaaagtttcctttgttcactagtgtttggtatacccgtgatggccttaatgatctacatgcttatacccagtaatgaaccgcatcagagcatggttctcgatcacaatatcattcccgggctgagcatcctaaatctgattttctttatcctatgtacttttgtccagctcctcggggggtggtacttctacgtgcaggcatacaaaagccttcgacatcgtagtgccaatatggacgtcttgattgtgctggccacctcaatcgcctacgtttactcacttgttatactggtggtggccgtggccgagaaagcggagaggagcccagtgacattctttgatacaccccctatgctcttcgtttttatcgctctcggtaggtggctggagcacttggcaaaaagcaaaacttccgaagccctcgcgaagctgatgtccctgcaggccactgaggcaacagtcgtgactttgggtgaggacaatttgataatccgggaggaacaggtccccatggagctggttcaaagaggcgatattgtcaaggttgtgcccggaggaaaattccccgtcgacggcaaggtgctcgaggggaatacaatggccgatgagtctctgatcactggagaggctatgcccgtgacaaaaaaaccagggtctacggtaatcgccggctccataaatgcacatgggtcagtactgataaaagcaacgcatgtaggtaatgacacaaccctggcccagatcgtcaagctggttgaagaggcacaaatgtctaaagctcctatacagcagcttgcagaccgtttttccgggtatttcgtgccattcattatcattatgtcgacactgaccctggtggtgtggatagtaattggttttatcgactttggagtcgtgcagcgttactttcctatcaagactgttatgttcgataagactggaaccattacccatggggtgcccagagtgatgcgcgtgctgctcctcggcgacgttgccaccctacctctgagaaaggtgctagctgtagtcgggaccgctgaagcctcttccgagcatcctctaggcgttgccgtgaccaagtactgtaaggaggaattggggacagagactcttgggtactgtacagacttccaggctgtgcctgggtgcgggatagggtgtaaggttagtaacgtcgaaggcatcttagcccatagcgaacggcccctgtctgcccctgctagtcaccttaacgaggcagggagtctgcctgccgaaaaggacgccgtgcctcaaacgtttagcgtgctcattggaaatagagagtggctgagacgtaatgggctgactatttctagcgacgtgtctgatgctatgaccgaccacgaaatgaaaggccagactgcaatcctcgtagcgattgacggagtgctgtgtgggatgattgccatagctgacgcagtgaaacaggaagctgccctggcagtgcacacgctgcagtcaatgggcgtggatgtcgtgctcattacgggggacaacagaaagacggccagggctatcgccacgcaggtaggcattaacaaggttttcgccgaggtgctgccctctcacaaagtggctaaagtgcaggaactgcaaaataaaggcaagaaagtggcgatggtcggtgacggagtgaacgactctccagctctggcccaggccgacatgggcgtggctatcggaaccggaaccgatgtggcaattgaagccgccgacgtggtactcattagaaacgacctcttagatgtggtggcctccatacacctctcaaagcgtactgtgcggcgcattagaataaacctagtcttagctctgatctataacctggtaggcatccctatcgcggcaggggtgtttatgcctattggaatcgtgcttcagccctggatggggtcagcagcaatggcagcctcttcagtcagcgtggtcctatctagtctgcaactgaagtgttacaagaaacctgatcttgagcgatatgaagctcaggcccacggacacatgaaacctctcaccgccagtcaagtgtccgtacacattggtatggatgaccgatggagagattcccctagggctacaccatgggatcaggtaagctatgtttcccaggtctcactaagcagtttaaccagcgacaagcccagcagacactccgctgccgctgatgatgatggggacaagtggtctcttctgctgaatggtcgtgacgaagaacagtacatctag

SEQ ID NO: 3627 - DNA, 4164 bp, Artificial Sequence
  Description of Artificial Sequence: Synthetic coding sequence
atgcccgagcaggagcggcagatcaccgcccgggagggcgccagcaggaaaattctctcgaaactttccctgccgactcgggcttgggaacccgccatgaagaagtctttcgcctttgataacgttggttatgaaggaggactggatggcctgggcccaagcagccaggtggcaaccagcacagtcaggattttgggcatgacttgccaatcatgcgtgaagagcattgaggatcggatttcaaatctgaagggcatcattagcatgaaggtaagcctggagcaaggctcggccaccgtgaaatacgtgccctcggtagtgtgtctgcagcaggtgtgtcatcagattggcgacatggggttcgaggcttccattgccgagggcaaggccgctagttggccctctaggtcacttccagcccaagaggccgtagtgaagctgcgcgttgaagggatgacttgccaatcttgcgtgtccagcatcgagggaaaggtcaggaaactccagggcgtggtgcgcgtgaaagtttcgctgagcaatcaagaagctgtaatcacctaccagccgtacctgatccagccagaggacctgcgtgatcacgtcaacgatatgggctttgaggccgctatcaaaagcaaggtggctcctctttcactaggccctattgacatcgaaagactgcagagcaccaatcctaaaaggccattgagcagtgcgaatcaaaattttaacaactctgagacgcttgggcaccagggatcacacgtagtgacgctgcagcttcgaatagacgggatgcattgcaaatcttgtgtcctgaacattgaagagaacatcggccaactgcttggggtgcagtcgatccaggtcagccttgaaaataaaaccgcccaagtgaaatacgaccccagctgcacttcacccgtggccttacagagagctatcgaagctctgccgcctggtaacttcaaggtgagcctacccgacggagctgagggatcaggcacagatcaccgtagcagcagctctcatagtcctggtagcccaccccgaaaccaggttcaaggcacctgctcaaccacactgattgctattgcaggcatgacctgtgctagctgcgtccacagcatagaggggatgatcagccagttagaaggtgtccagcagataagtgtttctctcgccgaaggaaccgccaccgttctctacaacccaagcgtaatttcgcccgaagagctgcgggcggcaatcgaagacatggggtttgaagcctccgttgttagtgagtcttgttctaccaatccattaggtaaccacagcgcaggcaactcaatggttcaaaccaccgacgggacccctacttccgtacaggaggtcgccccccacaccggccgtctgccagctaatcatgcgcccgatatcctggcaaaatcgccccagtctacacgtgcggtagcaccacagaagtgcttcttgcagatcaaagggatgacctgtgcttcttgtgtcagtaacatcgaacgaaacctgcaaaaagaggcaggcgtgctgtctgtactggtggccctgatggccggcaaagccgagatcaaatacgaccccgaggtcatccagccgctagagattgcccagttcatccaggacctgggttttgaggctgccgtcatggaggactatgccggttctgacggtaacatcgaactgacaatcacggggatgacctgtgcctcatgtgtgcacaatattgaatccaagctcacgcggactaacggcataacttatgcttctgttgccttggcgactagcaaggccttggtgaagttcgaccctgagattatcggtcccagggacatcatcaagatcattgaagaaatcggattccacgctagtctggctcagcgcaaccccaatgcccaccaccttgaccataaaatggagatcaagcagtggaaaaaatctttcctttgcagccttgtcttcggaatacccgttatggcccttatgatttacatgctcattccgagcaatgaaccccaccaatcaatggtgttagaccacaatatcatccccggactcagtatccttaatctgatcttctttatcctctgtacatttgtgcagagcaaaactagtgaggccctcgcaaaactgatgtccctacaggctaccgaggcaaccgttgtcactctgggcgaggataatctcatcatccgcgaagagcaggtgcctatggagctcgttcaaagaggcgacatcgtgaaggtcgttccagggggcaagttcccagtcgacggcaaggtgcttgaggggaacacaatggctgatgaatcccttatcacaggtgaggctatgccagtaacaaaaaagcccggttctaccgttattgcaggatccatcaacgcccacgggtctgttctcatcaaagccactcacgtggggaacgataccaccctggcgcagatcgtgaaattagtcgaggaagctcagatgtcaaaagctccaattcagcagttagctgaccgcttctccggctacttcgttccatttattattattatgtccacactaacattagtcgtttggatagtaatcgggtttatagatttcggggtcgtgcagaggtatttccccaaccctaacaaacatataagccaaactgaggtaatcatccggtttgccttccagacaagcatcactgtcctctgcatagcatgcccatgttccctgggattggctacccccactgcagtcatggttggcaccggcgtggcggcccagaacggcatacttatcaaagggggaaaaccactggagatggctcataagatcaagactgtgatgttcgataaaactgggactattacccacggggtgcccagagttatgcgagtgctgctgttaggtgacgtggccaccctgcctctgcgtaaggtgctggccgtcgttggaacagccgaagcctctagcgaacacccgctgggcgttgccgtaacgaagtattgtaaggaagaactcggaaccgagacgctgggctattgtaccgactttcaagcagtgcccggctgcggaatcggctgtaaagtgtccaatgttgaaggcattctggctcacagtgaaagacccctcagtgcccctgcatcacatttaaacgaggcaggaagcctgcctgccgagaaggacgctgtgccgcagacatttagcgtcctgattggcaatcgagaatggctgagaagaaatggccttacgatctctagtgatgttagcgacgctatgaccgatcacgaaatgaagggacagacagccattctcgttgctattgacggggtgctctgcggcatgattgcaatcgcagacgctgttaaacaggaggctgcactcgcagtgcacacattgcagtccatgggagttgacgtggtgctaatcactggcgataaccggaagaccgctagggcgattgccacgcaggtgggaattaataaggtgtttgccgaagttttaccctcccacaaagtagccaaagtacaggagctgcagaataaaggcaagaaagtcgcgatggttggggatggtgtaaatgatagtcctgccctcgcacaagcggatatgggagttgcaatcgggacggggactgacgtggccatcgaagccgctgacgtggttctcattaggaacgatctgctcgatgtggtcgcctccattcacctatctaagcgcaccgtccgaaggatcaggatcaacctggttctggctctcatctacaacttagtcggcatcccaattgccgctggcgtgttcatgccaatcggtattgtactgcaaccttggatgggctccgccgccatggccgcttcatcagtgtctgtggttctaagttctctgcagttgaagtgttataagaagcccgacctcgaaaggtatgaagcccaagcgcatgggcatatgaaacctctgactgctagccaggtttctgtccatatcggcatggatgacaggtggcgcgattcaccaagagccacgccatgggaccaagtgtcctacgtgtctcaggtgtccctcagcagtcttacgtccgacaaaccttcaagacacagcgcagctgcagacgatgacggcgacaagtggtccctcctgcttaatggaagagacgaggagcaatatatttag

SEQ ID NO: 3628 - DNA, 1587 bp, Artificial Sequence
  Description of Artificial Sequence: Synthetic coding sequence
atgaagaagagcttcgccttcgacaacgtgggctacgagggcggcctagacggactcggaccatctagtcaggtggccacctccactgtgcgaatcttaggcatgacttgccaatcttgcgttaaatctattgaggatcgaatcagcaacttgaaagggataatttcaatgaaagtgtcactggaacaagggtctgctacggtaaagtacgtgccatccgtggtgtgtctgcagcaagtgtgccatcagataggggatatggggttcgaggctagtattgccgaagggaaggccgcatcttggccatcgaggtccctgcccgcacaggaggcagtggttaaactgcgggtcgaggggatgacatgtcagtcctgtgtatcttccatcgaagggaaggttcggaaactgcagggtgtggtgcgggtgaaagtgtctcttagcaaccaggaggccgtcatcacttaccagccctacctaattcagcctgaggacctccgtgatcatgtgaatgacatgggttttgaggcggccatcaagtcaaaggttgcccccctgtcactcggacctatcgatattgaacgcctccagagcacaaaccccaagagaccactttctagcgccaatcaaaacttcaacaatagcgaaactctcggccaccagggctctcatgtggtgaccctacagttaaggatagacgggatgcattgtaagtcttgtgtactgaacatcgaggaaaacattgggcagctgctcggcgttcagtctattcaggtgagcctggagaacaaaacggcccaggtgaagtacgacccgagttgtacatcccccgtggccttgcaaagggcaattgaggctctgccaccaggaaacttcaaagtgagcttacctgacggagcggaaggttcaggcactgaccaccgctcaagttcctcacacagcccagggagtccacctaggaaccaggttcagggaacatgtagtaccacactgatagccatcgcagggatgacgtgtgcttcctgcgtacacagtattgagggcatgatctctcaactagaaggcgtacagcagatctcagtgtccctggctgaggggactgccaccgtcctttacaatcctagtgtgatttctcccgaagaactgagagccgcgatcgaagatatggggtttgaggcttccgtcgtgtctgaatcttgctccacaaaccctctcggcaatcacagcgcagggaactctatggtgcaaaccacagacggcacgcctaccagcgtgcaagaagtcgcacctcatacaggccggcttcccgctaatcacgcgcccgacatcttagcaaaaagtccccagtctacgcgggcggtggccccacagaagtgcttcctacagatcaagggcatgacctgcgcctcttgtgtctcgaatattgagcggaacttacagaaagaagcagcccctcggtgggttgtgctgctacggtcgggtctgcaaatcagcgagacccaggtgagccagcatgggagggcccaccggcctgggcacaagcactgcctttgccttttttcaggccatcccggtggttgctgcggttag

SEQ ID NO: 3629 - DNA, 3966 bp, Artificial Sequence
  Description of Artificial Sequence: Synthetic coding sequence
atgagcgacagcgtgatcctgcggagcatcaagaagttcggcgaggaaaacgatggctttgaaagtgacaagtcttacaataatgataagaagagccgcctccaagacgagaagaagggcgacggcgtccgggtcggcttctttcagctgtttcgtttctcttcctctaccgacatctggctgatgtttgtggggtccctgtgtgcttttctgcacggtatcgcacagccaggagtgcttttaatcttcgggacgatgacggacgtcttcattgactatgacgttgaactccaggagctgcagatccctgggaaggcatgcgtcaacaacaccatagtgtggacaaatagtagtctcaatcagaatatgactaacggaactagatgtggtctgctcaatatcgaaagcgagatgataaaatttgccagctactatgccggaatcgccgtagctgttctgataaccgggtacattcagatctgcttctgggtgatagctgccgcacgtcagattcagaagatgagaaagttttactttcggagaataatgcggatggagattggatggttcgactgtaacagcgtcggagaattaaatacacggtttagcgacgacatcaacaaaattaatgatgcgatagccgaccagatggcactcttcattcaaagaatgacctccactatttgcggctttctgctcggcttttttcgcggatggaaactcacattggtgataatttccgtatcacccctcattggaataggggctgcaactattggcctctccgtgtcaaaattcacggattatgaacttaaagcctatgctaaagctggggttgtggccgacgaagtaatctcatcaatgcggacagtggccgcttttggtggagagaaacgcgaggtagagagatatgaaaagaacctcgtgtttgcccaacgttggggtattcgcaagggcatcgtaatgggattctttaccgggtttgtttggtgtctgattttcctttgttatgcgctggctttctggtatgggtccaccctggtcttagatgaaggcgagtacacccccggaacccttgttcagatattcctgtcagtcattgtgggcgccctgaatctcggaaatgctagcccatgccttgaggcgttcgctacagggagagctgccgcgactagtatttttgaaacaatagatagaaagcctatcattgattgtatgtctgaagacggctacaaactggacaggataaagggagagatcgaattccataacgtcactttccattatccatcaagaccagaggtgaaaattctcaatgatctgaacatggtgattaaaccgggcgagatgacggccctggtgggcccatctggggctggtaaatctactgcactccaactgattcagcggttctacgacccatgcgaaggaatggtaaccgtcgacggacacgacatccgaagtctgaatatccagtggctccgggaccagatcgggatagtagagcaagagccggtgctgttcagcaccactattgcggagaatattcggtatggaagggaagatgccactatggaggatatcgtgcaggcggcaaaggaggcaaatgcttacaacttcataatggacctcccccagcagtttgacactcttgttggtgaggggggtggtcaaatgagcggaggtcagaaacaaagggtggcaattgcccgcgctttgatccggaacccaaaaatcctcctacttgacatggccacctccgcgctagacaacgaaagcgaggcgatggtccaggaggtgcttagtaagatccaacacgggcatactataattagcgtggcccataggctgagcactgttagagccgccgataccatcattggatttgaacacggaaccgctgtggagcgtggtacgcacgaagaactgctggagcgtaagggcgtgtatttcaccctggtcacactccaaagccagggcaaccaggctctgaatgaggaagatatcaaggatgctaccgaagacgacatgctggcacgaaccttcagccggggatcctaccaggacagcctcagagccagtattaggcagcgatcaaaatcgcagctctcctatttggtgcatgagcctcccctggcagttgttgaccataagagcacttatgaagaagaccggaaagataaagacatacccgtgcaggaagaggtggagcccgcccccgttcgtcgtatcctgaaattttccgcacccgaatggccctacatgctggtggggtcggttggggcagccgtgaatggcaccgtgacgcccttatacgcttttctgttttctcagatcctgggcacctttagcatacctgataaagaagaacagcgtagtcagataaatggcgtgtgcctgctctttgtggcgatggggtgcgtcagtcttttcacccagttccttcagggctatgcgttcgcgaagagcggagagcttctgactaaacggctcagaaaatttggctttcgcgctatgctgggacaagacatcgcgtggtttgatgacctgagaaattcccctggcgctctgacaaccaggctggcaacagacgcaagccaggtccagggcgcagcaggttcccagatcggcatgattgtcaacagcttcactaacgtgacagtcgccatgataatagccttcagtttctcgtggaagctgtcgttagttatcctctgtttcttccccttcctcgctctgtccggcgccacccagactcgaatgctcactggctttgccagccgggacaaacaggctctggaaatggttggccaaatcactaacgaagccctctctaatattagaacggtcgcaggcatcggcaaagagcggcgcttcattgaggcgcttgagacagaacttgaaaaaccgttcaagaccgccattcagaaggctaatatctatggcttttgtttcgccttcgcccagtgtattatgtttattgccaactcagcctcttatcggtatgggggatatctcatcagcaatgaggggctgcattttagttacgttttcagagtcatcagtgctgttgttctgtccgccactgccctgggacgcgcgttctcgtacactccctcttacgccaaagctaaaatcagtgccgcccgcttctttcaacttctcgaccgccagcccccaatttcggtctacaacactgcgggcgagaagtgggataacttccaggggaagatcgatttcgtggactgtaagttcacatacccttctcgacccgattcccaagtcctgaatggactgagtgtatccatctctccgggccagacactcgccttcgttggctcctcagggtgtggcaagtctactagtatacagctgctcgagcggttctacgaccctgatcagggcaaagtgatgatagacggtcacgactccaagaaggtgaatgttcagtttctccgatccaatatcgggatagtatcccaggagccagtgctgttcgcatgttcaattatggacaacatcaagtatggggacaacacaaaagaaatacccatggagagagtgatagccgccgcaaagcaagctcagctgcatgacttcgtgatgagcctcccggagaagtacgagaccaatgtagggtcccaggggtctcaactttctcggggcgagaaacagcgaatcgcaatcgccagggcaatcgttcgtgacccaaagatcctgcttcttgacgaggctacaagcgccctggacactgaaagcgaaaaaaccgttcaggtggccctggacaaagccagagagggccgtacatgcattgtaatcgcccacaggctctccacaatacagaacgccgacatcatcgccgttatggcccagggggtggtgatcgaaaaggggacccatgaagagttgatggcccagaaaggagcttactacaagcttgtgaccaccggtagtcctatctcctag

SEQ ID NO: 3630 - DNA, 3861 bp, Artificial Sequence
  Description of Artificial Sequence: Synthetic coding sequence
atggacctggaggccgccaagaacggcaccgcctggcggcccacctctgccgagggagactttgagctcggcatttctagcaagcagaagcggaaaaaaacaaaaacagttaagatgatcggcgttttaacactgttccgatacagcgactggcaggataagctgttcatgagccttggaacgatcatggccatcgcacatggctctggcttacctctaatgatgattgtgttcggagaaatgacagataaatttgtggacacagctggtaacttctcatttcctgtcaattttagcctctccctgctgaacccaggaaagatccttgaagaggagatgacccgctacgcctactactattcgggcctcggggccggcgtgcttgtggccgcctacattcaggtctcattctggactcttgcagccggtcgacaaataagaaaaatccgccagaagttcttccatgccattcttcgccaggaaattggttggtttgacataaacgataccaccgagctgaacacccgcctgacagacgatatttccaagatttccgaaggcattggagacaaggtaggaatgttctttcaggctgtagctaccttttttgcaggtttcatcgtgggtttcatccgcgggtggaaactgaccctcgtcatcatggccataagtccgattctcggactttccgctgccgtgtgggcgaaaatcctgtctgccttttctgataaagaattagccgcttatgctaaagccggcgctgttgctgaggaagccctgggcgcaatcaggacggtcatagccttcggtggtcagaataaggagcttgaaaggtatcagaagcatctggaaaatgctaaggaaatcggcattaaaaaggcaattagcgcgaacatctctatgggcatagcttttcttctcatctacgctagctacgcgctggccttttggtatggcagtactcttgtcatcagtaaggagtacaccatcggaaacgccatgaccgtgttcttctctatcctgattggagcattctccgtagggcaggcagcgccctgcatcgacgcattcgccaacgctagaggagccgcttatgtaatcttcgacatcatcgataacaatcccaaaatagactctttttctgagagaggccacaagcctgactcgatcaagggaaatctggagtttaacgacgtccacttctcttaccccagtcgcgcgaacgtgaagatcctgaagggcctgaatctgaaggtgcaatccggtcagactgtggcactagtcgggtcttcaggatgcggcaagtcgaccacagtgcagctcatccagaggctgtacgacccggacgaggggacaatcaatattgatggccaggatatccggaacttcaatgtcaactacctgcgcgaaatcattggcgtggtgtctcaagagcccgtgctcttttccacaacaatcgcagaaaatatttgttatggcaggggtaacgtgacaatggatgagattaagaaagccgtaaaggaggccaatgcctacgagttcattatgaagttgccgcagaagttcgatacactcgtgggtgagaggggcgcccagcttagcggtggacagaaacaaaggattgctattgctagggccctcgtgaggaaccctaagattcttctgctggatgaagccacctccgccctcgacacagagtccgaagctgaagtccaggcagccctcgacaaggctcgcgaaggcagaaccaccatagtgatcgcccatcgcctgagcacagtgagaaatgcagacgtgatcgctggcttcgaggatggtgttatcgttgaacaaggtagccacagtgaactcatgaaaaaagagggggtatactttaagctggtgaacatgcagacgtccggttcacagatccagtcagaagagttcgagctcaatgatgagaaggccgctaccaggatggctccaaacgggtggaagagccgactttttcggcatagcacgcagaaaaacctgaaaaattctcagatgtgtcagaaatcactggacgtagagacggacggcctcgaggcaaatgtgccccccgtttcttttctgaaagttctgaaactgaacaagacagaatggccctatttcgtggtcggtacggtctgcgctatagcgaatggcgggctccaaccagctttctccgtgatcttctctgaaataattgccatctttgggcccggagatgacgcagtaaagcagcagaagtgcaatatcttctcgctgatctttcttttcctgggtattatctcattcttcacattcttcctgcagggatttacatttggcaaagctggggagattttgacacgacgattgagatctatggcctttaaagctatgctgcggcaggacatgagttggtttgacgaccacaaaaattccactggcgctctgagcacccggctagcaaccgatgcagctcaggtccaaggcgctactggcactcggctcgcgttgatcgcccagaacattgctaatctggggaccggaataattatttcctttatctacggatggcagctcactctgttgctgctggctgtggtgcccataatcgcagtttcgggtatagtcgagatgaagctgctggctgggaacgccaagagggacaagaaagaactggaggcagccggcaagattgccaccgaggccatcgagaatatcagaactgtggtaagcctgacacaggagagaaagttcgagtccatgtatgtggagaagctctacggcccatatcggaattcagtccaaaaggctcacatctacgggatcacattcagtatttcacaggctttcatgtacttcagttacgccggctgctttaggttcggcgcttacctcatcgttaacggtcacatgagattcagagacgtgatactggttttcagcgccattgttttcggagccgtggccttgggtcacgcatcttcctttgcccccgattatgcaaaagcaaagctcagtgccgctcacctgtttatgctcttcgagcggcagccactgatcgatagttactcggaggagggtttgaaacccgacaaattcgaaggcaacatcacatttaacgaggtcgttttcaattatcctacccgggcgaatgtgccagttctacaggggctctccctggaagtgaaaaaaggccaaacccttgcactcgtcggaagttctggctgtggcaagtccacagtggtgcaactgttagagcggttttacgatccactggcgggaacagtctttgtggactttggtttccagcttctagacgggcaagaggctaagaagttgaatgttcagtggctaagagctcagctgggcatcgtgagtcaggagcctatactgttcgattgctccatcgctgagaatatcgcttacggtgacaacagtcgcgtggtatctcaagacgaaatagtcagtgcagcaaaggctgctaacatccaccccttcatcgaaaccctgccccacaaatacgagacaagggttggagataaagggacccagctgtctggcggacagaaacagcggatcgccatcgcgcgggcactcatccgacagcctcagatcctactgctggacgaggcgacctctgctctcgacaccgagtcagagaaggtggtgcaggaagcactggacaaggcccgcgaagggcgcacatgtattgtaattgctcacagactttctacaatccagaacgcagatctcatcgtggtttttcagaatgggcgagtgaaggaacacggcacccaccaacagctgctggctcagaaaggcatctacttctccatggtatccgttcaggccgggactcagaacctctag

SEQ ID NO: 3631 - DNA, 3699 bp, Artificial Sequence
  Description of Artificial Sequence: Synthetic coding sequence
atggacctggaggccgccaagaacggcaccgcctggcggcccaccagtgccgaaggagatttcgagttggggatctcaagcaagcagaagcgaaaaaaaaccaaaaccgtgaagatgataggcgtgttgacactgtttagatactccgattggcaagacaagctatttatgtcactcggcactatcatggccatagcccacgggagcgggctgccactgatgatgatcgtattcggggagatgacagataagttcgtagatacagccggaaacttctcattccccgtcaatttctctctgtctctgctcaatcctggcaagattctcgaagaagaaatgacaaggtatgcctactactattctggtctgggggcgggggtgctcgtcgcagcatacatccaagtcagcttctggactctcgcagccggtaggcaaatcaggaagattcgccagaaatttttccacgctatactgagacaggaaattggatggttcgatattaacgataccactgaactgaacacacgcctgacggacgatatttcgaagatcagcgaggggattggcgacaaggtaggcatgtttttccaagccgttgcaaccttcttcgctggattcattgttggtttcatccggggctggaaactgacactcgttatcatggctatcagtccgattctggggttatcagccgccgtgtgggccaagatactgtctgctttttccgataaggagctggctgcttatgctaaggccggtgccgtggctgaggaggccttaggagcgattcggaccgttatcgcgtttggtggacagaataaagagctcgagcgctatcagaagcaccttgagaatgcaaaagagattggtattaaaaaggccattagtgctaatattagcatgggaatcgcctttctattaatttacgccagctacgctctggctttttggtatggttccacgcttgtcattagcaaagagtacacaatcggcaacgccatgactgtgttcttttcaattctgataggcgcttttagcgttgggcaggccgccccctgcattgatgccttcgcaaatgctcgcggggccgcttacgtcattttcgacatcattgataacaatcccaagatcgacagcttttctgagcgagggcataaaccagatagcataaaaggtaacctcgaatttaatgatgtgcacttcagctatccctccagagctaacgtcaagatcctgaaggggctgaatttgaaggttcagtccggccaaaccgtcgctcttgtgggtagctctgggtgcggaaagagcactaccgtccagctgattcagcgcttgtatgatcctgacgaagggacaataaacatagatggccaggacattcggaatttcaacgttaattaccttcgggagataattggcgtggtttctcaggaacccgtccttttctccacaacaattgccgaaaatatctgctatgggcgaggtaacgtcactatggacgaaattaagaaggctgtaaaagaggccaacgcctatgagtttattatgaagctgcctcagaagtttgatacgctggtcggcgagaggggtgcgcaactgtctggcggacagaagcaacgcatcgctatcgcaagagctctagtgcggaatccgaaaatcttactgcttgatgaagccacctccgccctggatacggagagtgaggcagaagtgcaggcggctctagataaagctcgagagggaaggacaaccatcgtaattgcacacaggctgtctactgtccggaatgcggacgtcatcgccgggtttgaggacggtgtgatagtggagcaaggcagccactccgaactgatgaaaaaagaaggggtctactttaagctcgtgaatatgcagactagcggtagtcagattcagagcgaggaatttgagctgaacgacgaaaaggccgccacgagaatggcccctaacggttggaaatctagattgttccggcattcgacacagaaaaaccttaaaaattcccaaatgtgccaaaagtcactggacgtggagaccgatggcctggaggcaaacgtgcctcctgtgtcatttttaaaggtcctgaagctgaacaaaacagagtggccctactttgtcgtgggaaccgtgtgtgctatcgcaaacggtggccttcagcctgccttctctgtcatcttctctgagattatcgctatcttcggaccaggagacgacgccgtgaaacaacagaaatgcaatattttcagtctgatttttctatttctgggtattatttcattttttactttctttctgcaaggcttcacctttggaaaggctggggaaattttgactcgccgactgagaagtatggcattcaaggccatgttacgtcaggacatgagttggtttgacgaccacaaaaatagcacgggcgccctatctacccgcttggccaccgacgctgcccaggttcaaggagcgaccggtactagactggccctaatagcgcaaaacatcgcgaatctgggcaccggcattatcatctcttttatttatggctggcagctgaccctgctgttgttggcagtggttcctatcatcgcggtttcaggaattgtcgaaatgaaattactcgctggaaatgccaagcgagataaaaaggagcttgaggcagccggtaaaatcgctactgaagcgatcgagaacattcgaaccgtggtcagtctaactcaggaaaggaagttcgaaagcatgtacgtggagaagctctacggtccttatcgggtgttctccgcgatcgtgttcggcgctgtggccctgggacacgcatctagcttcgcccccgactatgctaaggctaagctcagtgcggcccatttgtttatgctcttcgagcgccagcccctgatcgacagctattccgaagagggccttaaaccagataaattcgagggaaatattactttcaacgaggttgtgttcaactacccaacgcgggctaatgtgccggtgctgcagggcctgtctttggaagtgaagaaagggcaaacactggcactcgtgggcagtagcggatgcggcaagagcacagtggtgcagttgctggagaggttttatgatcccctcgcgggaaccgtgcttctggatggacaagaagccaagaaactcaatgtgcagtggctgcgggcacaattgggcattgtctctcaggagccaatcctttttgactgcagtattgctgaaaacattgcttatggcgacaacagtcgggtggttagccaggatgagatcgtctctgctgccaaggccgcgaacatacatcccttcattgaaactctccctcacaaatacgagacacgcgtgggcgacaaaggcacccagctctcaggaggccagaagcagcgcattgccatcgccagagctttgatcaggcagccgcagatcctgctgctggacgaagccaccagtgcgctagacaccgaatcggagaaagtggtgcaggaagcccttgacaaggcgcgggaaggaaggacctgtatagtgatagcccacagactgtccactatccagaatgctgatctgatcgtcgtgtttcagaatggcagagtcaaagaacacggcacgcatcagcaactgctcgcgcagaaaggaatttacttctccatggtttctgtgcaggctgggacccagaacctatag

SEQ ID NO: 3632 - DNA, 3840 bp, Artificial Sequence
  Description of Artificial Sequence: Synthetic coding sequence
atggacctggaggccgccaagaacggcaccgcctggcggcccacctccgctgagggagatttcgaactgggaatctccagcaagcagaaacggaaaaagaccaagactgtcaaaatgattggagtgctgactctgtttagatatagtgattggcaggataaactgtttatgtctctgggcaccatcatggccatcgcccatggttcagggctgcccctgatgatgatagtctttggagaaatgacagacaaattcgttgatactgcaggtaactttagctttccggtgaacttttcgttgtcattgctcaacccaggcaaaattctggaagaagaaatgacaagatacgcttactactattccgggttgggcgcgggcgtgctggtcgccgcctacatccaggtaagcttctggaccctcgccgcaggccggcaaatccgaaaaatccgacagaagttcttccacgccatcctacggcaggaaatcggttggttcgacataaacgatacaacagaacttaatacacggctgacagatgatatctcaaaaatctcagagggcatcggtgataaagtcggcatgttctttcaggcggtggccacctttttcgccggcttcatcgtaggcttcatacgcggctggaagcttaccctagttatcatggccatctctcccatactggggctgagcgccgcagtctgggctaaaatcttatccgcattttccgataaagaacttgcagcgtatgccaaagctggagcagtcgccgaggaagccctcggggccatccggaccgtaatcgcgttcgggggacaaaataaggagttagaacggtaccaaaagcacctcgaaaatgcaaaagagattggtataaagaaagctattagtgccaacatcagcatggggatagcatttttactgatttacgcctcttacgctctggcattctggtacggctccacgcttgtgataagtaaggaatacactattggaaacgccatgaccgtgttcttcagtattttgatcggagccttttccgttggccaggccgctccctgcattgacgcctttgctaatgcgagaggggccgcttatgtgatcttcgatatcattgataataaccccaaaatagatagtttctctgagaggggccataagcccgattctatcaaagggaatttggaattcaacgacgtgcactttagctatccaagccgcgccaacgttaagatcctgaaggggctgaaccttaaggtgcagtctggtcagactgtggcactggtaggttcaagcgggtgcgggaaaagcactacagtgcagctgattcagcgtctgtacgaccccgatgagggcacaatcaacattgacgggcaggacatccgcaacttcaatgtcaactatttgagagagattattggagtcgtctcacaggaacctgttttattctctacgacaatcgctgagaatatctgctatggtcgcggcaatgtgacaatggatgaaatcaaaaaagcagttaaagaggcaaatgcatatgaattcattatgaagctccctcagaagttcgacaccctggtgggagaaaggggtgctcaactatccggagggcagaagcagaggatcgctattgccagagccctggtcagaaaccccaagatcctgctgctggatgaggccacctccgcactggatacagagtcagaggctgaggtgcaggccgcgctggacaaggcccgagagggcagaacaactatagtgattgcgcatagactgtcgacagtgcgcaatgcagacgtgatcgctggttttgaagacggcgtaatagtggagcagggctctcactctgagttgatgaagaaagaaggtgtgtattttaagctggtaaatatgcagacttccgggagccaaatccagagcgaggagttcgaactcaatgacgagaaagcagctacccgcatggcccccaacggttggaagtcgagactttttcggcattctacacagaagaaccttaaaaactcccagatgtgccagaaatcactcgacgtggagacagatggccttgaagcgaacgtccctcctgtgtcgttcctgaaagttctcaaactaaacaaaacagaatggccctatttcgttgtgggcaccgtgtgtgccatcgccaacggcggccttcagcctgccttcagtgtcattttttctgaaatcatagctatattcggacctggtgatgatgctgtgaagcaacaaaaatgcaatatcttcagcctaatttttcttttccttgggattatctctttcttcactttcttcttgcaaggtttcacgttcgggaaggccggtgaaattttaactaggagactgcgaagcatggcttttaaggccatgctccgtcaggatatgagttggttcgacgatcataagaattctactggtgcattaagcacaagattagctaccgacgcggctcaagtgcaaggcgccacaggcacccgcctggccttaattgctcagaatatcgccaacctgggcactgggataatcatctcatttatttatggatggcaactgaccctgctcctgcttgctgtggtgcccattatcgcagtgagcggaatagtggaaatgaagcttctggccggcaacgccaagagagataagaaggaactggaagccgcaggcaagatcgccaccgaggccattgaaaatatccgtactgtagtaagcctcacacaggagaggaagttcgagagcatgtacgtggaaaagctctacggaccttaccgtaacagcgtccaaaaggctcatatctacgggatcactttttcaatctcccaggcatttatgtacttttcctatgccggctgctttaggttcggagcgtaccttatagtgaatggtcacatgagatttcgcgatgtcatcctcgtttttagcgccatcgtcttcggcgctgtagcgctgggccatgcctcctcttttgccccagactatgccaaggccaagctgagtgcagcacacttattcatgctgttcgaaagacagcccttgattgacagttatagtgaagagggtctcaaacctgacaaattcgaagggaacattacattcaacgaagtggtgtttaattaccccacccgggcaaacgtacctgtacttcagggcctgtctcttgaagtgaaaaagggtcaaaccttggctttggttgggtcctctggttgcggcaaatccactgtagtgcagctgcttgagaggttctatgaccctttggcaggaactgtccttctggatggccaggaggccaaaaagctcaatgtacagtggctgcgggcacagcttggcatcgtgtcccaagaacccattctgttcgattgctccatcgccgagaatatcgcttacggagacaactctcgcgtggtgagtcaggatgaaattgtgtcagctgctaaggcagctaatattcatcccttcattgagactctcccacacaagtatgagactcgagtgggcgacaagggaacccagctctccggcggccagaagcagagaatcgctatagcacgagcgctcattaggcaaccacaaatcctcctcctcgatgaggccacatctgccctggatactgagtcagagaaagtagtgcaggaagctttggacaaagctcgcgagggtcgcacctgtattgtgatcgcacatagactcagcacaatccagaatgctgacctgatcgtcgtgttccaaaatggtcgagtcaaagaacacggaacccatcaacagctcctggctcagaaggggatctacttctcaatggtgtccgtccaggccggtactcagaacctttag

SEQ ID NO: 3633 - DNA, 186 bp, Artificial Sequence
  Description of Artificial Sequence: Synthetic coding sequence
atggacctggaggccgccaagaacggcaccgcctggcggcccacctctgcagagggggactttgagctgggcatttcatcaaaacagaagaggaaaaagaccaaaaccgtgaagatgatcggggtgctgactttgttcagatactcggattggcaggacaagttgttcatgagcctggggacatag

SEQ ID NO: 3634 - DNA, 3699 bp, Artificial Sequence
  Description of Artificial Sequence: Synthetic coding sequence
atggacctggaggccgccaagaacggcaccgcctggcggcccacctccgccgaaggggatttcgaattgggtattagctctaaacagaaaagaaagaagactaagaccgtaaagatgatcggagtgttgactctcttcagatacagtgattggcaagataagctgtttatgtcccttggtaccatcatggcaattgcccatgggtctggactgccgctgatgatgattgtgttcggtgagatgaccgacaagttcgtggacacagccggcaacttctcgttccccgtgaacttctccctctcgctgcttaatccaggaaagatcctggaggaggaaatgacacgttatgcatactattattctggactgggggccggtgtgctcgtagcggcctatatacaggttagcttctggaccctcgctgcgggacggcagattcgaaaaataagacagaagttctttcatgcgattctgcgacaagaaattggatggttcgacatcaacgatacaactgagcttaatactcggctaaccgatgatatcagcaagatttccgagggcatcggggataaagttggaatgttcttccaggccgttgcaacattcttcgccggatttatagtcggtttcatacgaggatggaagctgacattggtgatcatggccattagtccgatcttaggtctatccgccgctgtatgggctaaaattctctccgctttttccgacaaggagcttgcagcttacgcaaaagccggggctgtggccgaggaagccctcggggccattcgtactgtcattgcattcggcggtcagaacaaggagctcgaacgctatcagaagcacttagagaacgccaaggaaatcggcatcaagaaggccattagcgcaaacatctctatgggcatagctttcctgctaatttacgcaagctacgctctggcgttttggtatggtagtaccctggttatctccaaggagtacaccataggtaacgctatgaccgttttctttagtatacttatcggcgcttttagcgtgggacaggcagccccctgtattgacgcgtttgccaatgctaggggcgcagcctacgtgattttcgacataattgacaacaatcccaaaatagattcctttagcgagcgtggtcataagcccgattcaattaaaggcaaccttgagtttaatgacgtccacttctcgtatccctcacgagccaacgttaagatactgaagggactaaacctgaaggtccaatcgggtcaaactgtcgctctggttggttcctctggatgtggaaaaagtacaacggttcagctaattcagcggctgtacgaccctgacgagggaaccataaacatcgacggccaggacattaggaattttaatgtgaactacctgcgagagatcattggcgtggtgagtcaggaacctgttctgttttctacaacgatcgcagagaatatctgttacggcaggggcaacgtgacgatggatgagatcaaaaaggccgtgaaagaagcgaacgcttatgagtttatcatgaagctcccgcagaagttcgacacacttgtgggggagcgaggggctcagctgtctgggggtcagaagcagagaattgcaatcgctcgagcactcgtccggaatcctaaaatcctgctgctggacgaggccaccagcgcactggacactgagtccgaggctgaggtgcaagccgccttggataaggccagagaggggcggactaccatcgtgatcgcacatagactatcaaccgtgcggaatgcggatgtcatcgcaggatttgaagacggagtgattgttgaacagggatcgcactcagagctgatgaaaaaagagggggtgtactttaagctcgtaaatatgcagacctcagggagccagatacaaagcgaagaatttgagttgaatgacgagaaagcggccaccagaatggctcctaacggatggaagagccgccttttcaggcacagtacacagaaaaatctcaagaattctcagatgtgtcagaaatctttggacgtggaaaccgatgggctggaggccaacgtgcctcccgtgtctttcctgaaagtgctcaaattgaacaaaacagaatggccgtactttgtggtaggaacggtctgtgccattgccaacgggggcctccagcccgccttcagtgtcatcttctccgagataattgcaattttcggcccaggagatgacgccgtaaaacagcaaaagtgtaacattttcagcctaatattcctgtttctgggtatcatcagcttctttacatttttcctacagggcttcacctttgggaaagccggtgaaatcctcactcggcgactccgctccatggccttcaaggctatgctgagacaggacatgtcatggtttgacgaccacaaaaattcaaccggagctctgagcacacggcttgcaaccgatgccgctcaggtacagggggctacaggaacccgccttgcgctcatcgcccagaacatcgcgaacttagggactggcataatcatctcttttatctatgggtggcaacttaccctcctgttgctggccgttgttcccattatagcagtaagtggcattgtggagatgaagcttcttgcggggaatgcgaaaagagataaaaaggaattagaggcagccgggaagatcgcaaccgaggctattgagaatattcgcaccgtcgtgtctcttacccaggagagaaagttcgagtcaatgtacgtcgaaaaactgtacgggccctacagagttttctctgcaatagtgtttggggcagtggctctcggtcacgcctctagttttgctcccgactatgcaaaagcaaagctgtcggccgcacatcttttcatgctttttgaaagacaaccactgatagacagctattctgaggagggattgaaaccagacaagttcgaggggaatatcactttcaatgaggtggtgttcaattatccaacacgggcgaatgtgcctgtgctgcagggactgagtctggaagtcaagaagggccaaacccttgcactggttggctcaagcggttgtggcaagagtacagtcgttcagctccttgaacgattttatgacccacttgcaggtaccgtgctgctggatggccaggaagcaaagaaactgaacgtccagtggctgcgagcccagttggggattgtgtcccaggaaccaatactgttcgattgctccatcgcagaaaacatagcctacggagacaactcccgggtggtgtcccaggatgagatcgtctcagctgcaaaagccgcaaacatacacccatttatagaaacactgccccacaaatatgagacacgagtcggtgacaaggggactcagctgagcgggggtcagaaacagcggattgcgatcgcgagggctctgatcagacagcctcagattctgctgctcgatgaagctaccagcgccctggataccgaaagtgaaaaagtcgtccaggaggcacttgacaaggcacgagaggggagaacttgcattgtcattgcccaccggttgtccacaatccagaacgccgatttgatcgtggtgtttcagaatgggagggtgaaagagcacgggacacatcagcagctgcttgcccagaaggggatctatttttccatggtaagtgtgcaggccggtacacagaatctgtag

SEQ ID NO: 3635 - DNA, 3840 bp, Artificial Sequence
  Description of Artificial Sequence: Synthetic coding sequence
atggacctggaggccgccaagaacggcaccgcctggcggcccaccagcgctgaaggtgactttgagcttggaattagtagtaagcagaagaggaaaaagactaagacagttaagatgattggagtgctaaccctcttccggtactcggattggcaagacaaactattcatgagtctgggcactatcatggcaattgcacatggctcaggtcttcctcttatgatgatagtttttggcgagatgaccgataagttcgtggatacagccggaaatttcagctttccagtgaacttctccttatccctgctgaatcctggaaaaatacttgaggaggagatgaccaggtacgcctactactacagtgggttgggtgctggcgtcctggtggccgcttacatccaggtgtccttctggacactggctgcggggcgccagattcgtaaaatacggcaaaagtttttccatgccatattgcgccaggagattggatggttcgacattaatgacaccaccgaactcaatactcgcctcactgatgacatcagtaagattagtgagggaatcggcgataaggttggcatgtttttccaggccgtggctactttctttgccggttttatcgtgggctttatcagaggctggaagcttactctagtcattatggctatcagccctatcctgggtctttctgcagcagtgtgggcgaaaattctgtctgcattctcggacaaggaactggccgcctacgcaaaggctggcgcggttgcggaggaagctctgggcgccattcggacagtgatcgcttttggtggccagaataaagaattagagaggtatcagaagcatctggaaaacgctaaggaaataggaattaagaaggctataagcgccaatatctcgatgggaatcgccttcctgctgatttatgccagctatgccctcgcattttggtatggctcaaccctggttatttcaaaggaatacaccatcggcaatgcaatgaccgtatttttttccattctaattggagcatttagtgtcgggcaggcagctccatgtattgatgctttcgcgaacgctaggggagcagcctatgttatctttgacattatcgataataatcccaaaatcgatagtttttccgaacgagggcacaagcctgactccattaaaggtaacctggagttcaacgacgtgcacttcagttatccctcacgtgctaatgtcaagattctgaaaggtctcaatcttaaagtccagtcaggacagaccgttgccctggttggcagcagcgggtgtgggaagagcactacggtgcaactgatccagcggttatatgacccagacgaagggaccatcaacatagacgggcaggacattagaaacttcaatgtgaattacctgcgcgagattatcggagtcgttagtcaggaacctgttctgtttagtacaacaattgcggagaatatctgctacgggagagggaacgttactatggacgaaataaagaaagctgtgaaggaagctaatgcctatgagttcataatgaagctcccacagaaatttgacacacttgtcggggagagaggagcccagttgagcggcggtcagaagcagcgcattgcaattgccagggcattagtacgcaatcccaagatccttctcctggatgaggccacttctgctctggatacagaatccgaagctgaggtgcaggcagcactggacaaggccagggaggggcggactaccatagttatcgcacatagactttccacagtacgcaacgccgacgtgattgccggatttgaggatggtgtgattgtggagcagggatcgcactccgaactgatgaaaaaagaaggggtttatttcaagcttgtgaacatgcagacatccggatcccagatccagagtgaagaattcgagttgaacgatgagaaagctgctaccagaatggctcccaacggatggaagtcaaggctgttccgccatagcacccaaaagaacctaaaaaactcacagatgtgtcaaaagtccttggatgttgaaacagatggcctcgaagccaatgtgccgcccgtctcattcctaaaggtactgaagctcaataaaactgagtggccgtattttgttgtaggaactgtgtgtgctatcgcgaatgggggtcttcagcccgccttttccgtaattttctcagagataatcgccatttttggtccaggagacgacgccgttaagcagcagaagtgcaacatcttcagtctgatcttcttatttctggggatcatatcattttttacgttctttctgcagggattcacctttggaaaggctggcgagattcttaccaggaggctgagatctatggccttcaaggctatgctgcgtcaagatatgagttggtttgacgaccataagaattccaccggcgcactgtccactcgattagccaccgatgccgcccaggtgcaaggggccactggtaccagactggccctcatcgcacaaaatattgcaaacctgggcaccggaatcataattagcttcatctatggatggcaattaacactgctgctgttagctgtggtgcctattatcgcagtcagtggaatcgtggaaatgaagttattggccggtaatgcaaagagggacaagaaagagttagaggccgccggtaaaatcgcgactgaggccatcgagaacatacggaccgttgtgtccctgacccaagaacgcaagttcgaaagcatgtacgtggagaagctgtatgggccctaccggaattcagttcagaaagcccacatctacggtatcactttttcaatcagtcaagccttcatgtacttctcctacgctggatgtttcagattcggagcttacctgatagtgaacggccatatgaggttcagagatgtcatccttgtgttttctgctatagtatttggggcagtcgctctgggccatgcatcctccttcgcccctgattacgctaaagccaagctgagcgcagcgcatctgttcatgctgttcgagagacaacccttgatagactcatactccgaggaggggctcaaaccggataaattcgaagggaatatcacattcaacgaggtcgtgttcaactaccctacacgcgcaaatgtgccagttcttcagggcctgagcctcgaagttaaaaaggggcagaccctggcgttggttgggtcttccggatgtggaaaaagcaccgtagtgcagctcttggagcgtttctacgatccactagccggtacggtgctcctcgatggccaggaggcaaagaaactgaacgtccagtggctcagggcccagttggggattgtgagccaggaaccaatcctgttcgattgtagcatagcagaaaacattgcctacggcgacaattccagggtggtgtctcaggatgaaattgtatccgccgctaaggctgcgaacatacacccctttatcgaaacactcccgcacaaatacgagaccagagtgggcgataaaggcactcagctctctggagggcagaaacagcgcattgcaatcgcaagagctctgattagacagcctcagatacttctgctggatgaggccacaagtgccttggacacggaatcagaaaaggtagttcaggaagctctggataaggcacgcgagggccgcacctgcattgttattgcccatagactcagcactattcaaaatgccgacctgattgtggtattccagaatggccgagtaaaggagcacggaacccaccagcagctgctggcgcagaaggggatctacttcagcatggtgtccgtgcaggccggaacccagaatctgtag

SEQ ID NO: 3636 - DNA, 1464 bp, Artificial Sequence
  Description of Artificial Sequence: Synthetic coding sequence
atgcgggagaacatggcccggggcccctgcaacgccccccggtgggccagtctgatggtgttagtagctattggcacagccgtgaccgccgccgtgaacccgggcgtggtggttcgtatctcacagaaaggcctggattacgcgagccaacaggggaccgctgccctccagaaggaactgaaaagaatcaaaatcccagattactccgattcttttaaaatcaagcacttgggaaaagggcactactccttctacagtatggacatacgtgagttccagctcccttcatctcagattagcatggtgcccaacgttggactgaagtttagcattagtaatgcgaatatcaaaatctctggaaagtggaaggcacaaaaacgatttcttaaaatgagcggtaatttcgacctgagcattgagggcatgtcaatttctgcagacctgaagttggggagtaaccccacctccggcaagcctacaattacctgtagcagttgttccagccatataaattctgtgcatgtacatatcagcaaaagtaaagttggatggctcatacagctgtttcacaagaagatcgaaagcgctttgcgtaataagatgaactcccaggtttgtgaaaaagtgacaaattctgtatcgagtgaattgcaaccctacttccaaactctgcctgtaatgactaaaattgactcagttgccggcataaattatggcctcgtcgcaccacccgcaactactgccgaaacactggacgtgcaaatgaagggcgaattttatagcgagaatcatcacaatccaccaccatttgctcctccagtaatggagtttcccgccgcccatgaccgcatggtgtacctcgggcttagtgattactttttcaacactgctgggctcgtgtaccaagaagccggagtcctgaaaatgaccctgcgcgacgacatgatccccaaagaatccaagttccggctcaccaccaaattcttcggcacattcctccccgaggtggctaaaaagtttcccaacatgaagattcaaattcatgtcagcgctagcactccacctcacctgtccgtccaaccgacaggtctcacattttaccccgccgttgacgttcaggctttcgccgttctccccaacagttctctcgcttccttgttcctcattgggatgcataccacaggctcgatggaggtgtctgccgagagcaatcgtcttgtaggcgaacttaaattagatagactgctcctggaactgaagcacagcaacattgggccattccctgttgaacttctgcaggacatcatgaattatattgtcccaatcctcgttctgcctcgggtgaatgaaaaacttcagaagggattccccttgcctacccctgcccgggtccaactttataatgtcgttctccagccacaccagaattttctcctttttggagccgacgtggtttacaaatag

SEQ ID NO: 3637 - DNA, 1449 bp, Artificial Sequence
  Description of Artificial Sequence: Synthetic coding sequence
atggacgagggcatcccccacctgcaggagcggcagctgctggagcatcgagacttcattgggttggattacagttccctttatatgtgcaaacctaagcggtccatgaaacgtgacgacacaaaggatacgtataaattaccccacagacttattgagaaaaaacgacgggacaggattaacgagtgcatcgcccaactgaaagaccttctacctgaacatctcaagctgacgaccctgggacatctggagaaggccgtcgttctggagctgaccctgaaacacctgaaagctctaaccgctctcacagaacagcagcaccaaaagataattgccctgcagaatggagaacgttcgttgaaatcacctatccagtcggatctggatgctttccatagtgggtttcaaacctgtgctaaggaggtcctacaatatctgagccgatttgagtcgtggacgccacgcgaaccgaggtgtgtacagcttatcaaccatctgcatgcggtggcgacgcagttcctgccaactccgcagctcctaacacagcaggtgcccctttctaagggcacaggtgcaccatctgccgcaggaagcgcagctgcaccttgtctggaacgagccggacaaaaactagagccattggcatattgtgtgccagtgatccagcggactcaaccgagcgcagagttggccgccgaaaacgacaccgatacagattcaggctatggcggcgaggccgaggctcggcccgacagagagaaagggaagggcgccggagccagtagagtgactatcaaacaagagccacctggcgaggactcccctgcgcctaagagaatgaaattagactccaggggaggaggatctggagggggtcctggcggtggcgcagccgctgcggccgccgcactattgggtcccgacccagcagctgcagctgcactgctcaggccagacgccgctctgctgagttctctggtcgcttttggcggaggaggaggagcccccttcccccagcccgccgctgccgcagcacccttttgcttgcctttctgcttcctgtctccttccgcggctgccgcctacgtgcagcccttcttagataaaagcgggctcgagaaatatctctatccagctgccgccgctgccccttttccactgctctaccccggaatacccgccccggctgcagccgccgctgcagctgctgctgcagccgcggcagctgcagcattcccttgtttatcatccgttctaagtcctccccccgaaaaagcaggggccgcagcggctactttactcccacacgaggtcgctcctctaggcgcccctcaccctcagcacccacacgggaggacccacttgccatttgcaggcccgagggaacccggcaatcctgagagtagcgctcaggaggatccctcacagccaggaaaagaagccccttag

SEQ ID NO: 3638 - DNA, 1113 bp, Artificial Sequence
  Description of Artificial Sequence: Synthetic coding sequence
atggacgagggcatcccccacctgcaggagcggcagctgctggagcacagggatttcatcggcctggactacagctcactgtatatgtgcaagccaaaaaggtccatgaaacgggatgatacaaaagatacatacaaattgccacaccggctcattgagaagaagcgacgcgacagaataaatgagtgcatcgcccaacttaaagatttactacctgaacatcttaagttgactacactcggacacctcgagaaggctgtcgtgctggagctaactctcaaacatttgaaagccttaaccgctctcaccgaacaacagcaccaaaagatcatcgccttgcaaaacggcgagagatccctaaaaagccctattcagtctgacctggacgcatttcattcaggcttccagacctgcgccaaggaggtcctccagtacctgtccagatttgaatcctggacaccgcgggagcctcgatgcgttcagctgattaaccaccttcatgctgttgctacacaatttcttccaacaccacagctcttgacacagcaggtgcctctgagcaagggtacgggggctccctcagcggccggatctgccgctgctccctgcctggagagagcaggacagaagctcgaacccctggcatactgcgttcccgtcattcagcgcacccagcccagcgccgaactggccgccgaaaacgacacggacacagattcgggttatggcggggaggccgaagcccggccagaccgcgagaaagggaagggagccggcgctagccgtgttaccatcaagcaggaaccaccaggagaggacagccctccaccacctcctcgctctccggcgtgccccagatgctgtagaccactgcctcgacgccgggccccaccaccccgtccgtcgtgcaggactcggtggagacctctcggaaggcgaacaccttcaacccgcacagccgctcccacctgcccctcacccgggcctgcatcaagggggacacggcgggcattgctgagaaagattccacggtcccaggagaggaagctgcctgagagcctgaggcccgaaggtcgccggtttaagcagagtgagaagctcaaatacccgtag

SEQ ID NO: 3639 - DNA, 1191 bp, Artificial Sequence
  Description of Artificial Sequence: Synthetic coding sequence
atggtggccggcacccggtgcctgctggccctgctgctgccccaggtgctactcggcggagcagccggccttgtgcctgagctgggcaggaggaagtttgccgcagcctctagcgggaggccctccagccagccatccgatgaagtgcttagcgaattcgagctgcggctcctgtcgatgtttgggctgaagcagcgccctactccctccagggacgctgtggtgccgccttatatgttggacctgtatcgccgccatagcgggcagccgggaagtcctgccccggatcacaggctcgaaagggccgccagccgcgccaacacagtcagaagtttccaccatgaggagtctttggaggaactgccagagactagcggtaaaactacgcggcgtttctttttcaatctaagctctatccctacagaggagtttattaccagcgcagaactgcaggtgttcagagagcagatgcaggacgcactgggaaataacagctctttccatcatagaattaacatatatgagattatcaaaccagctaccgctaactcaaaatttccggtgacccggcttctggacacccgactcgtaaaccaaaatgcctcacggtgggagtctttcgatgtgacccccgctgtaatgcgatggaccgctcaaggccacgcaaatcatgggtttgtggtggaagtcgcccatcttgaagaaaagcagggtgtgagtaagcgccatgtgaggattagtagaagtctgcaccaggatgagcattcctggtctcagatccgccctctcctggtcacgtttggacacgatggtaagggacatcctctgcataagagggagaagagacaagctaaacacaagcagcgcaagcgactaaagtcctcctgcaagaggcatccgctctacgtggatttttctgatgttggctggaacgactggattgtggcaccacccgggtaccatgcgttctattgtcacggtgagtgccctttcccactggccgaccatctcaatagcaccaaccacgcgatagtccagacactagtgaactctgtaaatagcaagattcccaaggcctgttgtgtgcccaccgagctgagtgctatctctatgctgtatctagatgaaaacgagaaggttgtcctgaagaattatcaggatatggtagtagaaggatgcggctgtcggtag

SEQ ID NO: 3640 - DNA, 1296 bp, Artificial Sequence
  Description of Artificial Sequence: Synthetic coding sequence
atgcacgtgcggagcctgcgggccgccgccccccacagcttcgtggctctttgggcgcccctgttcttactgagaagtgctctcgctgacttctcactggataatgaggttcattcttctttcatacaccggcggctgcgatctcaggaaagacgagagatgcagagggagattctttccatcttaggcctgcctcacagaccgagacctcacttacagggtaaacacaattctgcgcccatgttcatgctggatctgtataatgccatggccgtcgaggaaggaggtggccctgggggacagggattttcctatccttataaggccgtattttcaactcaaggtccccctctggcctcattgcaggacagccatttcctcacagatgccgacatggtcatgtccttcgtgaatcttgtcgaacacgacaaagaatttttccatcccagataccaccacagggagtttaggtttgatctctccaagatacccgaaggagaggccgtcactgccgcggaattcaggatttataaagactacattcgggagaggtttgacaacgaaacatttcgtatatctgtataccaagtattacaggaacacctgggaagggagtcagacctgttcttgttggattcccggacgctgtgggcgtccgaggaaggatggctcgtgttcgacattaccgccacatcgaatcactgggtagtgaatcccagacacaacttaggcttacagttatccgtggagaccctcgacggccagagcattaatcctaaactcgctgggctgataggaagacatggccctcagaataaacagcctttcatggtcgcattctttaaagccacagaggtgcatttcaggagcatacgctctacagggagtaagcagagatctcaaaatcgcagtaagacccctaaaaatcaggaggctttacggatggccaacgttgctgaaaactcctcaagcgaccaacggcaagcatgtaaaaaacatgaactgtacgtatcattccgggacctgggctggcaggactggatcatcgcaccagagggctacgcggcttattattgcgaaggcgagtgtgctttcccactaaactcctacatgaacgctacaaatcatgccattgtgcagaccctcgtacacttcataaatccagaaacagtgcctaagccatgctgcgcacccacacagcttaacgccataagcgtcctatattttgacgactcaagcaatgtgatattgaagaagtatcgtaacatggtggtgcgcgcctgtggatgtcactag

SEQ ID NO: 3641 - DNA, 1098 bp, Artificial Sequence
  Description of Artificial Sequence: Synthetic coding sequence
atgcacgtgcggagcctgcgggccgccgccccccacagcttcgtggccctatgggcccccctcttcctgctccggagcgccctggcagatttcagtctggacaacgaggtacatagttcttttatacacaggagactgcgcagtcaggaaagacgagagatgcagagggaaatcctctccatcctgggattgccgcaccgtccaaggcctcacttgcaggggaagcacaatagcgctcctatgtttatgttggatctgtataatgctatggcagtagaagaaggagggggccccggcggtcagggtttttcatacccctataaggcggtcttttcaacgcaaggccctccattggcaagcctgcaggattctcacttccttacagacgctgacatggtgatgtcttttgttaacctagtggagcacgacaaggaatttttccatccacggtatcaccatcgagagtttaggtttgacctgtccaagattccagagggggaggccgttactgccgccgaattccgcatatacaaagattatattagagaacggtttgacaatgaaaccttcaggatttctgtttaccaggtattgcaagagcatcttggtagagagtcagacctgtttttactggattcaagaaccttatgggccagcgaggagggttggctcgtgtttgatataacagcaaccagcaaccactgggtcgttaatcctcgacataacctgggactgcagttatcagtcgagactttggacgagaattcatcctccgaccagagacaggcatgcaagaagcacgagctgtacgtgtcttttagagacctcggttggcaagattggatcattgcccctgaaggctacgcggcttattattgtgagggggagtgtgccttcccgttaaacagttacatgaacgcaacaaatcacgcaatcgtacagacattagtgcactttataaatccggagacagtccccaaaccatgctgtgcgccaacacagctgaatgccatttctgtgctgtatttcgatgattcgagcaacgtaattctgaaaaagtatcgcaatatggtggttcgcgcatgtggatgccactag

SEQ ID NO: 3642 - DNA, 1656 bp, Artificial Sequence
  Description of Artificial Sequence: Synthetic coding sequence
atggccggcgacctgagcgccggcttcttcatggaggagctgaacacataccggcaaaaacaaggggtcgtcttgaaataccaggaactgcccaacagtggtccaccccacgatcggcgctttacattccaggtcattatcgacgggcgagagttccctgagggagagggacggagtaaaaaggaggccaaaaacgccgccgccaagctggccgttgagatccttaataaggagaaaaaagccgtgtccccattactcctgaccactacaaatagtagtgaaggtctgtccatgggtaattatataggcctgatcaataggatcgcacagaaaaagcggttgacagtgaactacgaacaatgtgctagcggggtgcacggacccgaaggttttcactacaaatgtaaaatgggccagaaagagtacagtatcggtaccgggtcaaccaaacaggaggctaaacagttagccgcaaagctggcctacctacagatccttagcgaggaaacttccgttaaatctgactatctgtcctctgggtcatttgcgaccacctgtgaatcgcagtcgaactcgctggtgacctcaacactcgccagtgagagttcttccgaaggtgacttctctgccgacacgtctgagatcaactccaattccgactcattgaatagctcctctctgttaatgaacggcctgcggaacaaccagagaaaagctaagcgctcccttgcaccccgtttcgatctgccagatatgaaggagacaaaatacacggtcgacaagcgcttcgggatggactttaaggagattgaactgatcggcagcggtgggtttggccaggtttttaaagcaaagcaccgaattgacggaaaaacatacgtgattaaacgcgtaaagtataataacgagaaggctgagagggaagtcaaagccctggcaaagctggatcacgtgaacattgtccactacaatggctgctgggatggattcgactacgacccagagacgtctgatgatagcctggaaagcagcgactatgatccagagaattccaagaatagttcaaggtcaaagactaaatgcttattcatccagatggagttctgtgataaagggacgttggaacaatggatagagaaaagaagaggcgaaaagctcgataaggtccttgcattggagctgttcgagcagatcaccaagggagtcgactatatacattcgaaaaaactaatccaccgggaccttaagccttctaacattttcctcgtcgacacgaagcaggtaaaaataggcgattttggtctggtcacctccctcaaaaacgatggtaagcgtactcggtctaaaggaactttgcgctacatgagccctgaacagatcagctcccaggactatggaaaggaagtggacctttacgctctcggattgatccttgccgagttactgcatgtttgcgatactgcctttgaaaccagcaagttttttactgacttgcgggatggaataatttcagatattttcgacaagaaggaaaaaacgctgctgcagaagcttctttccaaaaagccagaagacagacccaatacctccgagatcctgagaactttaacagtgtggaagaagagccctgagaaaaacgaaaggcacacttgctag

SEQ ID NO: 3643 - DNA, 366 bp, Artificial Sequence
  Description of Artificial Sequence: Synthetic coding sequence
atgacccggatcctgaccgccttcaaggtggtgcggaccctgaagacgggattcggcttcacgaacgtcacagctcaccagaagtggaaattttctaggcccgggattcggctcctctccgtaaaagctcagacggctcatatcgtcctggaagacgggactaagatgaaaggttactcgtttggccaccccagcagtgtggccggggaagtggtcttcaatacaggcttgggggggtaccctgaggccataaccgaccctgcatataaaggccaaatcctgaccatggccaatcccattatcggaaacggcggggccccagacactactgcccttgatgagctgggtctgtcaaaatatctctag

SEQ ID NO: 3644 - DNA, 4521 bp, Artificial Sequence
  Description of Artificial Sequence: Synthetic coding sequence
atgccccagatcatcaagatgacccggatcctgaccgccttcaaggtcgtgcgcacactcaaaaccgggtttggtttcaccaacgttactgcccaccagaagtggaaattttcaagacctggcatcaggctgctatcggtgaaggctcagactgctcacattgttttggaggatgggactaaaatgaaaggatactcatttggacatcccagctctgttgccggagaagtcgtctttaataccggactgggaggctacccagaagccatcactgatcctgcgtacaaggggcaaattctgacaatggcaaatcctatcattggcaacggcggggcccctgatactacggccttagacgagctaggactctctaagtacctcgagagcaacggcattaaggtatcgggccttttagtgctcgactactccaaggactacaaccactggctggccactaagtctctagggcagtggctgcaagaggaaaaagttcctgccatatacggtgtggatacaaggatgctgactaaaatcatccgggataaaggcacaatgctcggcaagattgagttcgaaggacagccggtagattttgtggatcctaataaacagaacctcatcgctgaggtatcgaccaaggatgtgaaagtgtacggcaaagggaacccgactaaagttgtggcagtcgactgcgggattaagaacaatgtcataaggctgctggtaaagagaggcgcagaggtccacctcgtgccatggaaccatgatttcaccaaaatggagtacgatggaatcctcattgctggcggcccaggtaatccggcattggccgaaccattgattcagaacgtacggaagatactggagtccgatcggaaagaacccctatttgggatcagcaccggcaacctgattaccggccttgctgccggggccaagacctacaagatgagtatggctaaccgtggacagaatcaacctgttctcaatatcactaacaagcaggccttcatcaccgcgcaaaaccacgggtacgccctggacaataccttgcccgccggctggaaacctttgttcgtgaatgtgaatgaccaaaccaacgaaggcattatgcatgaatccaaacccttcttcgcagtccagttccacccggaagtgacccccggacccatcgacacagagtaccttttcgatagcttcttttctctgattaagaaggggaaggccacaacgatcacttctgtacttccgaaaccagcgctagttgcctccagagtggaggtgtctaaggtcttgatcctgggaagtggcggcctgtcaattggccaagcaggagagtttgattactcaggatctcaagctgtgaaagccatgaaggaggagaacgtaaagactgtacttatgaaccctaacatagcctcagttcagacaaacgaagtgggcctgaagcaggcggacactgtgtactttttacccataacacctcaatttgtgacagaggttataaaagctgaacagccagacggtctgatcttgggaatgggcggccagaccgccctgaattgcggagtggagctctttaaaagaggagtgctaaaagaatacggagtgaaagtgcttggaacgtcagtagaatcaatcatggctaccgaggatagacagctctttagcgataagctaaacgaaatcaacgagaagattgctccatcatttgctgtcgagtcaattgaagacgccctgaaggctgctgataccatcggctatcccgttatgatccgtagtgcttacgccttgggcggcctgggaagcggaatctgtccgaatcgggagactctcatggacctgagtaccaaagccttcgctatgacaaatcagattctggttgagaaaagcgtcaccgggtggaaggaaatcgaatatgaagtcgtccgggacgccgacgacaactgcgtgacagtgtgcaacatggagaatgttgacgcgatgggagtgcacaccggggatagcgtcgtagtggcacctgcgcagactctttctaatgcggaatttcagatgctgcgtaggacctcaatcaacgtcgtgcggcatctgggaatcgtaggggaatgcaatattcagtttgccctgcaccccacatcaatggagtattgcattattgaggtgaacgccagattatctcggtccagtgccctggccagtaaggccaccggctaccccctcgccttcattgccgccaagatcgcactaggcatcccactgccggaaattaaaaacgttgtgtctgggaagaccagcgcctgttttgaaccaagtttagactacatggtgacgaagattccaaggtgggaccttgatcggttccacggcactagttccagaattggatccagtatgaaatcagtaggggaagtgatggcgatcggtcgaacatttgaggaatcctttcaaaaggcacttcgaatgtgccaccctagcatcgaaggcttcacgccccgcctccccatgaataaggagtggccctcaaatctcgatctacgaaaagaacttagcgagccaagcagtacacgcatatacgccattgccaaagcgattgacgacaacatgtccctcgacgaaatcgaaaagctcacctacatagacaaatggttcttgtacaaaatgagagatatccttaatatggaaaagacgttgaagggactgaatagtgagagcatgactgaagaaaccctgaagcgcgcgaaagaaatcggattcagtgacaagcaaatctccaaatgccttggactaacagaggcacaaacccgggaactccgtctgaagaagaatattcacccctgggtgaagcagattgatacacttgccgctgaatacccttccgtaaccaactatctgtatgttacatataacggacaagagcacgacgtcaactttgacgaccacggaatgatggttttaggctgcggaccctatcatattggaagcagcgtagagttcgactggtgtgctgttagtagcatacggactttaagacagcttggaaagaagacagtagtggtcaattgcaaccctgaaacagtgagcacagatttcgacgagtgtgacaagctgtattttgaggagttgagtttggaacgaatcctcgacatttatcaccaagaagcctgcggcggatgcataatcagtgttggcgggcagattcctaacaacctcgcagtgcccctttacaagaatggcgtgaagataatgggcacaagccccctgcaaatcgatcgcgccgaagatcgctccatttttagcgcagtgttggatgagctgaaggtggcacaggccccgtggaaggccgtgaatactctcaatgaggccctggagttcgctaaatctgttgactatccctgcctactaaggcccagctatgtactaagcggcagtgccatgaacgtagtgttctcagaggatgagatgaaaaaattcctggaagaggcgactagggtttcccaggaacacccagtggttttgacaaagttcgtcgagggtgcacgggaagttgaaatggacgccgtggggaaagacggaagagtgatttctcacgccatatctgaacacgttgaagatgcaggcgtgcacagtggcgatgctaccctgatgttgccaacacagacgatcagccagggtgcgattgagaaggtgaaagatgccacaaggaagatagcaaaagccttcgccatttcaggcccgtttaatgtacagttcttggttaaaggcaatgacgttctcgtcattgagtgtaatctaagggcctcgcgctcattcccctttgtaagtaagacactgggcgtcgacttcattgatgtggctaccaaggtgatgattggtgagaatgtggacgagaagcaccttcccaccctggatcatcccattattccagctgactatgttgcaatcaaggcacccatgttttcttggccccgcctgcgggatgccgatcctatacttagatgcgagatggccagcaccggcgaggtggcctgcttcggcgaagggatccacaccgcatttttgaaggccatgctcagtactggatttaagatcccccaaaaaggcatattaataggaattcagcagtcgttccggccacggtttctcggagtcgccgagcaactccacaatgaaggcttcaagctattcgctacggaggcaacctctgattggctgaatgctaataacgtcccagcaacaccagtcgcttggccaagtcaggaaggtcagaatccaagtttgtcgagtatacggaaactcatccgggatgggtctatcgatctcgttatcaacctccctaacaacaacacgaagttcgttcatgacaattatgtcattcgtcgcacagccgttgatagcggcataccacttctcactaatttccaggttaccaagctgttcgctgaagcagtgcagaaatctcgaaaagtcgatagcaagagtctctttcattatagacagtatagtgcgggaaaagctgcctag

SEQ ID NO: 3645 - DNA, 3150 bp, Artificial Sequence
  Description of Artificial Sequence: Synthetic coding sequence
atgaaggaggagaacgtgaagaccgtgctgatgaaccccaacatcgcctctgtacagactaacgaggtagggctgaagcaggccgatacggtttactttcttcctatcactcctcagttcgtgaccgaggtcatcaaggccgagcagccagacggtctaatcttaggcatgggcggtcagacagcgctgaactgtggcgtcgagctgtttaaacggggggttctcaaagaatatggagtgaaagtgctcggcacatctgtggagagcataatggcaacagaagatcgccagctgttcagcgacaagctgaatgagataaacgagaagatcgctccatcatttgccgtagaaagtatcgaagacgcattgaaagcagcagacacaattgggtaccccgtgatgatccgctctgcctatgcgctaggcggcctcggatcgggtatttgcccaaatcgggagactcttatggatctatccacaaaagcattcgcaatgacaaaccagatactggtcgaaaaatccgttactggatggaaggagatcgagtacgaggtagttcgtgacgcagatgataattgtgtgacggtctgcaatatggaaaatgtggacgcgatgggagtccatacaggggactcagtcgtcgtcgcccctgcgcaaacactgtctaatgcggagttccagatgctgcgccgcacctccataaatgtagttaggcacctgggcatcgtgggcgagtgtaatatccagtttgcccttcacccaaccagcatggaatattgcattatagaggtgaacgccagattgtcccggagtagtgcccttgcaagtaaggccacgggttatccccttgcatttatcgctgctaaaattgcattaggaattccattgccagagataaagaacgtcgtgtctggaaaaacctcagcctgttttgagcctagcctcgattacatggtgactaaaatcccacgttgggacttggacagattccatggaacatcatcgaggattgggagctctatgaagtccgtcggagaagttatggctatcggcagaacctttgaggaatccttccagaaagctctgcgcatgtgtcatccatccattgagggattcaccccgagactgccaatgaataaggagtggccaagcaacctagacctgcgtaaagagctgtccgagccgagctctactcgcatctatgccatagcaaaagccattgatgataacatgagcttggatgagattgagaagttgacatacattgataagtggtttctctacaagatgagagatattttgaatatggaaaagactctgaagggactcaattccgagtctatgacagaggagactcttaaaagagctaaagagataggcttttcggataagcagatctctaagtgcttgggtctcacagaggcacaaactagagagctgagactgaaaaagaatatccacccctgggtcaaacagattgacacattggcggcggaatatccgagtgtcacaaactacttgtatgtaacttacaacggacaggaacacgacgtgaacttcgacgaccatgggatgatggttttggggtgtggaccctaccacattggttcaagcgtcgaattcgattggtgtgccgtgtcctcgatcagaacacttcgtcaactggggaaaaagacggtggtggtcaactgtaaccccgagacagtctctaccgactttgatgagtgcgacaaactgtattttgaggaattatcccttgaacgcattctggatatctaccatcaggaagcttgtggcggttgcatcattagcgtaggtgggcaaatcccaaataatctggctgtgcctctgtacaagaacggggtgaaaatcatggggaccagtccactgcaaatcgacagagcagaggacaggagcatatttagcgcagtactagacgagttgaaggtggctcaggccccctggaaggcagtcaacactctgaatgaagccctggagtttgctaagtctgtcgattacccgtgcctcctcaggcctagctacgttctctccggttctgccatgaatgtcgtgttcagtgaagacgaaatgaagaaattcctcgaggaagcaacacgcgtttctcaggagcatccagtggtcctgacaaaattcgtggagggggccagggaggttgaaatggacgccgtcggaaaagacggtcgcgtgatctcccacgctatatccgagcacgttgaggacgcaggtgtgcattctggcgacgctaccctcatgctgcctacccagaccatttcacagggtgctattgagaaggtgaaagacgccactaggaagatcgccaaggcatttgcaataagcggcccctttaatgtgcaattcctagtcaaaggcaacgacgtgctggtgatcgaatgtaacctcagagcttccagatccttcccatttgtctcaaagaccttgggagtcgactttatcgacgtggctacgaaagtaatgatcggagaaaatgttgacgagaagcacctgccaactttggatcaccccattattcccgcagactacgtggccattaaggcgccaatgtttagctggccacgcttaagggacgcagaccccatcctgagatgcgaaatggcttcaactggagaggtggcctgtttcggagagggcattcacactgcctttcttaaggccatgctcagtaccggatttaagatccctcagaaaggaattcttatagggatccaacaatcattccggccaaggttcctgggagtcgccgaacaattgcacaatgagggctttaagttattcgcaactgaagctacatccgactggctaaatgctaataatgtaccagccacaccagtggcctggccaagccaggagggtcaaaaccccagtctgtcaagtatccggaagctaattagagatggttcaattgatcttgtaattaacttaccaaacaacaataccaagtttgtgcacgacaactatgtgattcgccgcaccgccgtagatagtggcatccctctcttaactaattttcaggtgactaaattgttcgccgaggctgttcagaaatctaggaaagtcgactctaaaagcctctttcactatcgtcagtattcagcagggaaggctgcgtag

SEQ ID NO: 3646 - DNA, 366 bp, Artificial Sequence
  Description of Artificial Sequence: Synthetic coding sequence
atgacccggatcctgaccgccttcaaggtggtgcggaccctgaagacggggtttggcttcacaaacgtcaccgcccatcagaagtggaaattctctagaccaggcattcgacttctgtccgttaaggctcaaactgctcacatcgtgttggaggacggaacgaagatgaagggatatagtttcgggcatccctcctctgtggcgggcgaggtggtctttaataccggcctgggcggataccccgaagctataacagatccagcctataaagggcaaatcttgacgatggccaaccctatcattggcaacgggggcgctccagacacaacggccttagatgaactggggctgtctaaatacctctag

SEQ ID NO: 3647 - DNA, 1542 bp, Artificial Sequence
  Description of Artificial Sequence: Synthetic coding sequence
atgacccggatcctgaccgccttcaaggtggtgcggaccctgaagaccggattcgggttcaccaatgttactgctcaccaaaaatggaagttctctcgccctgggattagactgctgtccgtcaaagcacaaactgcgcacatcgtactggaggatggtacgaagatgaaggggtactcatttgggcaccccagttctgtcgctggagaggtagtatttaacaccggattgggaggttaccccgaagcaattacggacccagcatacaaaggtcagatcctgaccatggcaaacccgatcattggcaatggcggtgctcctgacacgactgctcttgatgaactaggcctcagcaagtaccttgagtctaatggcattaaagtttctggtctcctcgtgttggactatagcaaagactataaccactggctagccaccaaatccctagggcaatggttgcaggaggagaaggtccccgccatttacggcgtggacacaaggatgctgacaaagattattcgggataaaggtaccatgctgggaaagatcgaatttgaaggccagcctgtcgactttgttgacccgaataaacagaacctaatcgccgaagtcagtactaaggacgtgaaggtgtatggcaaagggaaccccacgaaggtggtggctgtcgattgcggcataaagaataacgtgattcgactcctggtgaaacggggcgccgaagtgcacctcgtcccttggaaccacgacttcaccaagatggaatatgatggtatcctcatagcagggggccctggaaaccccgccttagctgaacctctcatccagaacgtccgtaaaattctcgaatccgaccggaaggagcccctttttgggattagcacaggcaacctaatcacaggcctagctgcaggggccaagacttacaaaatgtccatggccaataggggccaaaatcagccagtcttgaatatcaccaacaagcaggcgtttatcactgcccagaaccacgggtacgccttagataatactctcccagccggctggaagcccctgtttgtgaatgtaaacgatcagacgaacgagggaataatgcacgagtccaagccgttcttcgccgttcagttccaccctgaagttactcctggcccgattgacactgagtatttgttcgacagttttttttccctgatcaaaaaggggaaagctactacaattacctccgtattgcctaagccagccttagtggcatctcgcgtggaggtgtcaaaggtgctgattctcggatccgggggtttgtcaattgggcaggccggtgagtttgattattccggctctcaagctgtgaaagcaatgaaggaggagaatgtaaagacggttttgatgaatccaaacatcgccagcgttcaaacaaacgaagtgggcctcaagcaggctgataccgtttattttctacccataactccccagttcgttaccgaggtcattaaagccgagcagcctgatggcctcatactgggtatgggagccaggcaactctag

SEQ ID NO: 3648 - DNA, 4527 bp, Artificial Sequence
  Description of Artificial Sequence: Synthetic coding sequence
cggccccggccccagatcatcaagatgacccggatcctgaccgcctttaaagtcgtgaggacactgaagacggggtttgggttcaccaacgttactgcccatcagaaatggaagttttcacggcctggaatcagactgttaagcgtgaaggctcagacggcacacatagtgctcgaagacgggactaagatgaaaggatacagcttcggtcacccaagttctgttgccggagaagtggttttcaatactgggctgggcggctatccggaggcgattacggatcccgcgtacaagggccagattttgactatggctaatccaataatcggaaatggtggagccccagacacaaccgctctcgacgagctgggactgagcaagtacctggagtccaatgggatcaaagtctccggccttctcgtgctagactactccaaggattacaatcattggttggcgaccaagagcctcggacaatggttacaggaggagaaagtccctgccatatacggtgtggatacccggatgctgacaaagatcattcgtgataagggcacaatgcttggtaagatagagtttgagggccagcctgtggactttgtggatcctaacaagcagaacctgatagcagaggtgtctacaaaggacgtcaaggtgtacggaaagggcaatcctacgaaagtcgtggccgtggactgtgggataaaaaataatgtgattcggcttctcgtgaagagaggagccgaggtgcatttagtgccctggaatcacgactttacaaagatggaatacgatggcatcctgatagcgggaggcccagggaaccccgccctggctgaaccactgatccagaatgtgcgtaaaattctggaaagcgaccgtaaagagcccctctttgggatttccacagggaatttgatcacaggtttagcagcaggagcaaaaacctacaaaatgtctatggccaaccgcggacagaatcaaccagttttaaacattacaaataaacaagcttttattacagctcagaaccacggctacgcgcttgacaacaccctgccagccggttggaagcctctctttgtaaatgtgaatgaccagacaaacgaaggaattatgcatgaaagcaagcccttctttgctgtgcagttccaccctgaagttactcctggccctattgacactgagtacctgtttgactccttcttttctttaattaagaagggaaaagcaacgaccatcacgtccgtgttgcccaagcctgccctagtggcctcaagagtcgaagtgtcgaaggtcctgattttagggtcaggcgggctcagcatcgggcaggccggcgaatttgactacagcggaagccaagccgtcaaagctatgaaagaggaaaatgttaagactgtcttgatgaaccccaacatagcttctgttcagacaaacgaggtgggcctgaagcaagctgataccgtatacttcctcccaattaccccccagtttgtcactgaggtcattaaggctgagcagcctgacggactcattcttggaatgggggggcagacggcccttaattgcggggtggaactgtttaagagaggcgttttgaaagagtacggagtaaaagttctgggaacatccgtggaaagcatcatggccactgaagatcgccagttatttagcgataagctgaatgagattaacgaaaaaatcgcaccaagctttgccgtcgaatcaattgaagacgctctcaaggctgctgataccatcggctacccagtcatgatccggtctgcatatgccctcggaggcttgggctccgggatctgtcccaatcgcgagaccctgatggatttgagcactaaagctttcgccatgaccaatcagattttggtggagaaatctgtgacaggttggaaagagatagagtacgaggtggtgcgcgatgcagacgataattgtgtcacagtgtgcaatatggagaatgtcgacgctatgggggtgcacactggagattccgtggtggtggcgcccgcacagacgctctccaatgcagaatttcagatgctgcgacgcaccagcatcaatgtcgtcaggcatctaggcattgtcggggaatgcaacatccagttcgcactccatcccacttctatggagtactgtataatcgaggtgaatgctcgattgagtcggtcaagcgccctggcctccaaagctaccggttaccccttggcttttatcgccgcaaagatcgccctggggataccgcttccagagatcaaaaatgtagtctctggcaaaacctctgcctgttttgagccctccctggactatatggtcacgaaaatcccacggtgggacctcgatcgttttcatggaactagctcccggataggctcctcaatgaagagcgtgggtgaggtcatggcgataggaagaacattcgaggagagcttccagaaagcgttaagaatgtgtcacccttcaattgagggctttacgccacgcctacctatgaataaagaatggccttcgaatctggacctgcggaaagaactcagtgaaccaagcagcactcgaatttatgcaatcgccaaggccatagacgacaacatgtcacttgatgagatcgagaagctgacgtacattgacaagtggtttctatataaaatgcgggatatactgaatatggagaagaccctcaaaggcctgaacagcgagtccatgacagaggagaccttaaagagagctaaggaaatcgggttctctgataagcagatcagtaagtgtctgggactgaccgaggcccagacgcgtgagctcagactaaagaagaatatccatccttgggtcaaacagattgacacattagctgccgagtacccttctgtcactaactacctgtacgtgacctataatggccaggagcatgatgtgaatttcgacgatcatggaatgatggtactgggctgcgggccgtatcacatcggcagttctgttgagtttgactggtgcgcagtgagcagtattcgcaccttgagacaactcggtaaaaaaacagtcgtggtcaattgtaaccccgagactgtgtcaaccgatttcgacgaatgcgataaattgtactttgaagaactttccttggaacgcatcctggacatctaccatcaagaggcgtgcggaggctgcatcatcagtgtgggcggacagatccctaacaatctggcagttcccctgtataagaatggagtgaagattatgggaacctcaccactccaaattgatcgggctgaagatcgctcaatctttagcgccgtgctagatgagctcaaggtggcacaggcaccttggaaagcagtaaatacgcttaatgaggctctagaatttgctaagagtgtagactacccatgtctgctccggcccagttacgtgttgagcggtagcgccatgaatgtggtgttcagtgaagacgaaatgaagaagtttttggaggaagctacgcgagtgtcgcaggaacatcccgttgtacttactaagtttgttgagggcgctcgggaggtcgaaatggacgcagttggtaaggacgggagagtaatctcccacgcaattagtgagcatgtcgaggacgccggtgttcatagcggtgatgcgaccctcatgcttcctacccaaacaatctcacaaggggcaatcgagaaagttaaggacgccacgcgtaagatagccaaggctttcgcaatcagcgggccattcaatgtccagtttctggtgaaaggaaatgacgtgctggttatcgagtgcaatttgcgcgctagtcgttcatttcccttcgtctccaagaccctgggtgttgacttcatcgatgtcgccaccaaggtgatgattggggagaatgtagacgaaaaacacttaccaaccctcgaccatcccatcattcccgctgactacgtggccattaaggcacccatgtttagttggcctcgactccgcgatgccgatcccatcctgcgctgcgaaatggcaagcaccggtgaagtcgcctgcttcggggaaggcattcacaccgctttcctgaaggctatgttgagcaccgggttcaaaatacctcagaaagggattctgatcggcatacaacagagcttcagaccccgctttctgggcgtcgccgagcagctccataacgagggctttaagctgttcgcaacggaggctacaagcgactggctcaatgctaataatgttccagccactcctgtggcgtggccatcacaggagggacaaaatccctcactgagctccattcgcaaactaatcagggacggatcaatcgaccttgtgattaatctccccaataacaataccaagtttgtgcacgacaactatgttatacgaagaaccgccgttgattctggtattccgcttctgacgaacttccaggtcactaaactgtttgctgaagctgtgcagaaatccaggaaagtggacagtaaatccctctttcactataggcagtattccgcgggaaaggcagcatag

SEQ ID NO: 3649 - DNA, 213 bp, Artificial Sequence
  Description of Artificial Sequence: Synthetic coding sequence
atgacccggatcctgaccgccttcaaggtggtgcggaccctgaagactggatttggtttcacaaacgtgacagcccaccagaagtggaagttctcaagaccgggcatccggctgctgagcgtgaaggcgcagaccgcacatattgtgctggaggatcgggatgctgatacccccgcacctctcttaaaccagccagaacctcacgttatttag

SEQ ID NO: 3650 - DNA, 606 bp, Artificial Sequence
  Description of Artificial Sequence: Synthetic coding sequence
atgagccggcgggagggcagcctggaggacccccagaccgacagcagcgtgtcccttcttcctcatttagaggctaaaatacgccagacccactccctcgcccatctcctaaccaagtatgccgagcaacttttacaggagtacgtgcagctgcagggtgacccctttgggctcccctcattctctccacctagattgcccgttgcaggactctccgccccagcaccatcccatgccggcctgcccgtacatgagcgcctgcggttagacgctgctgcactcgccgccctcccacccctgctcgatgctgtctgcagacgacaagcagagcttaatcctcgagccccaagacttcttcggaggctcgaggacgcagctcgccaggctcgagccttgggtgccgccgtggaggcactcctggctgccttgggggccgcaaaccgaggccctcgggctgagccacctgccgctactgcctcagccgcctctgctaccggggtgttccctgctaaagtcttagggctgcgagtgtgcggactatatcgggagtggttaagcagaaccgaaggagaccttggacagttgctgccgggtgggtccgcgtag

SEQ ID NO: 3651 - DNA, 603 bp, Artificial Sequence
  Description of Artificial Sequence: Synthetic coding sequence
atgagccggcgggagggcagcctggacccccagaccgacagcagcgtatctctcctgccacatctcgaagccaaaattcgccaaacccacagcctggcacatcttctgactaagtacgccgaacagttgctgcaagagtatgttcaactccagggtgatccctttggactgccctcctttagcccccctagattaccagtcgctgggttaagcgcgccagcgccttcacatgccggcctgcctgtgcacgagcgcctccgtctggatgctgcagctctggcagcgcttcctccgttactggacgccgtctgtagacgccaggctgagctaaatcccagagcaccaagactcctcagaaggcttgaagatgctgcacgccaggctcgggctttgggagccgcggtggaggctttgcttgcagccctgggagcggccaacaggggaccccgagctgaaccacccgccgccaccgcctccgctgcttctgctacaggcgtgttcccagccaaagtgctaggcctgcgggtctgtggtctgtatcgcgagtggctgagccggaccgagggagatcttggacagcttcttcccggcggcagcgcttag

SEQ ID NO: 3652 - DNA, 513 bp, Artificial Sequence
  Description of Artificial Sequence: Synthetic coding sequence
atgaagacccagcgggacggccacagcctgggccggtggagcctggtgcttctgctgttggggctggtaatgccactagccattattgcacaggtgctgagctacaaggaggcagtgctgcgcgccatagatggaatcaaccagagaagcagcgacgccaacctgtatcgcctacttgacctggacccccggcctactatggatggggaccccgacacccccaagcccgtcagctttactgtcaaggagaccgtgtgccccaggaccacacagcagagccccgaggattgcgatttcaaaaaggacggtctggttaagcgatgcatgggaacggtaactctgaaccaggctcgtggctccttcgacatctcttgcgataaggacaataaacggtttgcattgctaggagacttcttccgcaaaagtaaggagaagattgggaaagaatttaagcgcattgtccagcggataaaggattttctcaggaacctagtccctcgcacagaatcctag

SEQ ID NO: 3653 - DNA, 1692 bp, Artificial Sequence
  Description of Artificial Sequence: Synthetic coding sequence
gcctgctgctgcggcggcggctgcacctgctgcggctgcacctgcacaactgggtgctgcaccacatgcacttgttgtgcatgtgcctgtaccaccggtacaaccacaggtgctggcgcatgttgcaccggtggctgcgccgctggaggcaccggctgcgggggggccggctgttgctgtacttgctgtgcaggcgccgctggcacaggctgtggcggtacttgcgccgcaggttgcggagggtgcgctggatgtggaggtgctggggcttgtgggggctgtggcgcaggatgctgcgccggtggcgccgcttgttgcacatgttgttgttgctgttgtggttgtggtacatgttgctgttgcgccggctgtactacctgctgctgtgctgggtgcggcacaggcggatgtgggggctgcggaggcgccgcttgctgctgttgctgcggcggcgctggcgccgctgccggagccgcaaccgcagctgctggtgcgtgcacaggcggtgctaccgcatgcgcaggaggcacatgttgtgcaaccacagcgtgtgggacctgcgccacaacatgcaccggttgcgcgggaggttgctgtgcagccaccacaaccgctaccggcgcgggtggcgctgccacctgctgtgctgccggcgccaccggcgctgcgacgaccactggtggcgctggatgcgcggggggtgccggggcaggtgggtgttgtggaaccacgactggcacttgcactgggtgtgctggcacgggctgctgctgttgtgcaggtgggtgtacaggatgcacatgctgttgcgccgggtgtggctgtactacatgttgctgtgcggcctgcgctggggccggaggggcttgctgcgccacttgtactggcgctaccggagccaccacctgcgccaccgctggcggctgtgcgtgtgccgctgcctgcgcgacaggcgcagcagcaaccggggcctgcaccacaacaggagcagcaggcactaccacttgttgtaccacttgcgccgctaccgcagccgcagctgcgtgtgccggcgcatgcgccgccactgccactggaaccaccgcaacctgtgccggcgcaacttgtgccgctgcttgcacttgctgtggcgcctgctgttgttgtgccgcctgcggagcaggagctactacctgctgcaccggcgcggcgggagcagcttgtacaggatgcggtgccgggggtgctggtggtactggcgggggttgctgcacctgtacgacttgtgctggatgcggtgcaggttgcaccggaggggcttgcacgggctgcacctgttgctgcacaggtggtgcaggctgtgcttgcggcgcgggcacgacgtgtgccgggggcgccgcgggcggatgcacgtgcgcaggtggcgctgccggggctgggggagcgggcgcaggctgcgctggctgcgccgcagggtgcggcggagccgccaccgccacttgtacatgtggcgccactggttgtgctacagctgcaacgggatgtgctgggacgacaggagggacgggagggggcggctgctgcgctacgggagcgtgcggaggcggagggtgctgttgtgggggagctgcatgtacgtgcgcctgctgcgcaggctgcactacggcgggctgcgccggttgcggctgcacctgcggtggatgtacaggctag

SEQ ID NO: 3654 - DNA, 555 bp, Artificial Sequence
  Description of Artificial Sequence: Synthetic coding sequence
atggccgaccacctgatgctggccgagggctaccggctggtgcagcgacctcctagcgccgccgctgcccatggacctcacgcgctgcgcactcttccaccttacgcaggccctggcttagatagcggccttagaccgcggggtgcacccctgggccccccacctcctcggcaaccaggcgcccttgcctacggagcgtttggtccacccagctcttttcagccgttccctgccgtccctccacccgcagcaggcattgcccatcttcagcccgtagccaccccttatccgggaagagcagccgccccccctaatgccccgggggggccacccggccctcagcctgccccatccgcggctgctccaccacctcctgctcacgccttgggagggatggacgcagagctgattgacgaggaagctctgacgagtctggaactggagctaggcctgcaccgggtccgcgagctgcctgaattgttcctcgggcaatccgagttcgactgtttctccgatctgggcagcgcgccccccgctggaagcgtgagttgttag

SEQ ID NO: 3655 - DNA, 3198 bp, Artificial Sequence
  Description of Artificial Sequence: Synthetic coding sequence
atgaagatcctgatcctgggcatcttcctgttcctgtgcagcacccccgcatgggccaaagagaaacattattatatcgggattatcgagaccacatgggactatgcttccgatcatggcgagaagaagcttatcagcgttgatactgagcactcaaatatctacctgcagaatggcccagatagaatcgggaggctctacaaaaaggccctatacctgcagtacaccgacgagacctttagaacaactatcgagaagcccgtctggctgggtttcttaggcccaatcatcaaggcggaaaccggagataaagtctacgtgcatctaaaaaatctggccagtagaccctacacgtttcattctcacgggattacgtattataaggagcatgaaggggctatataccctgacaacaccacagatttccaacgcgccgatgacaaagtgtatcccggcgagcagtacacttacatgctgctggccacagaggaacagtcacccggtgaaggcgacgggaactgcgtgactcggatctatcactcccatattgacgcccccaaggatatagcctcaggcctgatcgggccgcttattatttgtaagaaggactcattagacaaggaaaaagagaaacacatagacagggaattcgtggtgatgtttagtgttgtagatgagaatttctcctggtaccttgaagataacatcaaaacatattgttcagagccagaaaaggtagacaaggacaacgaggactttcaagaatccaatagaatgtactctgtgaatggatacacgttcgggagcctgcctggccttagtatgtgtgctgaagatcgggtcaagtggtacctgttcggcatggggaacgaggtggacgttcatgctgcattttttcacggtcaggctctcaccaacaagaattatcgtattgataccattaacctgttccctgcgacactctttgacgcctatatggtggcacagaacccaggggagtggatgctctcttgccagaatctcaaccacttaaaagcaggactgcaagcctttttccaggtccaggagtgtaataaatccagctctaaagataatatccgcggcaaacatgttaggcactattatattgcagctgaagagatcatctggaattatgctccctcagggattgatatctttaccaaggaaaatctgacagcccctggctcagatagtgccgtttttttcgagcagggcacgacccgtatcggggggtcctataagaagctcgtctacagggaatacacagatgcatctttcaccaacagaaaagagcggggacctgaggaggagcatcttgggattctgggtccggtgatatgggcggaagtcggtgacactattcgggtgacgttccacaacaagggagcctatccactttccatcgaacccattggcgtcaggtttaataagaataacgaaggtacgtactactctccaaactacaacccacagagtcggtcggtaccaccttccgccagccatgtggctcccaccgagactttcacttatgagtggacagtccccaaagaggtggggcctaccaacgccgatcctgtctgcctcgcgaagatgtactattctgcagtggaaccaacgaaagacatatttaccggccttattggtcctatgaaaatctgtaagaaaggatctctgcacgccaatgggaggcaaaaggacgtggacaaagagttctatttatttcccacagtcttcgatgaaaatgaatctctgctattagaagataacatacggatgtttaccaccgctccagaccaggttgacaaagaagatgaggatttccaagaaagtaacaagatgcatagcatgaacggtttcatgtacggaaatcagcccgggctgacaatgtgcaagggtgatagcgtggtctggtatttattctctgcaggcaatgaggcagatgtgcacggcatttatttcagcgggaacacatacctctggaggggagagaggcgggatacagctaatctgttccctcagacctcactgacactgcacatgtggcccgataccgaaggtaccttcaacgtcgaatgtttgacaacagatcactatacaggaggcatgaaacaaaagtatacagtcaaccaatgtcgccgtcaaagcgaagatagtacattctatttgggtgaaaggacctattacatcgctgccgtggaagtggagtgggattacagtccgcagagagagtgggaaaaagaactgcatcatttacaggagcaaaacgtatcgaacgccttcctggataagggagagttttatatcgggtctaagtacaaaaaagtggtttatcggcagtataccgatagcaccttccgtgtcccagtggaaaggaaagcggaggaggagcacttaggtatcctcgggccgcagctccatgccgacgtgggcgacaaggttaagatcattttcaaaaatatggcgacccgaccttactctatacacgcccacggcgtccagaccgagtcttcaacagtcactccaaccctcccaggggaaacacttacatacgtgtggaagatcccagagcgctcaggggccggcacagaggattctgcgtgcatcccatgggcttactactccactgtcgaccaggttaaagacttatattctgggctgatcggacctctcatcgtgtgtcgccgcccgtatttgaaagtgttcaatcccaggcgcaaactggagtttgccctcctttttctggtgtttgatgaaaacgagtcctggtacctggatgataatatcaagacatactccgatcatccagaaaaggttaataaagatgatgaagagtttattgagtcaaataagatgcacgccatcaatggtcgaatgtttggcaacctgcaaggattgaccatgcacgtcggagatgaggtgaactggtatctgatggggatgggaaatgaaatcgacctgcacacggttcacttccatggtcactctttccagtacaaacaccgcggcgtatattctagtgatgtgtttgatatatttcccggtacctatcagacgctggaaatgttcccacggacaccaggtatctggctgcttcactgccacgtgacagaccatatccatgctggaatggaaacaacttacacggtgctgcagaatgaggacactaaaagtggttag

SEQ ID NO: 3656 - DNA, 603 bp, Artificial Sequence
  Description of Artificial Sequence: Synthetic coding sequence
atggccttcaccgagcacagccccctgaccccccaccggcgggacctctgttcccggagcatttggctggccagaaagatacgttccgatttgacagcccttaccgagagctacgtgaaacaccaagggcttaataaaaacatcaatttagactccgctgatggcatgcctgttgcctccacggaccagtggagtgagttaaccgaggctgagcggcttcaggagaacctgcaggcgtacaggacgtttcacgtgctgttggctaggctcctggaggatcaacaagtgcatttcactcccactgagggcgattttcaccaggctatccacacactcctgctccaagtcgctgctttcgcttaccagatcgaagaactgatgatcctcctggagtataagatcccaagaaacgaagctgacggaatgccaattaacgtcggggatggaggcttatttgagaaaaaactgtgggggctgaaggtcctccaggaactcagccagtggacagtgaggagcatccacgacctgagattcatctcatcccatcaaaccggaatacccgccagagggtcacactacatcgctaataataaaaagatgtag

SEQ ID NO: 3657 - DNA, 1869 bp, Artificial Sequence
  Description of Artificial Sequence: Synthetic coding sequence
atggcccacgtgcggggcctgcagctgcccggctgcctggccctggctgcactctgttccctagtgcattcacagcacgtctttttggccccccaacaggcccgaagccttctgcagcgcgttcgaagagccaacacctttctggaagaagtgagaaaggggaacctggagcgggaatgcgtcgaagagacctgcagctacgaggaagcctttgaggccttagaatccagcaccgctacagacgtgttctgggcaaagtacaccgcatgcgagactgccagaacacctcgggacaagttggccgcttgcctagaaggaaactgtgccgaggggttagggaccaactacagaggtcacgtgaacatcacacgctccggaattgagtgtcagctgtggagaagtcggtacccacacaagcccgagattaatagtacgactcaccccggagccgacctgcaggagaatttctgtcggaatcctgattcttctaccaccggcccatggtgctacaccaccgaccccaccgtgcgccgacaagagtgttcgattccggtgtgcggacaggaccaggtcacggtggccatgacaccccggtcagaaggcagcagcgttaacttatcacctcctctcgagcaatgtgttcccgataggggccagcagtatcaaggcaggcttgctgtgactacgcatggcctgccgtgcttagcctgggcatctgctcaggccaaggcactcagtaagcaccaagactttaattccgccgttcagttggtggagaacttctgcagaaaccctgacggagatgaggagggcgtttggtgttatgtcgcagggaaacccggagacttcggatactgcgacctgaattactgcgaggaagcggtggaggaggaaacaggcgacggtctggacgaggatagcgatcgggccattgaaggaagaactgccacatctgaatatcagacattttttaatccccggacatttggctctggagaggccgattgcggtctgcgcccgttgttcgagaaaaagagcctggaggataaaacggagagggagttgctcgaatcttacattgatggaaggatagtcgaaggctcagacgcggaaattggcatgagcccgtggcaggtgatgctattcagaaaaagtccacaagaattgttatgcggtgcaagcctgatctccgatcggtgggttctgaccgcagcgcattgcctgctgtatcctccctgggacaaaaacttcactgaaaatgacctgcttgtaagaatcgggaagcattcacgaactcgctacgaacgcaacattgaaaaaatttccatgctggagaagatctacatccacccccgatacaattggcgcgaaaacctggaccgtgacatcgcgctcatgaagctcaaaaagcccgtggcattctcagattacattcaccctgtgtgcctccccgatcgtgaaaccgcagcaagtctgctccaggcagggtataaggggcgggtaaccggttggggcaatcttaaggaaacgtggactgctaatgtgggaaaaggccagcctagcgtgctccaggtcgtcaacctgcccattgttgagcgacccgtgtgcaaagatagtacccgcattcgaataactgacaatatgttttgtgctggctacaagcctgacgaaggaaagaggggcgatgcttgtgagggagattctggcgggccatttgtgatgaaaagtccttttaacaataggtggtaccagatgggcatcgtgtcttggggtgagggctgcgatagggatggcaaatacgggttctatacccacgtgtttaggctcaaaaagtggatccagaaggtgatcgaccagtttggcgagtag

SEQ ID NO: 3658 - DNA, 195 bp, Artificial Sequence
  Description of Artificial Sequence: Synthetic coding sequence
ctgcagggcgagttcctgccccagccccggcagcagcaccacggcactctggtactgcattacaggccacaccgagaggaggcaggcatgcagcatccgtgtctctggccaggcagttctcactgtagcgatgacagtaccctacgtcgattgcagtgtgagtccgtcacgtctatcggggcagtgtgtccctag

SEQ ID NO: 3659 - DNA, 1752 bp, Artificial Sequence
  Description of Artificial Sequence: Synthetic coding sequence
atggcccacgtgcggggcctgcagctgcccggctgcctggccctggctgcactctgtagcctggttcatagccagcatgtgtttcttgcacctcagcaggcacgaagcctgctccaacgtgtccggagagccaatactttcttagaggaggtgcgcaaggggaacctggaaagagagtgcgtggaggaaacatgttcctatgaggaagctttcgaggctctcgagtcatcgaccgcaaccgacgtattctgggccaagtatactgcatgtgagacggcccgaacccccagggataaactggcagcgtgcttagaggggaattgcgccgagggattggggaccaactatcgcggccacgtgaatatcacacgaagtggtattgaatgccagctgtggcgtagtagataccctcataagccagagattaattctaccacacaccccggagcagatttgcaagaaaatttctgcagaaatcctgattcttctaccacaggaccttggtgttacacaacagatcccacagtgaggagacaagagtgctctatccccgtttgtgggcaggatcaggtcaccgtggcgatgactccacgcagcgaggggtcttcggttaacctttcaccaccactggagcagtgtgtacccgatcgcggccagcaataccagggcaggcttgctgtgactacacacggcctaccctgtctggcatgggcctcagcccaggcaaaagcactcagcaagcaccaagattttaactccgccgtacaattggtggagaacttctgcagaaatccagatggcgatgaagagggggtttggtgttatgtagcagggaagcctggcgattttggatactgtgacctcaactactgcgaggaggcagtggaagaagagaccggagatgggctggacgaggactctgacagagccatcgaaggacgcacggctacttccgaatatcagacgttctttaatccgaggaccttcggctccggggaggctgactgcggtctgcggcccctcttcgaaaagaagtccttggaggacaagaccgaacgggagttactggagagctacatagacgggcggattgtcgaaggatctgacgcagagataggcatgagtccttggcaagtgatgctgttccggaagtctccccaggagctgctgtgcggcgcgtccctaatcagtgatcggtgggtgctgactgctgctcattgtctgctgtatcccccatgggataagaattttaccgagaacgacctcctagtgaggattggcaagcattcccggacaaggtacgagaggaatatagaaaagatttccatgttggagaaaatatacatccatccttccctgttacaggccggatacaagggccgcgtgactgggtgggggaacctgaaggagacgtggacagccaatgtgggcaaagggcagccttcagtgctacaggtggtgaacttacctattgtcgaacgtccagtgtgcaaagactccacacgcatacgcatcaccgacaacatgttctgcgctggatacaagccagatgagggtaaaaggggagacgcatgcgaaggggactccggtggccctttcgtgatgaagtcccctttcaataacagatggtatcagatgggcatcgtgagctggggtgaaggttgcgaccgcgatgggaagtatggcttctacacacacgtttttaggctcaaaaaatggatccagaaagttatagatcagtttggggaatag

SEQ ID NO: 3660 - DNA, 888 bp, Artificial Sequence
  Description of Artificial Sequence: Synthetic coding sequence
atggagacccccgcctggccccgggtgccccggcccgagaccgccgtcgcccggacattactgctggggtgggtgttcgctcaggtagccggagcatcaggcaccaccaataccgtggcagcctacaatctgacttggaaaagcaccaatttcaaaacaattctcgagtgggaacccaagcccgtaaaccaggtgtacacagtccagatcagcactaagagcggagactggaagagtaaatgcttctacacaaccgatacagaatgcgatctgacagacgaaatcgttaaggacgttaagcagacataccttgcccgggttttctcttatcctgcaggcaacgtcgaatcaactggatctgcaggcgaaccactgtacgagaactcccccgaattcaccccctacttggagactaacttggggcagcccacaatacagtccttcgagcaggtgggaacgaaagtcaatgtcacagtagaagacgaacggacactggtccgccgaaacaacactttcctttcattgcgagacgtcttcggtaaagatctcatctacacgttgtactactggaaatccagctcgtccgggaagaaaacagcaaagactaacactaatgagttcttaatcgacgtcgataagggcgagaattactgcttttctgttcaagctgtgatcccctctaggaccgtaaatagaaagagtaccgattcaccagtggagtgcatgggacaggagaagggggaatttcgcgagattttttacataattggagctgttgtgttcgtcgttatcatcctcgtaattattttagcaatttcactccacaagtgtagaaaggctggggtcggtcagtcgtggaaggagaattctcctctcaacgttagctag

SEQ ID NO: 3661 - DNA, 717 bp, Artificial Sequence
  Description of Artificial Sequence: Synthetic coding sequence
atggagacccccgcctggccccgggtgccccggcccgagaccgccgtggcccggacactgctgctgggctgggtcttcgcacaagttgccggggcatcaggtaccacaaacaccgttgccgcctacaacttgacatggaaatcaactaatttcaagactatccttgaatgggagcccaaaccagtgaaccaagtctatacagtacaaatctccacgaaatccggcgattggaagagcaagtgtttctacaccactgacactgaatgcgatctgactgacgaaatcgtgaaagatgtcaagcagacatacctcgcacgcgttttctcttatcccgcaggaaacgttgaaagcactgggtcagcaggcgagcctctgtacgagaactcccccgagtttaccccctacctcgaaacaaacttgggacagcccaccatccaatcttttgagcaggttgggacaaaagtgaacgtgaccgtggaggacgagcgaaccttagtgcgccgcaataatacttttcttagcttgcgggatgtgttcgggaaggatctaatctataccctgtactattggaaatccagctcctctggaaagaagtatagcacctccctggaactctggtatctttggagctcctcactgagtagctcctggttgtacctgtatactagcgtagagcgtcaggaatggggacgcgctgggcggcgtacaccccattag

SEQ ID NO: 3662 - DNA, 3807 bp, Artificial Sequence
  Description of Artificial Sequence: Synthetic coding sequence
atgatcgccgcccccgagatccccaccgacttcaacctgctgcaggagtccgaaacacacttcagctccgacacggacttcgaagatattgagggtaagaaccaaaaacaggggaagggtaagacatgcaaaaaagggaaaaaaggccccgccgagaaaggaaagggcggaaacggcggcggcaagccaccaagcggtcccaatcgcatgaacggccatcatcagcagaacggcgttgagaacatgatgctgtttgaagtcgtgaagatggggaagtctgcaatgcaaagcgtggtggatgactggatcgaatcctacaagcatgatagggacattgccctcctggatctgatcaactttttcatccagtgctccggctgcaagggggttgtgacagccgaaatgttcaggcacatgcagaactccgagatcatccgaaagatgaccgaagagtttgatgaggacagcggggactatcctctgacgatggcaggccctcagtggaagaaatttaagtcctccttttgcgaattcataggcgtgctcgtgaggcaatgccagtactctattatatacgacgaatatatgatggacacggtgatatccctgttaaccggtctttccgatagccaggtgagggcctttcggcacacaagtactctggctgcaatgaagttaatgactgccctggttaacgtcgcgctgaacctgtccattaatatggacaatacgcaaagacagtacgaagctgagcggaacaaaatgatcggcaaacgcgctaatgaacgacttgaacttctattgcagaaaaggaaggagttacaggaaaatcaggacgaaattgaaaacatgatgaacgccatatttaaaggagtctttgtgcatcggtatcgagacgccatcgccgagattcgagcaatctgcattgaagagatcggaatctggatgaagatgtacagcgacgcatttctgaacgatagctacctcaagtatgtggggtggacaatgcacgataaacagggcgaggtcaggctgaagtgcctgaccgcgctgcagggcctctactataacaaagagctcaatagcaaacttgagctgtttacatctagattcaaagatcgcatcgtctcaatgacactcgacaaggagtacgacgtggcggtccaagctattaaactgctgacattggtgttgcaaagtagtgaggaggtacttactgcggaagactgtgagaatgtctatcacctggtgtacagcgcccacaggcccgtggctgtggcagccggggagttcctgtataaaaagttatttagccgacgggaccctgaggaggacggcatgatgaaaagaagaggccggcaggggccaaacgcaaacttagtgaaaactctggtgtttttttttctcgagtccgagttgcatgagcacgccgcatatcttgtggactctatgtgggactgtgccaccgagctactgaaggattgggagtgtatgaattccctgctattggaagaacccttatctggagaggaagctctaacagacaggcaagagagcgcccttattgaaataatgctgtgcactatcaggcaggccgcagaatgtcacccccctgtgggtcgggggactggaaagcgggttctgaccgccaaggaaaaaaaaacgcagctggacgaccgcaccaagataactgaattgttcgccgtggcactgccccagcttctagctaaatattctgttgacgcagaaaaggtcactaatctgctgcagctaccacagtactttgatctggaaatctacaccacaggacggttggagaagcacctcgacgccctgctgcgccagataaggaatattgtggagaaacacacagatactgacgtcttggaggcatgctctaagacataccacgcgctgtgcaacgaggaattcaccatattcaacagagttgatatcagccgcagccagctgatcgacgaactggctgacaaatttaatcggctgttagaggactttttacaagaaggcgaggagccggatgaagacgatgcttaccaggtcctgtctacattgaaaagaatcacggccttccacaacgctcatgatcttagcaagtgggatctgtttgcctgcaattacaagctgttgaaaaccggcatagaaaacggcgacatgccagaacagatcgtgatccacgctcttcagtgcacccactatgttatcctgtggcaactggccaaaatcaccgagtcttctagcaccaaggaagatttgctgcgcctaaaaaaacagatgcgcgtgttttgtcagatctgtcagcactaccttacaaatgtgaacaccacagtgaaggagcaggctttcacgatcctgtgcgacatcctgatgatattctcacatcaaatcatgtctggcggacgcgatatgttggagcccctggtgtacacccccgattcttcactgcagtcagagctactgtcttttattcttgatcatgtgtttatcgaacaagatgatgacaacaatagcgctgatggacagcaagaagatgaagctagcaaaatcgaagctctgcataaaaggcgcaacctcctggccgccttctgcaaattgatcgtatatacagtggtcgagatgaacactgcggcagacatcttcaagcagtatatgaagtattacaacgactacggggacatcatcaaagagacaatgtcaaagacgcgtcagattgataaaatccagtgcgccaaaactctgatcttgagcctgcagcaactgttcaatgaaatgattcaggaaaatgggtataatttcgacagatcgagctccactttttcagggataaaggaactcgcaagaaggtttgccctcacattcgggctggaccagctgaagaccagggaggcaatcgccatgttgcacaaggacggcatcgagttcgcctttaaagagccaaacccacagggggagagccatccaccactgaatcttgccttcctggacatccttagcgaatttagcagcaagctactcaggcaagacaaaaggactgtctacgtgtatctggaaaagtttatgacctttcagatgagcctgcgcagagaagatgtgtggctgccactaatgtcctaccggaattctctcttagctggcggagacgatgataccatgtccgtgatctcaggaattagctcccggggaagtaccgtgcgcagcaagaaaagcaagcccagtactggcaagcgaaaggttgtagagggcatgcagctgagccttaccgaggagagttcttcaagtgactcaatgtggctttcccgtgaacagaccctgcatacaccagtgatgatgcagacccctcagctcaccagtactataatgagggaacccaagagactacgtcccgaggactccttcatgagtgtctatcctatgcagaccgaacaccaccaaacacccctagactataacacacaggttacctggatgctggcacagagacagcaggaggaggcccgtcagcagcaggaacgcgcggcaatgtcctacgtgaagttacgcacaaatctgcagcatgccatccgtagaggtacctcattaatggaggacgatgaggagcctatagtcgaggacgtaatgatgagctccgaggggcgcatcgaggacctgaacgaggggatggatttcgacaccatggacatagaccttcctccttctaaaaataggcgggaaagaacagaacttaaacccgacttttttgatcctgcttcaatcatggacgaatctgttttaggcgtcagcatgttttag

SEQ ID NO: 3663 - DNA, 1272 bp, Artificial Sequence
  Description of Artificial Sequence: Synthetic coding sequence
atgcagcgggtgaacatgatcatggccgagagccccggcctgatcacaatttgcttactgggttatctattatctgccgagtgcacggtgttccttgaccacgagaacgcaaacaagatcttaaacagaccaaaaagatacaactccggtaagttggaagagtttgtacagggaaatctcgagagggagtgcatggaggaaaaatgctctttcgaggaagcgcgcgaagtgtttgagaatacagagcggacgacggaattctggaagcagtacgtggatgtgacatgtaatatcaagaacggccggtgcgaacaattttgtaaaaacagcgccgataataaggtggtctgtagctgtacagaagggtaccgactcgctgaaaatcaaaagagctgtgagcccgccgtccctttcccttgcgggcgggtttccgtctctcaaacttcgaagctcactcgtgcagagacagtattcccagatgtggattatgttaactcaaccgaggctgagactattcttgacaacattactcagtctacccaatccttcaatgacttcacccgtgttgtgggcggtgaggatgctaagccaggtcaatttccctggcaagtggtgctgaacggtaaagttgacgccttctgtggcggatcgatcgtgaacgagaagtggatcgtgacagccgctcactgcgtggaaacaggagtgaaaatcactgtggtcgcgggggaacacaacattgaggaaacggagcataccgagcaaaagaggaatgtaattcggatcattccccaccataattacaacgccgcgatcaataagtacaatcacgacattgccctgctagagctcgatgagcctctggtactgaattcatacgtgacaccaatttgcatcgctgacaaagaatacactaacatttttctcaaatttgggtccggctacgtctcaggttggggtagggtgtttcacaagggcaggtctgccctggtgctgcagtacctaagggtgccactcgtcgatcgcgccacctgcctccgctccactaaattcacaatctacaataatatgttctgcgctggatttcatgagggggggagagactcttgccagggcgattcaggcgggccccatgttaccgaggtagagggcacatcattcttgacaggaattatctcctggggcgaggaatgcgcgatgaagggcaagtacggtatttacacaaaggtatcgcggtatgtgaattggatcaaagagaagactaaactaacatag

SEQ ID NO: 3664 - DNA, 6690 bp, Artificial Sequence
  Description of Artificial Sequence: Synthetic coding sequence
atgttccccggctgcccccggctgtgggtgctggtggtgctgggcactagctgggttggctggggcagtcagggcacagaggccgctcaattgcggcagttctatgtcgccgctcagggaatcagttggtcttacaggcccgagcctactaactcaagtttgaacctgagtgtaacaagctttaagaagatcgtgtatagagagtatgaaccctacttcaagaaggagaagccccaaagcacgatcagcggccttctgggacctacactgtatgcagaagtgggcgacatcatcaaagtgcactttaagaataaagctgataagccccttagtattcaccctcagggcatcaggtactcaaagctatctgagggggcatcttatctcgatcacaccttcccagccgagaagatggatgacgctgtggcacctgggcgcgagtatacttacgagtggtcaatttccgaagatagcgggcctacccacgatgaccccccatgtctcactcacatctactattcgcacgaaaatctgatagaggattttaattctgggctgataggtccattgctcatctgcaagaagggaaccctgacggaaggaggaacacaaaagactttcgacaagcagattgttttgttgttcgcagtcttcgatgaatccaagtcctggagtcagtcatcctctcttatgtatacagtgaacggctatgtgaatggcactatgcctgacattactgtctgtgcacacgaccatatctcatggcacctcttggggatgtccagtggaccggagctgttttccattcacttcaatgggcaagttctggagcagaatcaccacaaggtaagcgctatcacattggtcagcgccacctctactaccgcaaacatgacagtgggccccgagggaaaatggattatttctagcctaactccaaaacacctccaggctggaatgcaggcctacattgacatcaagaactgccccaagaagacccgtaacctgaagaagattaccagggagcagcgaaggcacatgaagcggtgggagtacttcatcgcagccgaagaagtaatttgggattacgctcccgttatccccgccaacatggacaagaaataccggagtcagcacctggataatttctcaaatcagattgggaaacactacaagaaagtgatgtatacacagtatgaggatgaatccttcactaaacatacagtaaacccaaacatgaaagaggacggaattctggggccaattatccgtgctcaagttcgagatacgcttaaaattgtcttcaaaaacatggcctccagaccatactctatctaccctcatggggtcacatttagtccttacgaggacgaggttaattcttcctttacatctggccgcaataataccatgatcagagcagtgcaaccaggcgagacttatacttataaatggaacatcctcgagtttgacgaacctaccgagaatgatgcccagtgcctgacccgcccgtattactctgatgtggatatcatgagagacattgcatcgggtttgattggtttgttgcttatttgcaagtcccggagtttggatcggcagggaatccaaagagctgcggatatagagcagcaagccgtgtttgctgtgttcgatgaaaacaagtcttggtatttagaggataacataaataagttctgcgaaaatcctgatgaagttaagagagatgatcccaaattctacgaatccaacatcatgagcaattttacattatcagctatcaatggttatgtccccgagtccatcactaccctggggttctgcttcgacgacaccgtacagtggcacttctgcagcgtgggtacccagaacgagattctgaccattcactttactggccactcattcatttacgggaagcgccatgaagacaccctgacactattcccaatgcgaggggaatctgtcactgtgacaatggacaatgtcgggacctggatgctgacatccatgaatagcagcccgaggagcaagaagctccggctaaaattcagggacgtgaaatgcataccggatgatgatgaggattcctatgaaatattcgaacccccggagtctaccgtgatggccacaagaaaaatgcacgacaggctggagcccgaggatgaagaatccgacgccgattacgactaccagaaccgcctggccgctgcactcggaatccgaagcttcagaaactcgtccttgaaccaggaagaggaagagttcaatctaaccgctctggccctagagaacggtacagaattcgtgtcctctaatacggatatcattgtggggtcaaattactcttcacccagtaacatttctaaattcacggtgaataatctggcggagccccaaaaagctccaagccatcagcaagccacgaccgctggtagtcctctgcggcatctgatcggaaagaattctgtgctgaattcgagcaccgccgagcactccagcccctactcagaggaccccatagaagatccccttcagcccgacgtgaccggaatcagactcctctcactgggggccggcgagttcaagtcccaggagcacgccaaacataaggggcccaaagttgagcgggaccaggcggcaaagcaccggtttagctggatgaagctgttggcgcacaaggtcggacgacaccttagccaggatactggatcaccatccggtatgaggccgtgggaggacctgccaagccaggacaccgggtccccctcccgcatgagaccatggaaagaccccccgtctgacctgttactgctcaagcagtccaattcctccaagattttagtgggtcggtggcacctggcctcagaaaaaggtagctatgaaatcatacaagacacggacgaagacaccgcagtgaataattggctaatatccccgcagaacgcgagccgggcttggggcgagtctacccccctggccaacaagcctggaaagcagtcaggccacccgaaattcccacgcgttcgccacaaatcactacaggttcggcaggatggtggtaaaagtagacttaaaaaatcacaattcctgattaaaacccgcaagaagaaaaaagagaagcacactcaccacgcaccattatcccctcggacttttcatccgttgcgtagcgaagcctataacactttcagcgagaggcgtctaaagcactccctagtactgcataagtccaacgaaaccagcctcccaactgacctgaaccagacactgccctccatggactttgggtggatcgcatcgctccctgatcataaccagaactccagcaatgacaccggacaggctagctgcccacccggtttgtatcagaccgtcccgccggaggagcattatcaaacgttccccatccaagatcccgaccagatgcactctacctcagacccatctcaccgcagctctagccctgagctttccgaaatgttagaatacgatcgctcccataagtctttccccactgacatctcccaaatgtcgccttcatctgaacatgaggtctggcagacggtgatttctcctgatctttcacaggttacattgtcaccagaactcagtcagaccaacctgtcacctgatctgagccacacaaccctttcacctgagctgatacagcgtaacctgagccctgcattaggccagatgcccatttctcctgacctctctcacacaaccctcagcccggatctttcccataccactctctctttggacctttcccaaactaatctgtcgcctgagctgtctcaaactaatttgtcacctgccctggggcagatgcccttaagccctgacctgagccacactactctgagccttgattttagtcagaccaaccttagccctgaattatctcatatgacgctttcacctgagttatcccaaacaaatctcagcccagccctgggtcaaatgcccataagccctgacctatcccatacaaccctttcactggacttcagtcagacaaacctctcccccgagttgagccagaccaatctgagccccgcactgggacagatgcctttaagccctgatccatcacacacaaccctgagcctggacctctcacaaacgaacctgagtccggaactctctcaaactaacttaagcccagatttaagcgagatgccactgtttgctgacttatcacaaatcccactgacaccggatctagaccagatgactctatccccggatcttggggagactgacctgtctcccaactttggccagatgagcctctcccccgacctgtctcaagttaccctgtcacctgatatctcggacacaaccctgctccctgatctgagtcagatctccccccccccagacttagatcagattttttacccgagcgaaagttcccagagcctgttgttacaggaattcaatgaatctttcccgtatcctgatctgggccagatgccaagcccttcttctccgaccctaaacgacaccttccttagtaaggagttcaaccctcttgttattgtagggcttagcaaagatggtactgactatattgagatcatcccgaaggaggaagtccagtccagcgaagacgactacgcagagatcgactatgttccatacgatgacccctacaagacagacgtcagaactaacataaattcctcgagagatccggataacatagctgcctggtacttaaggtccaacaatgggaatcgccgtaattactacattgccgcagaagaaatcagctgggactattccgagttcgtccagagggaaaccgatattgaggactccgatgatattcccgaagacacaacttataagaaagtggtcttcagaaagtaccttgatagcacttttaccaaacgggacccacggggtgaatatgaggaacatcttggtattctgggccctatcatccgggccgaggttgatgatgtgatacaagtcagatttaaaaacctcgcgagcagaccatactcactgcacgcacacgggctgtcatatgagaagtcctccgaaggcaaaacgtacgaggacgatagcccagagtggtttaaagaagataacgcggtacagccaaacagctcctatacgtacgtttggcatgccactgagcggtcaggtcctgaatctccaggtagtgcctgtcgcgcctgggcgtactacagcgctgtcaacccggagaaagacatccattcaggcctgataggaccactcctgatctgccagaagggaatcttacacaaggacagcaacatgccaatggacatgagggagtttgtcctactctttatgacttttgatgagaagaagagttggtattacgagaagaaatctcggtccagctggcggctgacttcaagtgaaatgaaaaaaagccacgaattccacgcaattaatgggatgatttactccctccccggtctgaagatgtacgaacaggagtgggtccggctgcatttactgaatatagggggttctcaggatatccatgtggtccattttcacggccaaacattgctggaaaatggtaataaacaacaccagctgggggtctggccactacttccaggatcgtttaagactctcgagatgaaggctagcaagcccggatggtggttgctcaataccgaggtgggggagaatcagagggccggcatgcagactccctttctgatcatggaccgagactgtcggatgcctatggggctttcaaccggtatcataagcgatagccagattaaagcctctgagttcttggggtattgggaaccccggctggccaggttgaataatggcggaagctataacgcctggagtgttgagaaactcgccgccgagtttgcctccaagccatggattcaggtagatatgcaaaaagaagtgattattacaggcattcaaacacagggagcaaaacactacctgaaatcatgctacacaacagaattctatgttgcgtattctagcaaccaaatcaattggcagattttcaaagggaacagtacccgcaacgtcatgtactttaacgggaattccgacgcctccactatcaaggagaaccagttcgacccgcccattgtggccaggtacatccgcatctcaccaactcgtgcttataaccgcccaacgctgagactggaattgcagggatgcgaagtcaacggctgtagcacgcctctcggcatggagaatgggaagatcgagaataaacagattactgcaagttcctttaaaaagagctggtggggcgattactgggagcctttccgcgcaagactcaatgcccaggggcgagtgaacgcctggcaggcaaaggctaataataacaaacagtggcttgagatcgacctgctgaagataaaaaagatcactgcgatcataacccaaggctgtaaaagtctctccagcgagatgtatgtcaagtcttataccatccactactccgaacagggtgtcgagtggaagccatatagactcaaatcttccatggtcgacaaaatctttgaaggcaatacaaataccaagggccatgtgaagaatttcttcaaccctcccatcatcagtcgcttcatcagagtgatacccaaaacctggaaccaaagtatcgcactgcgcctggagttgtttggctgcgatatctactag

SEQ ID NO: 3665 - DNA, 6675 bp, Artificial Sequence
  Description of Artificial Sequence: Synthetic coding sequence
atgttccccggctgcccccggctgtgggtgctggtggtgctgggcacctcttgggtgggctggggctcccagggtaccgaggccgcacagctccgccagttctatgttgcggcccaaggtatcagctggagctacagacctgagccaacaaactccagcttgaatttatcagttacaagcttcaagaagatcgtataccgcgagtatgagccctattttaagaaagaaaagcctcagtccaccatttctgggcttctcggcccaacgctctacgctgaagtgggcgacatcatcaaagtgcacttcaagaacaaagcggataagcctttatccatccacccacaaggaatcagatattccaagctttccgagggtgcaagttacctggatcacacctttcctgccgaaaaaatggatgatgctgttgcccctggccgggaatacacctatgaatggtcgatcagcgaagacagtgggccaacccacgatgaccccccctgtctaactcacatatactattctcacgaaaacctcatcgaggacttcaactccgggttaataggacccctgctgatctgtaaaaaagggactctaacagaagggggcacacaaaagaccttcgataaacaaatcgttctcctcttcgctgttttcgacgaatctaaatcttggagccagtcatcctcactgatgtacacggtgaatggctacgtcaatggaaccatgcctgatattaccgtgtgtgcccatgaccatatttcatggcacctgcttgggatgtcctccggccctgaactcttcagtatccacttcaatgggcaggtgcttgaacagaaccaccacaaagtgtccgccatcaccctcgtgtcagccactagtaccacagccaatatgactgtcgggccagaggggaagtggataatctcttctctgacccctaaacacctccaggccggcatgcaggcttatatagacattaagaattgtcccaagaagaccaggaacctgaaaaaaatcacaagggaacagcgcaggcacatgaagcgctgggagtattttatcgcggccgaggaagtcatttgggactatgcacctgtcatccccgccaacatggacaagaaataccgcagccaacatctcgacaatttcagcaatcagatcggtaagcattataaaaaggtaatgtacacgcagtacgaggatgagtcttttacaaaacacacagtgaatcccaatatgaaggaggacggcattctagggcctatcattcgcgcacaagtaagagacaccctcaaaattgtgtttaaaaatatggcatctagaccatattcaatatatccccatggcgtcaccttctctccttacgaagatgaagtgaactcttcattcacctcagggcgaaataacacgatgatcagggctgttcagcctggggagacatatacttacaaatggaacatacttgaattcgacgagcccacagagaacgatgcccaatgtcttacacgtccctactattctgatgtggatattatgagggatattgcttccggccttataggactcttgctcatctgcaagagtcgctcactggatcgccagggcatccagcgggcggccgacatcgaacagcaagctgtctttgctgtttttgacgagaacaagtcgtggtacctggaggataatattaacaagttctgcgaaaaccccgacgaggtgaagagagatgatcctaaattctatgagtcaaacatcatgtcaacgataaacggttacgttccagagtccatcactacgctcgggttctgctttgacgatactgtgcaatggcatttttgctccgttggcactcagaatgaaattctgaccatccacttcactggccatagtttcatctacggtaaacggcacgaggacaccttgactttgttcccaatgcgcggtgaaagcgtgacagtcaccatggacaatgtggggacttggatgctgacatccatgaactccagcccgagatcgaagaagctgcgcctaaaatttcgcgacgtcaagtgcatccccgacgacgacgaggactcttatgagatatttgaaccacccgagagtacagtgatggcgactagaaaaatgcacgaccgactggagcccgaggacgaggagtcagacgctgattatgattatcagaatcgcctggctgccgccctgggcatcaggagctttcgtaactcctccttgaatcaagaagaagaagagttcaacttgacagctctggctctagaaaatggaacagagtttgtttcttctaataccgacataatcgtagggagcaattatagctccccttcaaatatttcgaagttcacagtgaataatcttgcagaaccacagaaggctcctagccaccagcaggccactactgccgggtctccactgcggcacctgatcgggaaaaattcagtgctcaatagtagcaccgctgaacatagtagcccatactccgaggatccaattgaagatccgctccagcctgatgttacaggcatccgtctgctctccctcggcgcaggggagttcaaatcccaagagcacgccaaacacaagggtcccaaggttgagcgggatcaggccgctaaacaccgattctcttggatgaagctgctggcacacaaagtcgggagacatctgagccaggatacaggtagtccctctgggatgcggccttgggaagatctgccaagtcaagacaccggaagcccctcacggatgagaccctggaaggaccccccaagcgacctgctgctcctgaaacagagcaattcttctaagatccttgtggggcgatggcacttagcgagcgagaagggtagttatgaaataattcaggataccgacgaggacactgccgtcaacaactggctgataagcccccagaacgcctctcgcgcatggggcgagagcacacctcttgcgaataaaccaggcaagcagtccgggcatccaaagtttcctcgggttcgccataaatctctacaggttaggcaggatggcggaaaatcacggttaaagaagtcccagttcctgataaagacacgaaagaaaaaaaaggaaaagcacacacaccatgccccattatccccaagaacctttcaccctcttaggtctgaggcatataatacgttctcagaaagaaggctgaagcattctctggtcctgcataagtctaacgaaacctcactcccaacggatttaaatcagacgctaccatccatggacttcggttggattgctagcctgccagaccataaccagaacagcagtaacgacactggtcaggcaagttgccccccgggactttatcagacagtccccccggaagagcactatcaaactttcccgattcaggatccagatcagatgcatagcacctccgatcctagccacagaagttcatcgccagaactgtccgagatgctggagtacgaccggtcccataaaagctttccgaccgatattagccagatgagtcctagcagtgagcacgaggtttggcagaccgttatcagccccgacctatctcaggtcacactcagccccgagctatcacagacaaacctgagcccagacctgtctcacactactttatccccggagttgatccagcggaatcttagtccagcactgggccagatgcccatctcccctgacctcagtcacacaacactttcaccagacctgtctcacaccacactctctctggacctgtctcagactaatttgagccctgagctcagtcagactaacttgtcaccggccttgggacaaatgccgctctccccagacctcagtcacactaccctctctctggacttcagccaaacaaacctctccccggagctcagccacatgactcttagtcccgaactgtcacaaaccaatttgtcccccgccctcggtcagatgcctatttctcccgacctgtcacacacgactctgtcacttgacttctctcaaactaacctctcaccagagctctcccaaacgaatctatctccggccctggggcagatgcctttgtcaccagaccctagtcacactaccctctctctggacctgtcccaaactaacctgagcccagagttgagtcaaacaaatctttcacccgacctaagtgagatgccactcttcgccgacctgtcccagattcctttaacccccgacctcgatcagatgactctgtctcctgatctgggcgagactgacctgtcaccgaactttggacagatgagcctgtctcctgatctgagccaagtgaccttatcgccagatatcagtgatacaaccctcttaccagacctttcccagatctctcctcctcccgacctggatcaaattttctatccttctgagagcagccaaagtctgctcctacaggaattcaacgagtccttcccttaccctgatctgggacaaatgccctcaccgagtagtcctaccctcaatgacacatttctgtcaaaggagttcaatccactggtgattgtcgggctgtctaaggacgggacagactacattgagatcattcccaaggaggaggtgcagtctagcgaagacgattacgcggaaattgattacgtgccctatgatgatccttataaaaccgacgtgaggaccaacattaattcgtccagggatccggacaacatagcagcctggtatcttagatccaataacggcaatagacggaactattacattgccgcagaggagatcagctgggattacagtgagttcgtccagcgggagactgacatcgaagacagcgacgacattcctgaagataccacctacaagaaagtggtctttagaaagtatctggactctacattcactaaacgcgacccaagaggggagtatgaagaacacctcggcatcctcggacctataatcagggctgaggtcgacgatgtgattcaggtgagattcaaaaatttagccagccggccttactctttgcacgcacacggcctgagttatgagaaatcttcggaggggaaaacgtatgaggatgacagccctgaatggtttaaagaggataacgctgttcaacccaactccagttacacctatgtgtggcatgcaaccgagagaagtggaccggagtctcccggatcggcatgccgcgcttgggcctactattcagctgtcaacccggaaaaggatatacattcggggctgatcggtcccttgctcatatgtcaaaaaggcatcttgcataaagattctaacatgcccatggacatgcgcgaatttgtgctcctgttcatgacattcgacgaaaaaaaatcttggtactacgaaaaaaaaagccggtcatcgtggcgccttacatccagtgagatgaaaaagtcacatgagtttcatgccattaatggaatgatatatagccttcccggtttgaagatgtacgagcaggaatgggtgagacttcatctgttgaatatcggcggatcgcaggatattcatgtggtacacttccacgggcagacactgctggaaaacggtaacaagcagcatcagttgggcgtctggcctctgctccccggttcctttaagacactcgaaatgaaggccagtaagcctggatggtggctcctgaatactgaggtgggggaaaaccagagggcgggaatgcaaacacccttcttgattatggaccgagactgcagaatgccaatggggctgtccacaggcataatctctgattcccagattaaggcctcagaatttctgggttattgggagcccaggctggccagattaaacaatgggggatcttacaatgcttggagtgttgagaaacttgctgccgaatttgcatcgaaaccttggattcaggtggatatgcagaaagaagtcattataaccgggatccagacccagggggctaagcattatctcaagagctgttataccactgagttctatgtggcctacagcagcaaccagattaactggcagatctttaaggggaactccacgagaaacgtgatgtacttcaacggcaatagcgacgcctctaccatcaaagagaaccagtttgatccaccaattgtcgctagatacatcagaatatcccccaccagagcatataatcgacccactttaaggctcgagctgcagggctgcgaggtgaatgggtgctccactccacttgggatggagaatgggaagatagaaaataagcagatcactgccagttcctttaagaagagctggtggggcgactattgggaacccttcagagcccgcttgaacgctcaaggtcgagtgaacgcctggcaggcaaaagctaacaacaacaagcagtggctggagattgatctcctgaagattaaaaagattacagcaattatcacacaaggctgcaagtcactcagcagtgagatgtatgtaaaatcctacactatccactacagcgagcagggcgttgagtggaagccgtacaggctcaaatcgtctatggtggataagattttcgagggcaatacaaatactaaagggcacgttaagaattttttcaaccctccaataatctctcgatttataagggtgattcccaagacctggaaccagtcaattgcgctgaggttagagctgttcgggtgtgatatatattag

SEQ ID NO: 3666 - DNA, 999 bp, Artificial Sequence
  Description of Artificial Sequence: Synthetic coding sequence
atggacgacgccgtggcccccggccgggagtacacctacgagtggagcatctctgaagactctgggcccacgcacgatgaccctccatgtctcacacacatctactacagccatgaaaacttgattgaggactttaactctggactgattgggcctcttctcatttgtaaaaagggcacgctaactgagggtggcacccagaaaacttttgacaaacagatagtgctgttatttgccgtctttgacgaatcaaagagctggagtcaatctagcagcctgatgtacacagtgaatgggtatgtcaacgggactatgccggacattaccgtgtgcgcacacgatcatataagctggcacctgcttggtatgagttcgggccccgagctattcagcatccatttcaacggccaggtgttggagcagaatcaccataaagtgagcgccatcacactggtgagcgctacatccaccacagccaacatgaccgtgggacctgagggcaagtggattataagcagcctgaccccaaagcacctgcaggcaggtatgcaggcatacattgacattaaaaactgtcctaaaaagacgcgtaacctaaaaaagattacccgggagcagagacgccacatgaagcgctgggagtattttatcgctgccgaggaagtgatttgggactatgcacccgtgatcccggcaaacatggataagaaataccggtctcagcacctcgacaacttctcaaaccagataggaaaacactacaagaaagtcatgtacacccaatatgaggatgaaagctttaccaagcataccgtcaatccgaatatgaaggaggacgggatcctcgggcccattattcgggcccaggttcgggacacccttaaaattgtgtttaaaaacatggctagtagaccctatagtatctaccctcatggggttacattttctccatatgaagacgaggtgaacagctctttcacatcaggaaccacaccctag

SEQ ID NO: 3667 - DNA, 1335 bp, Artificial Sequence
  Description of Artificial Sequence: Synthetic coding sequence
atggtgagccaggccctgcggctgctgtgcctgctgctgggcctgcaggggtgtttggccgctgtatttgttacccaggaagaggcgcacggcgtcctacatagacggcggcgcgctaatgccttcctggaggaactgcggcccggatctctggaacgcgagtgtaaggaggagcaatgttcttttgaagaagcacgggagatcttcaaggatgcagaacgcactaaactcttttggatatcatattctgacggtgaccagtgcgcctcatcaccctgccaaaacggcggttcatgcaaggaccagctgcagtcttacatctgcttctgtctccccgccttcgaaggccgcaattgcgagacccataaggacgatcagctgatctgcgtgaacgagaatgggggctgtgaacagtattgcagtgatcacacggggaccaaacggtcctgcaggtgtcatgaaggatacagcctcctggcagatggggtgagctgcacccctaccgttgaatatccctgtggcaagatccccatcctagagaagcggaacgcctccaagccacagggacggatagtgggtgggaaagtttgcccgaagggcgagtgcccttggcaggtactattactcgtgaacggtgctcagctatgtggcggaacgctaatcaacacaatctgggttgtgtcggcagcgcactgctttgataagatcaagaattggagaaatctgattgccgtgttgggggagcatgatctctcagaacatgacggcgacgaacaaagcagacgtgtcgctcaggtaattattccctcgacttatgtgcccggaaccactaaccacgacatcgcccttctgagattgcaccagccagttgttctgacagatcacgtggtgcctctgtgcttgccagagagaacttttagcgaacggacactggcgtttgttcgcttttccttggtttcagggtggggccaacttcttgaccggggagccaccgctctcgagctgatggtgctaaatgttccacggctcatgacacaggattgcctgcagcaatcccgaaaagtgggggatagtcctaacatcaccgaatacatgttttgcgctggctatagcgacgggagcaaagattcttgtaagggggatagcggagggccacatgctacccattatcgtgggacgtggtatctgactgggatcgtctcttggggccagggctgtgccacggtcggccacttcggggtgtacactcgcgtctcacagtatatcgaatggctccaaaaattgatgagaagtgagccccgaccgggagtgctgttgcgtgctccattcccatag

SEQ ID NO: 3668 - DNA, 1401 bp, Artificial Sequence
  Description of Artificial Sequence: Synthetic coding sequence
atggtgagccaggccctgcggctgctgtgcctgctgctgggcctgcaggggtgtctggcagccggtggtgtcgccaaggcgtccggtggggagacaagggatatgccatggaagcctggtcctcatagggttttcgtgacacaagaggaggcacacggcgtgctgcatcgccggcgccgtgctaacgcatttctggaagagttaagacctggctccctggaaagggagtgcaaggaagaacaatgttcattcgaggaagccagggaaatctttaaggatgccgagagaacaaagttgttctggatttcatacagcgacggggatcagtgcgcttcctctccatgccagaacggaggtagttgtaaggaccagctgcagtcgtatatttgcttttgcctgccagcgtttgaagggcggaattgcgagacgcataaagacgatcagctaatatgtgtcaacgagaacggaggttgcgagcagtactgcagcgaccacacgggaacaaaaagatcttgcaggtgccatgaaggctatagtcttctcgcagatggcgtttcctgtacgccgacagtggaatacccttgtgggaagatacctattcttgaaaaaagaaacgcctctaagccacaaggcagaatcgtcggaggtaaggtttgccctaaaggagagtgtccatggcaggtgctgctactggtgaatggagcccagctgtgcggggggactctgattaacaccatctgggtggtttccgcagcccactgctttgacaaaattaaaaactggcgtaatttgatcgcagtgctcggagaacacgacctgagtgagcatgatggcgatgagcagtcaaggcgggtggctcaggtcatcattccttcgacctatgtgccaggaaccacaaaccacgacatcgccttgctgagacttcaccagccggtggtcctgaccgatcatgtggtgccactatgtctgcctgaaaggaccttcagtgaacggaccctggcctttgtccgtttctccctggtctccggctgggggcaactattagatcgaggtgccaccgccctggagctcatggtgctcaacgtgcccaggctgatgacacaggactgcttgcagcagagccgcaaagtgggcgactcccccaacataacagagtatatgttctgcgcaggctactcggacggatcgaaggatagttgtaagggagatagtggcgggcctcacgccacacactacagaggcacttggtatctaactggtattgtgtcttggggccaaggctgcgccaccgtggggcatttcggcgtttatacgcgcgtgagtcagtatattgaatggctccagaaactgatgagatctgagcccagacccggcgtcctccttagagcacctttcccatag

SEQ ID NO: 3669 - DNA, 1194 bp, Artificial Sequence
  Description of Artificial Sequence: Synthetic coding sequence
atgggcaacgtgaaccggcagggccagcactgccgggacttcatcatggtgagtcaggccctgcgcctactctgcctgctgcttggccttcagggctgtcttgcagcagacggagatcaatgtgcaagttcaccatgccaaaatggcggcagctgtaaggatcagctgcagagctacatctgcttctgtttacctgcctttgagggaaggaattgcgagacacacaaggatgatcagctgatatgtgtgaatgaaaacgggggttgcgagcagtactgcagcgatcacaccggcacaaaacgaagttgccgctgccacgagggctattctctgctggccgatggggttagctgcacaccaacagtcgagtatccctgtggtaaaatccctatactggagaaaagaaacgccagcaaaccgcagggccgaatcgtgggcggtaaggtctgccctaaaggcgaatgcccctggcaggtattgctcctagtcaatggtgcacaactatgcggaggaaccctaatcaacactatctgggtggtcagcgcagcacactgtttcgacaaaatcaaaaactggagaaatctgatcgccgtgctgggggagcacgatttaagcgaacacgacggcgatgagcaatccaggcgtgtcgctcaggtgattattccaagtacatatgttcctggtaccaccaatcacgatattgcactgctgcgactgcaccaacccgttgtgctcactgaccacgtcgtccccctttgcctgccggaacggacgttttcagaacggacgctagcctttgtcagatttagcttggtgagtggctggggtcaactgcttgatcgaggcgctactgctctcgaactgatggtattgaacgtacccagactcatgacacaggactgtctgcagcaatcacgcaaggtcggcgactctccaaatatcaccgagtacatgttctgtgccggatacagtgatgggtccaaagatagctgcaaaggtgacagcggggggcctcacgctacccattatcgcggtacgtggtatttaaccggaattgtgtcttggggtcagggttgcgctactgtggggcacttcggagtctacactcgagtgagccaatatatagaatggttgcagaagctcatgcgcagcgagcctcggcctggcgttctccttagggctccgtttccgtag

SEQ ID NO: 3670 - DNA, 651 bp, Artificial Sequence
  Description of Artificial Sequence: Synthetic coding sequence
atgcggatccaggaccccggcaaggtgttcttcggcaacgtggactcatctggcataaaacacaatattttcaatccccctattatagcgcggtacatccgcttgcatcctacacattactctattaggagcaccctacggatggaactcatggggtgcgatctcaactcctgctccatgccactgggcatggagagcaaggctattagtgacgcacagatcactgcctctagttactttacaaacatgtttgctacctggagcccgagcaaagcacgcctgcacctgcaggggaggagcaacgcatggcgtcctcaagtgaacaatcctaaagagtggcttcaagtggatttccagaagacaatgaaggtgactggcgttaccacccagggggtgaagtccctcttgaccagtatgtatgttaaggagttccttatttccagctcacaagatgggcaccaatggaccctcttcttccagaacggtaaagtgaaagtgtttcaggggaatcaagactcttttacgcctgtggttaacagcttggatccccctcttctcactagatatctgaggattcacccccagtcgtgggtccaccaaattgctcttcggatggaagtcttgggctgcgaggcgcaggatctttattag

SEQ ID NO: 3671 - DNA, 7056 bp, Artificial Sequence
  Description of Artificial Sequence: Synthetic coding sequence
atgcagatcgagctgagcacctgcttcttcctgtgcctgctgcggttttgttttagcgccacaaggaggtactacctgggcgctgttgagctttcatgggattacatgcagagcgatctcggcgagctgcccgtggatgcacgcttcccacctcgggtaccaaaatctttcccattcaatactagcgtagtgtataagaagactctctttgttgagtttactgatcatctgtttaatatcgccaagccacggcctccctggatggggctcctgggacccactatccaggcagaagtttatgatacagtcgtcatcactttgaagaatatggcatcccatccagtgagcctgcatgccgtgggcgtgtcgtattggaaggcctctgaaggcgcagagtatgacgatcagacttcgcagcgtgagaaggaggatgataaagtcttcccaggaggtagccatacctatgtttggcaagtgcttaaggaaaacggccccatggccagcgaccccttgtgcctgacttacagttacttgagccacgtggacctggttaaagatctgaacagcgggctgatcggggccctcttggtctgtcgggagggcagcctggctaaggaaaaaactcagacactgcataaattcatccttctattcgccgtgttcgatgagggaaagtcatggcacagcgaaacgaagaatagtctcatgcaggatcgtgatgccgcctctgcccgcgcttggccaaagatgcataccgtgaacggatacgttaaccgcagcctgcccggactgatcgggtgccacaggaagtcagtgtactggcacgtgatagggatgggcacaacacccgaagtccacagtatattcctcgaaggccatactttcctggtacggaaccaccggcaagcatctctggagatcagccccataacgttcctcaccgcacaaacgcttctgatggacctgggacagttccttctgttctgtcacatttctagccatcagcatgatggaatggaagcatacgtgaaggtcgactcctgtcccgaagagccccagctccgaatgaaaaataatgaagaggccgaggactacgatgacgacttgacggactctgaaatggatgtggttcggtttgacgacgacaacagtccatccttcattcagatccggtctgtggctaagaaacaccccaagacatgggtgcactatatcgccgccgaggaggaggattgggattacgcccctctggttctggctcctgacgatcgatcctacaaatcccagtacctgaacaacggcccccagcgcattggcagaaagtacaaaaaggttcgattcatggcatacacggatgagacattcaagactagagaagccattcagcacgaatccggaatcctgggaccattgttgtacggagaggtgggtgatactctgttgatcatttttaaaaatcaagccagtcgtccttacaacatttatccccatggcataaccgacgttaggcccctgtactcaaggcgcctccccaagggggtgaaacacctgaaggacttccccattcttcccggcgaaatattcaagtacaagtggacagtgaccgtggaagatggcccgacaaaaagcgacccgcggtgcctgacccgatattattcttctttcgtgaacatggagcgcgatttagccagtggcctcattggccctttactgatttgttataaagaatctgtggatcagaggggaaaccagatcatgagcgacaagcgaaatgtgatcctgttctccgttttcgatgagaataggagttggtacctgacagagaacattcaacgtttcctgccgaatcccgccggcgtgcagctcgaggatcccgaattccaagctagcaatattatgcacagcatcaatggctatgtgtttgactccctccagctctccgtatgtctgcacgaggtggcatactggtacattctgagtatcggtgctcagacagacttcctgtctgtctttttttcaggctatacttttaagcacaaaatggtgtatgaagacactttgacactcttcccctttagcggagaaaccgtgttcatgtcaatggagaaccctgggctgtggatcctgggttgtcataactcagactttaggaatcgtggaatgaccgcgcttctcaaggtgagctcctgcgataaaaatacgggcgattactacgaggattcatacgaagatattagcgcctacctgctgagtaagaacaacgccatcgagcctcgcagctttagccagaacagccggcatccctcaactaggcagaagcagttcaatgcgaccaccatcccagaaaacgatatcgaaaaaactgacccctggtttgcccatagaacacccatgcccaaaatccagaatgtcagctctagcgacctgctgatgctgctccgacagtcccccacccctcacggtctctcgctgtcagatctgcaagaggccaaatacgaaacattttctgatgatcctagccccggcgccattgattctaacaattccctctccgagatgacacacttcaggccccagctgcaccattccggtgatatggttttcacacctgaaagcggactccagttacggctgaatgaaaaactgggaaccacggctgccacagaacttaagaaattggacttcaaggtttcttccacgtcgaacaacttaatttccaccatcccctcagacaacctcgcggccggcacagacaacacaagctctctgggccctccctcaatgcccgtccattacgacagccagttggacaccacactcttcggaaaaaaaagttcgcctctcacagagagcggcgggcccctgagtctgagcgaggaaaacaatgattctaaactgcttgagtcaggcttgatgaattctcaagaatcaagttgggggaaaaacgttagctctactgagagtggacgactgttcaaagggaagagggctcacggacccgccctgttaacaaaagataatgccctgttcaaagtgtccattagcctgctcaagaccaacaaaacctcaaataactctgcgaccaacaggaaaactcacattgacggcccatcgctgctcatcgaaaattctccatctgtatggcagaatatacttgagagcgacactgaattcaaaaaggttacaccacttatccacgaccgcatgctgatggataagaatgccactgctttgcggctgaatcacatgagtaataagaccactagctctaagaatatggaaatggtacaacagaaaaaggaaggtccaattcctccggatgcacagaaccctgatatgagttttttcaagatgctgttcctccccgaaagcgccagatggatccagaggacacacgggaagaattcgctaaactctggccagggacctagtcccaagcagctggttagccttgggcctgaaaagtcggtggaaggccagaattttttgtcggagaagaataaagttgtggtaggaaaaggcgaatttaccaaagacgtgggcttgaaggagatggtttttcccagctctcgaaacctgtttctcaccaatttagacaacctccacgaaaacaacacccacaaccaggagaagaaaatacaagaagagattgagaagaaagaaacgctcatccaggagaacgtagtcctgccccagatacacactgtgacggggacaaagaatttcatgaaaaaccttttcttgcttagcacccggcagaatgttgaaggcagctacgatggagcatatgcccccgtcctgcaggattttcggagtctcaacgacagcaccaacagaactaaaaaacacaccgcacatttctctaagaaaggggaagaggaaaacctcgaggggcttggaaaccaaactaagcagattgtggaaaagtatgcatgtaccacaagaatatctccaaatacctctcagcagaacttcgtaactcagaggtctaagcgcgccctgaaacagtttcgcttaccactcgaagagaccgagctcgagaagcgcattatcgtggacgatacctccacccagtggagcaaaaatatgaagcacctgactccgtcaaccctgacacagattgactacaatgaaaaggagaaaggggctataacccagagtcctctctccgattgtctcactaggtcacacagtatccctcaggctaacagatcaccactgcctatcgcaaaagtgagctcttttccctcaatcaggcctatttatctcacccgagtgttgtttcaggacaatagtagtcatctgcctgcggcctcgtatcgcaagaaggacagcggagttcaagagtcctctcattttctacagggtgccaaaaagaacaacctttcactggccatcctcacactcgagatgaccggagatcagcgtgaagtgggcagcctcggcacctctgccacaaatagcgtgacatacaagaaggtcgaaaacacagtcctaccaaaaccggatctgcccaagacctctggtaaggtagagctgcttcctaaggtacacatataccaaaaggacctgtttcctaccgaaacttccaatggatcccccgggcatctggacctggtggagggttccctgctccaagggacggaaggggccatcaaatggaacgaagccaatcgcccggggaaagttccttttctgagagtcgcgactgagtcctcagctaagactccttcaaagctcctggatcccttggcctgggacaaccattacggaactcagattccaaaagaagagtggaagagtcaggaaaagtctccggaaaagacagcttttaagaagaaagacacaattctgtctctcaatgcctgtgagtccaaccacgccatcgcagccattaacgagggccagaataaacccgagattgaggttacctgggccaagcaggggcgcaccgagagactgtgcagtcagaatccaccagtcctgaaacgtcaccagagagagatcacccggactactctccagagtgaccaggaagaaatcgactacgacgatacaatcagcgtggaaatgaaaaaagaagacttcgacatatatgacgaagatgagaaccagagcccgcgctctttccagaagaaaactagacattattttattgcagctgtagagcgcctatgggattatggcatgtcttcctctccgcatgttctcaggaatcgagcccagagcggcagtgtacctcagttcaagaaggttgtttttcaggagttcaccgatggttcctttacacagcctctgtaccggggcgagcttaatgagcacttaggattgctgggaccttatatccgggcagaggtggaagataacattatggtcactttcaggaaccaggcatctcggccatacagtttctacagcagtctaatctcctacgaggaagatcagcggcagggagccgaaccaaggaagaatttcgtgaagcccaatgaaacaaagacctatttctggaaagtgcagcatcacatggccccgacaaaggatgagtttgattgcaaggcatgggcgtacttttccgacgtggatctggagaaagatgtgcactctgggcttataggcccactgctggtctgccacacaaacacattgaatccggcccacggtagacaggttactgttcaggagttcgccctgttcttcaccattttcgacgaaacaaaaagctggtacttcactgagaatatggagagaaattgccgcgcaccttgtaacattcagatggaggaccccaccttcaaggaaaattaccgctttcacgcaatcaatggctatatcatggataccctcccaggccttgtaatggcacaggatcagcgtatcaggtggtatctgctgtccatgggaagtaacgagaacattcactctattcacttctccggacacgtgttcaccgtcaggaagaaagaagagtataaaatggccctgtataatctatatcccggtgtgtttgagaccgtcgagatgctgccctcaaaggcaggaatttggagagttgaatgcctcattggcgaacatctacacgctggcatgagcacactgttcctcgtgtactccaataaatgccagacaccgttgggtatggcctcaggtcatattcgggactttcagataactgcttcaggccagtatggacagtgggctccgaagctggcacgcctgcattactctggcagtataaatgcatggtcaacaaaagagccctttagttggatcaaggtcgacctgctagctcccatgatcatccatggcatcaagacacagggtgctcggcagaaattctcttcgctttacatatcacagttcatcattatgtacagtcttgatggcaaaaaatggcagacttacagaggcaacagtactggtacactgatggtgtttttcgggaacgtcgattcatctgggatcaaacataacatcttcaatccccctatcatagctcggtacattcggttgcatcctacccactattcgattcgaagcactctaagaatggaactgatggggtgtgacctcaatagctgctcaatgcccctgggcatggagtccaaggccatttccgacgctcagataacggcgtcctcctacttcactaatatgttcgctacctggtctccaagcaaggcccgactgcatctacaaggacgctctaacgcctggcggccgcaggtgaataaccccaaggagtggctccaggtcgacttccaaaaaaccatgaaggttactggggtgactacgcagggggtcaaaagcctgcttactagtatgtacgttaaggagttcctgatttcttcgagtcaggatggacaccaatggactctgttctttcagaacgggaaagtgaaggtttttcaggggaatcaggactcctttactcccgtcgtgaattccttagacccgcccttgctcacaaggtacttaaggattcacccacagtcatgggtacaccagatcgccctgcggatggaagtcctgggctgtgaggctcaggacctgtattag

SEQ ID NO: 3672 - DNA, 999 bp, Artificial Sequence
  Description of Artificial Sequence: Synthetic coding sequence
atgggccggcccctgcacctggtgctgctgagcgccagcctggccggattgttgcttttaggggaatcccttttcatccgcagagaacaggccaataatattctggcaagagtcactcgggctaattctttcctggaagagatgaaaaaaggccacctcgagcgagaatgcatggaggagacctgtagctatgaggaagccagagaggtctttgaagattccgacaaaacgaatgagttttggaacaagtataaagacggcgaccagtgtgaaacgtcaccctgccagaaccagggaaagtgcaaagacgggctcggcgagtacacgtgcacttgccttgagggatttgagggcaagaactgtgaactgttcaccaggaaactgtgcagtctggataatggagactgcgaccaattttgtcacgaggaacagaattcagtggtctgctcctgtgcgcgaggctacaccctagctgacaacggtaaagcctgtatacccacaggaccctatccgtgtggaaagcagacacttgaacgcagaaaaaggtccgtcgcccaagcgactagtagctcgggggaagcccctgattccattacctggaaaccttacgatgccgccgacctggaccccacagagaacccctttgaccttcttgacttcaatcagacccaaccagaacggggtgataataacttgacacggatcgtgggtgggcaggagtgtaaggatggagaatgtccatggcaagcgctgttaattaacgaagagaatgaggggttttgcggcggcactattctatcagaattttacatactcaccgctgctcattgtctctaccaggctaaacggttcaagggtaccggcacacggtctaggcgcagggccgtacggaggtgcactagatggagatggtcatcgagcaccactgggagtcagaggcgacccatgacaagcacgtctccatgctccgggtctcgcccaccctctccttccgcatag

SEQ ID NO: 3673 - DNA, 1467 bp, Artificial Sequence
  Description of Artificial Sequence: Synthetic coding sequence
atgggccggcccctgcacctggtgctgctgagcgccagcctggccgggttgctccttttgggcgaatccctatttataagaagggagcaggccaacaacattctggccagagtcacccgggccaactcttttctggaggagatgaagaaggggcatctcgagcgcgaatgcatggaagagacatgctcatatgaggaggcccgcgaggtgtttgaagattccgacaagactaacgagttctggaataagtataaagacggcgaccaatgtgagacatccccgtgtcaaaaccaaggtaagtgcaaggatggtttgggcgaatatacttgtacgtgtctggaaggctttgaaggaaaaaattgtgaactgttcacaaggaagttgtgtagtctcgataacggtgattgtgatcagttttgccacgaagagcaaaattccgtggtgtgcagttgtgcaagaggctacacactggcagataacggaaaggcatgcattcctaccggcccatatccctgcggcaaacagacactagaaagaagaaaaagaagcgtggctcaagcaacatctagcagcggcgaggcgccagactccatcacttggaagccttacgatgctgccgacctggacccaacagagaaccctttcgatctactggacttcaaccaaacccaacccgagcggggagataataacctgacacgcatcgttggggggcaggagtgcaaggacggggagtgtccctggcaagcccttttaattaatgaggaaaacgagggcttttgcggtggcaccatcctgagcgaattttacatactcacagccgcccattgcctctaccaggccaagcgattcaaagtgcgcgtaggagatcgaaacacagagcaggaggaaggcggagaggccgttcatgaggtcgaggttgtcatcaagcacaatagatttacaaaggagacctatgatttcgatatcgccgtcctcagattgaaaaccccaatcacattccggatgaacgtggcacctgcttgtttgccggagcgtgactgggctgagtccactctcatgacacagaaaactgggattgtgtcaggcttcggcagaacacacgagaaaggtaggcagtcgacacgccttaagatgcttgaggtgccatacgtcgacaggaattcctgcaaactctcctccagctttatcatcacacagaatatgttttgtgccggttacgacaccaaacaggaggacgcatgccagggagactcagggggaccccatgtcacacgtttcaaggatacttactttgtgacagggatagtgtcttggggcgaaggatgtgctagaaaggggaagtacggtatctatacaaaggtgactgcctttttaaagtggatcgaccgttcaatgaagacacggggcctgccaaaggccaaaagccatgccccagaggtgattacaagcagtcccttaaagtag

SEQ ID NO: 3674 - DNA, 1005 bp, Artificial Sequence
  Description of Artificial Sequence: Synthetic coding sequence
atgggccggcccctgcacctggtgctgctgagcgccagcctggccggactgctgcttctcggcgaatctctattcattcgtcgggagcaggctaacaatatcctcgcaagagtcacccgtgccaactccttcctcgaggagatgaagaagggtcatttagagcgagagtgcatggaggaaacctgctcttacgaggaggcgcgggaggtcttcgaggactccgataaaaccaatgaattctggaataaatataaagatggcgatcagtgcgagacaagcccttgccagaaccaggggaagtgcaaagacggattgggtgagtacacttgcacatgccttgaaggttttgaaggaaaaaactgcgaactgtttacaaggaaattgtgttcgttggacaacggcgactgcgatcagttctgtcatgaagagcaaaactctgtggtctgtagttgcgcgagaggatacactcttgccgataacggtaaggcatgcatccccacaggcccatatccatgcgggaagcaaactttggagaggaggaaaaggagcgtagctcaggccacatcaagctcaggcgaggcacctgacagcatcacctggaagccctacgatgctgcagacctggaccctacagagaatcccttcgatctgttggactttaatcagacccaaccagaacgcggggacaacaacctcacaaggatcgttggcgggcaagagtgcaaggatggcgagtgcccctggcaggccctgttgatcaatgaagaaaatgaaggcttttgcggtggtacaattctgagcgagttttatatcctcacagccgcacactgcctataccaagctaaacgtttcaaggtacgcggtacgggtactcggagcaggagaagagccgtgagacgatgtactcgctggagatggtctagctctactaccggttcacagcggcgccctatgacctcaacatctccgtgctccggttcccgccccccctccccaagcgcctag

SEQ ID NO: 3675 - DNA, 1722 bp, Artificial Sequence
  Description of Artificial Sequence: Synthetic coding sequence
atgatcttcctgtaccaggtggtgcacttcatcctgttcaccagcgtgtccggggagtgcgttacacagctgttaaaagacacatgcttcgagggaggcgacattactacggttttcacccccagcgctaaatactgccaggtcgtgtgcacataccatcctcgttgtttgctctttacgtttacagccgagtcaccatcagaggaccctaccaggtggttcacatgcgttttaaaggattccgtgacggagactctccctcgcgtgaaccgcaccgccgccatctcaggctactccttcaaacaatgttcacaccaaatctcggtgaacaatatttgtctgttgaaacacacacaaacagggaccccaacaagaatcaccaagctagacaaagtggtatcaggcttctctttgaaaagttgcgccctatcaaacctagcatgtattagggatatcttccctaataccgtgttcgctgacagcaatatagattctgttatggctccggacgctttcgtgtgtggacgaatctgcacacaccatcctggctgccttttctttacttttttctcacaagaatggcctaaagagagtcagaggaacctttgtctcctgaagacctcggaaagtggcttacccagcactcgtatcaagaaaagtaaagcactgtctgggttctcactgcagagttgccggcatagcattccagtgttctgtcatagttcattttatcacgataccgatttcctgggcgaggagctcgatatcgttgctgctaaatcacacgaggcatgccagaaactgtgcaccaatgcagtgagatgtcagttcttcacatacacacccgcccaggcatcatgtaacgagggaaagggcaaatgctatctgaaactctctagcaatggctctcctacaaagatcctccatggtagggggggcattagcggatacaccctgcgcctgtgcaaaatggataacgaatgtaccaccaagattaaaccacgcattgtgggcggtacagccagtgtaagaggcgagtggccctggcaggtcacccttcacactacaagccctacacagaggcatctgtgtggagggagtataattggcaaccaatggattctcaccgccgcacattgcttttacggcgtggaatcgcctaagatattgagagtatacagcggcatcttgaaccagtcagagataaaagaagacacgtcttttttcggcgtgcaggaaatcatcatccacgaccagtataagatggcagaatccgggtacgatatagctctgctcaaattggagacaactgtaaattacaccgattcacagagaccaatctgtctcccctccaagggagatcggaacgtcatctatacagactgttgggtgacaggatggggttaccgcaagctcagagacaaaattcagaatacccttcaaaaggcaaagatccccttagtcaccaacgaggaatgccagaaacgatatcgcggccacaaaatcacacacaagatgatctgcgccggctacagagaaggggggaaggacgcttgtaagggcgattccggaggcccattaagttgcaaacacaatgaggtgtggcaccttgtgggcatcaccagttggggtgagggctgtgcccagcgcgaaaggccaggcgtttatacaaacgtcgtcgagtacgtggattggatcctggaaaaaacccaggccgtctag

SEQ ID NO: 3676 - DNA, 1878 bp, Artificial Sequence
  Description of Artificial Sequence: Synthetic coding sequence
atgatcttcctgtaccaggtggtgcacttcatcctgttcaccagcgtatctggagagtgcgtgacacagctgctgaaagacacgtgctttgaaggcggtgatattactaccgtctttacccctagcgcgaagtactgccaggtcgtttgcacctaccacccgcgatgtctgctttttacatttacggccgaaagcccttctgaagaccctacacgctggtttacatgtgtcctcaaagacagcgtgacagagactctgccaagggtaaatcgtaccgcagccattagcggctattcatttaaacagtgctcccatcagatctcagcatgcaacaaggacatttacgttgacttggacatgaaggggattaattacaactctagcgtggccaaaagcgcacaggaatgccaggagcggtgcaccgacgatgtgcactgccactttttcacgtatgcaacccgtcagttcccaagtctggaacatcggaatatttgcttactgaagcacactcagacaggtactcctacaaggatcaccaagctagacaaggtggtatcgggcttcagtctaaagtcctgtgccttaagcaatctggcatgcatccgcgacatattcccgaatacagttttcgccgactccaatattgactcagttatggcgcctgacgctttcgtctgtgggcggatctgcactcaccacccgggctgcctgttcttcacattcttctctcaggagtggccgaaggaatcccagcgcaacctgtgccttctcaaaaccagtgagagcggtttgccctcaacgaggatcaaaaagtccaaagctttgtctggcttttccctccaatcttgcagacactcgatccccgtgttctgccatagctccttctaccatgatacagattttctcggcgaggaattggacatcgttgcggccaaatcacatgaggcatgtcagaaactgtgcacaaatgccgttcgctgtcagtttttcacctatactcctgctcaggcctcttgcaacgagggcaagggtaagtgttatttgaagctctcgagcaatgggagtccgaccaaaattttgcacggacgggggggcatctcagggtacactcttcggctctgtaaaatggataatgaatgcacgaccaaaattaagccacgcatcgtgggcgggacggcgagcgtgaggggggagtggccatggcaggtgactctgcacaccacttctccaactcagcgccacttgtgcgggggatccattataggcaatcagtggatactcactgctgcccactgtttttacggggtcgagagccccaagatcttacgcgtttatagtggtattcttaaccaaagcgagatcaaagaagacaccagtttctttggagttcaggaaatcatcattcacgaccaatataaaatggccgagtccggatacgacatagcactgctcaaactggaaaccactgtcaattacacagattcacagcggcctatttgtctccccagcaagggcgataggaatgtgatctacacggactgttgggtcactggttggggataccgaaagcttagagacaagatccaaaacacactgcagaaagcaaagatcccgctggtgactaatgaggagtgtcagaaaaggtaccgtgggcacaagattacgcataaaatgatatgcgccggataccgggaggggggaaaggacgcttgcaagggcgactcaggcggccccttgtcatgcaagcacaatgaggtttggcatctggtggggataacatcctggggcgagggatgcgcccagagagaaaggccaggcgtctacacaaacgtcgtggaatacgtggactggattctggagaagactcaggccgtgtag

SEQ ID NO: 3677 - DNA, 633 bp, Artificial Sequence
  Description of Artificial Sequence: Synthetic coding sequence
tgaagcggcttcagcctgaagagctgcgccctgagcaacctggcctgcattcgggacatttttccaaataccgtgtttgctgatagcaatatcgattccgtgatggctccggacgcctttgtctgtggccgcatttgtacccatcacccaggctgtctgttcttcactttcttttctcaagagtggcccaaagaaagccagaggaacctgtgtctgctaaaaacttcagaaagtggactcccttctaccagaataaagaagtcaaaagccctctctggtttcagcctccagtcctgtcggcactctataccagttttctgccactccagtttttatcatgacaccgattttctcggcgaggagttggatatcgtcgccgcgaagagccatgaggcatgtcagaagctgtgcacgaacgctgtgcggtgtcaattctttacatacacacccgcacaggccagttgcaacgaaggcaaaggaaaatgctacctcaagctgtcttcaaacggtagtcccactaagatcctgcatggtagaggagggatttcgggatataccttgcggctgtgcaaaatggacaatgagctgaggggtgccccaatgaagataagcggctggctgaagacttcctag

SEQ ID NO: 3678 - DNA, 2199 bp, Artificial Sequence
  Description of Artificial Sequence: Synthetic coding sequence
atgagcgagaccagccggaccgccttcggcggccggcgggccgtgcccccaaacaattctaacgccgccgaagatgaccttcccaccgtggaactccaaggtgttgtacctcggggagtgaacctccaggagtttctcaatgtgacttctgtgcatctttttaaagaacgctgggatacaaataaagtggaccaccacacagacaaatatgagaataataaattgattgtgcgaagaggccagtccttttatgtgcagatcgacttctcacggccgtacgatcctaggagggatctttttcgcgtcgagtatgtaataggccgctatcctcaggaaaacaaagggacctatattcccgtcccaatcgtgtctgaactccagagcgggaaatggggtgcaaagatcgttatgcgggaggacagatcagtgcggctgagcattcagtccagccctaaatgtatcgtgggcaagttccgaatgtacgtcgcggtgtggaccccttacggagtattgcggaccagcagaaatccagagacagacacatacatcctgtttaatccctggtgtgaggatgacgctgtctatctggacaacgaaaaagagagggaagagtacgttttaaacgacattggcgtgattttctatggggaagttaacgacattaaaacccggagttggtcctatggccagttcgaggatggcatcctggacacgtgcctttacgtgatggatagggcccagatggatttgtctgggagggggaacccaatcaaggtatctagggtcggtagcgcgatggttaatgcaaaagacgatgaaggtgtgctcgttgggagctgggataatatttacgcgtacggcgtgcccccatcagcttggacgggatcggtcgacatcctcctggaatatcgctctagtgagaatcccgtgcggtatggacagtgctgggtattcgccggtgtgttcaatacatttttaaggtgcttgggcatacctgcccgaattgtaaccaattacttcagcgcacacgacaacgacgccaatctgcaaatggatatcttcctggaagaagacgggaacgtgaattccaaactcaccaaagatagcgtgtggaactatcactgctggaacgaggcctggatgacccgccccgatctgcctgttggattcggcggatggcaggccgtcgattctactcctcaagaaaattctgacgggatgtatagatgtggtccagctagtgtgcaagccataaaacatggtcacgtctgctttcaatttgatgccccttttgtgttcgcagaagtaaattccgacctcatctacattaccgccaaaaaggacgggactcacgtggtggagaacgtggacgccacccatatcgggaagctgatcgttacaaagcagattggcggcgacggcatgatggacatcaccgatacctacaagttccaggaaggccaggaggaagaaaggttagccctggagactgcactaatgtatggcgcaaaaaagcccttaaataccgagggagtcatgaaatcaaggtccaacgtggacatggacttcgaagtcgagaacgcggtgctaggaaaagattttaagctgtctatcacctttaggaataactcccataatcggtacaccattaccgcctacctgtctgctaacattaccttctatacaggggtacccaaagcagagttcaaaaaggaaacctttgatgtcaccctcgaacccctctccttcaagaaagaagcagtgttgatacaggcgggggaatatatgggccagctgcttgagcaagcgtccctacacttcttcgtgaccgcccggatcaatgagaccagagacgtgctggccaagcagaagtcgaccgtgttgacaattcctgaaatcatcattaaggtacggggaacacaggtggtgggatctgatatgacagtgaccgtagagtttaccaatccactgaaggaaacactcaggaatgtgtgggtacatcttgatgggcccggggttacccggcctatgaaaaagatgtttcgagagatccggccgaacagtacggtccagtgggaagaagtgtgcagaccttgggtaagcggccaccgcaaacttatcgccagcatgtcgagcgactcactgagacatgtctatggcgaattggacgttcagatccaacggcggccctccatgtag

SEQ ID NO: 3679 - DNA, 417 bp, Artificial Sequence
  Description of Artificial Sequence: Synthetic coding sequence
atgagcgagaccagccggaccgccttcggcggccggcgggccgtgccaccaaataactctaatgccgcggaagatgacctacccaccgtggaactgcagggtgtggtgccacggggagtgaaccttcaggagtttctaaatgtgaccagcgtgcatctgtttaaggagagatgggatacgaacaaggttgaccatcatacagacaagtatgaaaataacaagctcattgtgagaaggggccaatctttctacgttcagattgatttctctaggccttacgacccaagacgggatttatttcgagtcgagtacgtgattggccgctacccccaggaaaacaaggggacctacatacccgttccaatcgtgtccgaactgcaaagtggcaaatggggtgcgaagatcgtgatgcgctag

SEQ ID NO: 3680 - DNA, 1881 bp, Artificial Sequence
  Description of Artificial Sequence: Synthetic coding sequence
atgagcgagaccagccggaccgccttcggcggccggcgggccgtgccccctaacaactccaacgctgccgaggatgatctgcccactgtcgaactgcaaggagtggtgccccggggggtgaatcttcaaggtaggtaccctcaagagaacaagggcacttacataccagttcctattgtttctgagctacagtccggcaagtggggggcaaagatcgtgatgagagaagatagatcggtgcgcctttcaatacagagctcccctaagtgcatcgttggaaaattccgaatgtatgtggccgtctggactccgtatggcgtactccgtacatcccgcaaccccgagactgatacatatatcttattcaacccttggtgcgaagatgatgctgtgtacctagataacgaaaaagagagagaagaatatgtgctgaatgatattggtgtaatcttttacggggaggtaaacgacattaaaacaagatcttggagttatgggcagtttgaagatggcatactggatacatgcttgtatgtgatggaccgggcacaaatggaccttagcggtcgggggaaccctatcaaagtgtcccgtgtggggagtgctatggtgaatgctaaggatgacgaaggagtcctcgtaggtagctgggacaatatttacgcctatggtgttccgcctagtgcctggacaggaagcgtagacattctcctggaataccgtagctccgaaaaccctgtaaggtatgggcagtgttgggtgttcgctggtgtcttcaatactttcctgcgctgtctcggcatacccgctcggattgtcacaaattacttttccgcgcacgacaatgatgcgaacctgcagatggacatctttctcgaagaggacggtaatgttaatagtaaattgacaaaagattcagtgtggaactaccactgctggaacgaggcttggatgacccgtccggatctccccgtcggcttcggcggctggcaggccgtggacagcacgccccaagagaactccgacggcatgtaccggtgtggccctgccagcgtgcaagccattaaacacggacatgtctgttttcagtttgatgcaccattcgtgttcgccgaggtcaattctgaccttatctatatcaccgctaagaaagacggaactcacgtggtggaaaacgtagatgccacacacattggtaagttaattgtgaccaagcagatcggcggggatggaatgatggatataactgacacgtataagtttcaggaagggcaagaggaggaaaggctagctctcgaaaccgctctgatgtatggggcgaagaagccactgaacaccgagggtgttatgaagagccggtccaacgtcgatatggactttgaggtggagaacgccgtcctcggaaaggactttaaactctcaattacatttcggaataattcccataacaggtatactattaccgcttaccttagtgcaaatatcaccttctacactggagtgccgaaggccgagtttaagaaggaaaccttcgatgtaactcttgaacctctctcttttaagaaggaagctgtactgattcaggcaggcgagtacatgggccagctcctcgaacaggccagtctgcatttctttgtgacagctcgaattaacgaaaccagagatgttctcgctaagcaaaaatccacagtgctcactatccccgaaattatcattaaggtgagaggaacccaagtggtgggcagcgacatgaccgtcactgaagtgtgtagaccttgggtgagtgggcatcgaaagctgatagccagtatgtcctctgactccctgaggcacgtgtatggcgagctggacgtgcagatccagcgccgcccctccatgtag

SEQ ID NO: 3681 - DNA, 8835 bp, Artificial Sequence
  Description of Artificial Sequence: Synthetic coding sequence
atgaccctgcggctgctggtggccgccctgtgcgccggcatcctggcagaagccccaagggtgagggcgcagcatcgcgaacgggtgacctgcacacgcctgtacgcagcagatatagtgttcctcctcgacgggtcctcttctattggccgctcaaatttcagagaagtgcgttcgttcctggaaggactagtgctgcccttctcaggcgcagccagcgcccaaggagttcgcttcgctaccgtccaatacagtgacgaccccagaacagagttcggcctcgatgcacttggcagcggcggcgatgttattcgggccatcagggaattgtcctataaggggggtaacaccaggaccggcgctgctattctccacgtggctgaccacgtcttcttacctcagttagcccgaccaggggtgcccaaggtctgcattcttatcaccgacgggaagtcccaggacttagttgacactgcagcccagcgcttgaaagggcaaggcgtgaaactgtttgccgtaggtatcaagaatgctgatcctgaggaactcaagcgggtcgcaagtcaacccaccagtgatttcttcttctttgttaacgacttctccatattgcgcacactgcttcccctggtgtctagaagagtgtgcactacagccggaggcgtgcccgtgaccagacctcccgacgattccacatcagccccacgagatctggtgctgtcagaaccaagttcccagagcctgcgagttcagtggactgcagcctccggacctgtgaccggctataaagtccagtataccccattaactggcttgggacagccactgcccagtgagcgccaggaagtgaacgtacccgctggcgaaacatccgtcagactgcggggcctaagaccactaaccgaataccaggtcacggtcatcgcgctgtacgcgaatagcattggagaagccgttagtggcaccgcacgcacgaccgccctggagggcccagaattaacaattcagaatacaaccgcacactcactgcttgtcgcgtggcgatcggtccctggagccaccggctaccgggtgacatggcgagtactgtccggcgggccaacgcagcagcaggaactcggtcccggtcaaggctctgtgctgctaagagatctggagcccggaaccgattacgaagtaacggtttcaacgctgttcggaagaagcgttgggcctgctacatcactgatggcacgtacagacgcctcagtcgagcagaccctgagacccgtcatcctgggccccacctccatcctgctttcatggaatctcgttccagaagcccgaggttatcgcttggaatggaggcgcgagaccggcctagaacccccgcagaaagtggtgctcccatccgatgtaactaggtatcagctagatggcctgcagccagggactgagtatcgactaaccctttatactttactggagggacacgaggtcgctactccagcaacggtagtcccaaccgggccggagcttcctgtttctcctgtgaccgatctacaggctaccgagctgccaggccagagagtccgggtcagctggtctccagtgccaggcgctacccagtatcggataatcgtgagatcaactcaaggcgtggagagaactttggtccttccaggatcccagaccgcttttgatctggatgacgtgcaagctgggctttcatatacagtgcgcgtgagcgccagggtgggcccacgtgagggctctgccagcgtgttaacggttagaagggagcccgagacccctctggccgtccctggattacgagtagtcgttagcgacgctactcgcgtgcgggtggcctgggggccggtgcctggagcctcaggcttccgcatcagctggtctactggaagcgggcctgagtcctcccagaccctgccgcctgactcaacagccactgatatcactggcttgcaacctggcactacctaccaggttgctgtcagtgtactgagaggacgcgaagagggccccgccgcagtgattgttgctagaacagatccactgggccctgtgaggaccgtgcacgtgacccaagccagcagttctagcgtgaccatcacctggactcgagttcctggcgcgacaggttacagggtttcctggcacagtgcacacggcccggaaaagagtcagctggtctccggcgaggcgacggtcgcggagctggacggtctcgaacctgacacagagtacactgtacatgtccgcgcccatgtcgccggagtcgatggcccacccgcctctgtggtggtgaggacagcgcctgagccggttgggcgtgtatcacgcctgcagatattgaacgcctcgtcagatgtcctgagaatcacgtgggtgggcgtaactggcgccacagcgtaccgactggcatgggggcgctcagaaggcggtccaatgcgacaccagatcctgcctggaaacacagattccgccgaaatcaggggactcgaaggcggggtctcctatagtgtgagggtgactgccctggtgggcgatcgcgaaggaacccccgtgagcatcgtggtgaccactccacctgaggccccacctgcactcggcacgttgcacgtggtacagaggggggaacacagcctgcgactgagatgggaacctgtgccccgtgcccagggcttcctgctgcactggcaaccagagggagggcaagagcagagtagagttctcggccccgagctgtcttcctatcacctcgatggcctagaaccagcgacgcagtaccgggttcgtctgagtgtgctaggacccgccggcgagggaccttcagccgaagttactgccaggaccgagtctccacgcgtgccgtctatcgaactgagggtcgtagacaccagtatcgacagtgttactctcgcctggacgcctgtgtcacgtgcatcctcatatatcctgtcttggcggcctctacggggccctggccaggaggtgcccggctctccacagacattgccaggcattagtagttcccagcgcgtgaccggcctggagccaggggtgtcctatatctttagcctcacacctgtgctggacggcgtgcggggaccggaagcatctgtaactcaaacacccgtgtgccctcgtggcctggctgacgtcgtgtttctgccacatgctacacaggataacgcgcacagggccgaggccactagacgcgtactggagcgactggtgctcgcacttggaccactggggccccaggccgtccaggtaggcctcctgtcctatagtcaccggccctccccacttttccccctgaacggatctcatgacttgggcatcatcctccaacgcatacgcgacatgccctacatggatccgagcggcaacaatctgggaacagccgttgtgacagctcaccgctacatgctggccccagatgcgccggggcgaaggcaacatgtccccggtgtaatggtactattagtggacgagccactccgaggagacattttttctccaattagggaggcccaggcctcaggactaaacgttgtcatgcttggtatggctggtgcagaccctgagcaattgcgccggctggcccccggtatggattccgtgcaaaccttttttgcggtggatgatggcccctcactggatcaggctgtgtccggactcgcaacagctctgtgccaggcctcgtttactactcagccgaggcccgagccatgtccagtatattgcccaaaagggcagaaaggcgaacctggtgaaatgggcctacgggggcaggtcggtccccccggtgatcccggcctgccaggtaggactggagcccccggtccccagggccccccaggttctgcgacagcaaagggggaacgagggtttcctggggccgatggcagacccgggtcaccggggcgcgccggaaaccccggtacccctggggcaccgggcctgaaagggtctcccgggctgcctggaccacggggggaccccggggagcgcggtcccaggggcccgaagggtgaaccaggtgcaccaggccaagtgatcgggggagaagggccaggcctgcccggtaggaagggcgatcctggaccaagcgggccccccgggccacgaggacctctgggggatcctgggccccggggcccgcccggactccctggcaccgccatgaagggtgacaaaggagacaggggagaacgcgggcctcccggccctggggaaggggggattgcccccggcgaacctggcctgcccggactgccaggatcaccgggtccacagggcccagtgggccctcccggaaagaagggtgagaaaggagattcagaggatggtgcccccgggctgccaggacagccaggtagccccggtgagcaagggcccagaggcccacccggagctattggtccaaaaggggatagaggcttccccggtcctctcggtgaagctggggagaaaggagagaggggccctccaggcccggccggaagcagaggcttacctggggtggcaggacgccctggcgcaaagggacccgagggccccccaggtcctacaggccggcagggagagaagggggagcctggacgaccaggcgatcctgccgttgttggaccggccgtagcaggtcctaagggcgaaaaaggcgacgtcggtcccgccggtccacgtggagcaaccggcgttcagggcgaacgcggaccgcccgggctagtattgcctggggaccccggccccaaaggggacccaggtgatcgagggcccatcggtctaacagggcgggcaggcccacccggggattccgggcctcccggcgaaaaaggagaccccggcaggccaggccccccagggcccgtgggcccacgcggaagagacggagaggtgggcgaaaagggagacgaaggccctccgggggatcctgggctgcccgggaaggctggcgagaggggactacggggagcccctggggtgcggggaccggtcggcgagaagggggatcagggagatcctggggaggatggccgcaatgggagccccggctcgtcaggacctaaaggagacaggggggagcccggaccccccggcccgcccgggaggctggtagatacaggtcccggcgcccgcgagaagggagagccgggcgatcgcggacaagagggccctcgaggcccaaaaggggatccaggacttccaggcgcacccggggagaggggcattgagggatttcggggacccccaggacctcagggagaccccggtgtgaggggcccagcgggcgagaagggcgataggggtccaccagggctggacggaagatccgggttagacggcaagcctggcgccgccggaccatcaggccctaatggagctgcgggaaaggccggagacccagggcgagacggtttaccgggtcttcgaggtgaacagggtctacccggacccagcgggcccccaggattacctggaaagcctggcgaggacgggaagcccggtttaaacggcaagaatggggagcccggcgaccctggtgaagatggaaggaagggggagaagggagactccggagcttccgggagagaaggacgcgacggtcctaaaggggagcgcggggccccaggtatccttggtccacagggcccacccggcctcccgggtcccgtgggtcccccaggccaaggattccccggagttcccggcgggaccggccccaaaggagacaggggtgagacgggtagcaagggtgagcaagggttacccggcgagcgggggttgcggggggagcccggatccgtgcccaacgtggatagactgctggaaactgccggcataaaggcgtctgccttgcgggaaatcgtagaaacctgggatgaatcctctggatcattcctgccagtccccgagcggcgccgaggtcctaaaggtgatagtggggaacagggtccacccggcaaagaagggcccattggctttccaggagagagaggcttgaagggagatcgcggcgatcctggccctcagggtccacctggcctggccttaggcgagcgggggccacctggaccatcaggcctggctggggagcccggcaaaccaggcattccaggactccccggaagggctggcggagttggtgaagcggggaggcccggcgagaggggcgagagaggagaaaagggtgagcggggagaacagggtcgtgacggaccacctggcctaccgggcactcccggccctccaggccctcctggacctaaagttagcgtcgacgaacctggccctggtctttccggggagcagggtcctccgggcttaaagggtgcgaagggggaaccagggtccaatggtgaccaggggccaaagggggatcgcggcgttccaggcattaagggcgaccgtggtgagcctggtccccggggccaggacgggaatccaggtcttccgggcgaacgcggaatggccgggccagagggtaaacctggactccaggggccccgaggcccacccggtccagttggtggacacggtgaccctggaccaccgggcgctcccggccttgctgggccagcgggaccacaagggccgtccggactgaagggggagccaggcgagacaggacctccaggccgcggtttaacaggacccacgggtgccgtgggcctaccgggtcctcctggccctagcggactcgtgggacctcaggggtccccgggcctgcctgggcaggtcggggaaacagggaagccaggggctcccggccgagacggagcttctgggaaagatggcgatcgagggagccctggggtccccggtagccctggactgcccggcccggtgggccccaaaggcgagcctggaccgacaggggcccccggccaggccgtagttggcctgcctggggctaaaggagagaagggcgcccccggggggttagcaggtgacctggttggtgaaccaggagctaaaggcgaccgaggcctgcctggacctcggggggagaaaggagaggccggcagagccggtgagcccggggaccctggggaggatggacagaaaggagccccaggacccaaaggcttcaaaggagacccaggcgtgggcgttcccggctcacccgggccccctggacccccaggagtgaagggggatctcggactgccggggttacccggggctccaggtgtggtcggattccctggacaaaccgggcctcggggagaaatgggacagccaggaccgagcggagaaagaggactggccggccccccaggccgggaaggcatccctgggccactgggcccccctggaccccccggttccgttgggccacccggggcctcgggtctcaagggcgataagggcgaccccggggtcggtctgcctgggcccagaggcgagcgcggagaacccggcatcagaggcgaggacgggaggccgggacaagaagggcccagaggccttacgggccctccaggcagccggggcgaacggggggagaagggagatgtgggctcagcaggattaaagggagataagggagactcagctgtgatcctggggccccccggaccccggggcgcgaaaggcgacatgggcgagcgcggaccacgaggattagatggcgacaagggcccccgaggagacaacggagaccctggcgataaaggatcaaaaggagagcccggagataaagggagcgcaggactccctggactccgtggcttgctcggcccacaaggacagccaggggctgcgggtatacccggagatccaggatctccagggaaagatggagtgcccgggattcggggggagaaaggcgacgtcggattcatgggcccaagaggattaaagggggagcggggggtcaaaggagcctgcgggctcgacggggagaagggtgataagggtgaggccggtccacccgggcgccccggtctggctgggcacaaaggcgaaatgggcgaaccaggcgtcccgggtcagtctggagcacccggtaaggaggggcttattggacccaaaggggaccgaggatttgacggccagcccgggccgaaaggcgaccagggggagaagggagagaggggtacacccggaataggcggattcccaggacctagtgggaatgacggcagtgccggcccaccaggacctccggggtctgtaggcccaaggggacctgaaggcttgcagggccaaaagggtgagagaggcccacctggcgagagagtcgtaggagctcccggggttcctggggcgcctggagaacggggtgagcaaggcaggcctgggcctgccggacctcgaggcgaaaaaggtgaggcggctctcaccgaggacgatatcagaggctttgtgcggcaggagatgagtcagcactgtgcttgtcagggacaatttatcgccagcggctcacggcccctgcccagttacgccgctgatacagcaggctcccagcttcacgccgttcccgtactccgggtgagccacgcggaggaggaagagcgggtgcctccggaagatgatgagtacagtgagtactcagagtattctgtggaggagtaccaggacccggaagcgccatgggactcggacgacccctgctccctgcccttggacgaaggctcttgtaccgcttatactcttcggtggtaccacagggcggtgactggttctacagaagcatgtcatccgtttgtttacggaggctgtggggggaacgccaatcggttcgggactagagaggcttgtgagcgcaggtgccccccccgggtggtgcagtctcagggtactgggaccgcccaggactag

SEQ ID NO: 3682 - DNA, 8739 bp, Artificial Sequence
  Description of Artificial Sequence: Synthetic coding sequence
atgaccctgcggctgctggtggccgccctgtgcgccggcatcctggcagaggcaccccgggtgcgcgctcagcatagagagcgggtgacttgcactcggctatacgcggccgatatcgtgttcctgctggatggaagctcttctattggcagaagtaattttagggaagtgagatcgttcctggagggattagtgctccctttctccggagctgctagcgcgcagggggtgcggtttgccaccgtgcaatattctgatgacccacggactgaattcggcctggacgcgttgggttcaggcggcgacgtaattagagccataagggaactgagctataagggcggtaatacaaggaccggagctgccattcttcacgtggctgaccacgtcttcctcccacagctggcacggcccggcgtgccaaaggtgtgcatccttataactgatggaaagtctcaagacttagtggacaccgcggcccagcggctaaaaggccagggcgttaagttgtttgcggtgggaattaagaacgccgacccagaagagctcaagagggtggccagccagccaactagtgacttctttttcttcgttaatgatttttccatccttagaacccttctccctttggtgtcgagaagggtttgcaccacagctgggggcgttcctgtgactcgcccccctgacgacagcacgtctgcaccccgtgacttggttttgtctgagccctccagccagagcctgcgtgtacagtggaccgctgccagtgggccggtaacagggtataaagttcagtatacaccccttacaggcttgggacagccattgccttccgagcggcaggaggtaaacgtgcccgcaggggagacctctgtaagattgaggggactgcggccactgaccgagtatcaggtcacagtcatcgctctttacgctaattccattggcgaagcggtgagtggcaccgcccgaactactgccttggaagggcccgagctcaccatccaaaacactacagcgcactcactgctggtcgcctggagaagcgttccaggagccacaggatatcgggtgacatggcgagtactgagcggcgggcccacacagcaacaggagttgggccctgggcagggcagcgttctcttgcgggatctggagccaggaaccgattacgaagtgaccgtctcaaccctgttcggcagaagtgtcggcccagcaacctctctcatggcccggactgatgcatccgtggaacaaaccctgcgccctgtcatcctgggccctactagtatattgctgagctggaacctagtacctgaggctcgggggtaccgactcgaatggagacgggaaactgggctagagcccccacagaaagtcgtccttccaagcgatgtgacacgttatcagcttgacgggctgcagccgggcacggaatatcggttgacactgtacacactgctggaaggacacgaagtggcgacacctgccactgttgtgcccaccggacccgagctacctgtgtcgcccgtcacggacttgcaagccaccgagctcccagggcaaagagtgagagtgagttggtcccccgttcctggggctacccagtatcggattattgtgcgctctacccagggcgtcgaaaggacactggtgttgcctgggagtcaaaccgctttcgacctcgacgatgtacaggccgggcttagttacacggttcgggtctcagcacgggtagggccccgtgaaggaagtgcgtctgtgctcaccgtgcgaagagaaccagaaacccctctcgccgtgcctggattaagggttgtggtgtcagacgcaacccgggtgcgggtggcttggggccctgtccccggagcttcaggattccgaatctcctggtccaccggaagcggacctgaaagctcccagactctgcctcctgactcgacagcaaccgatatcacaggcctccagcccggaactacctatcaggtggccgtcagcgtgctaaggggccgcgaagagggcccagccgccgtgatcgttgctaggactgaccccttgggtccagtgaggacagttcacgtgacacaggcctcctcgagctccgtgactattacctggactcgagtgccaggtgctacaggatatagagtcagctggcacagcgcccatggccccgagaagtcccagcttgttagtggagaagcgaccgtggcggagctggatggactggagcctgataccgagtatactgtgcatgtgcgggcacacgttgcgggagttgacggtccacccgccagcgtcgttgtgcgcacagcccctgaacccgtgggacgcgtttcccgacttcagatcctgaacgcatcaagtgacgtgctgagaatcacatgggtaggagtaacaggtgccacagcgtataggctagcttgggggagaagcgaggggggccctatgaggcatcagatcctgcctggcaataccgactccgccgagataagaggactggagggcggtgttagctactctgtccgagtgacggcgctggtgggggatcgtgaaggcacacctgtatccatcgtcgtcacaacccccccagaagcccctcccgcccttggcaccctccacgtcgtacaaagaggagagcatagcctccgcctgaggtgggagcccgtgccaagagcacaaggattcctgttacactggcagccggaaggaggacaagaacagtccagagtgctgggacccgagttgtccagctatcacttggacggtttagagcctgccacgcagtatcgcgtccgactgagcgtgctaggccccgctggtgaggggccgagtgcagaagtgaccgcgaggacagagtccccacgggtgccatccattgaacttagggtcgtggacacaagtatcgatagtgtaacactggcttggacgcccgtttcgcgggcctcttcttacatactgtcctggcgaccgctccgtgggccagggcaggaagtgcccggcagccctcagactctgcccggaatcagctctagccaacgtgtgactggcttggagcccggcgtgtcctacatcttcagtttaactccagtcctcgacggagtccgcggccccgaggcatcagtgacacagacgccagtgtgtcctagaggactggccgacgtggttttcctaccacacgcaacacaagacaatgcccatcgggccgaggcgacacgtcgggtgcttgagagactagtgctggcccttggccctttggggccccaggcggtgcaggtcggactgctgtcttactcacaccgacccagtcccctcttcccactgaatggttctcacgatcttggcataattcttcagagaataagggatatgccttatatggatccctccggcaacaatcttgggacagcggtcgtgacagcacatcgctatatgctcgctcccgacgctccaggccggaggcaacacgttcccggtgtgatggtgctcctggtcgacgagccactgcgaggagacatctttagtcctatacgagaggcacaggcctcaggcttgaatgttgtgatgctgggcatggccggcgccgacccggagcagctaaggagactggcacccggcatggattctgttcagacttttttcgctgtcgacgacgggccatctttggatcaggcagtgtccggcttggccaccgccctttgtcaggcaagttttactactcagccccggccagagccctgcccagtgtattgcccaaagggccagaagggggaacccggcgagatgggcctcaggggtcaggtgggtcccccaggcgaccccgggctgccgggacgtaccggcgcgcccgggccacagggcccaccaggttccgctacggctaagggagagaggggtttccccggcgctgacggccggccaggcagccctggccgcgccggcaatccagggacaccaggggctccaggtcttaaggggagccctggccttccgggtccaaggggcgaccccggagaacgaggtccacgcggaccaaagggggagcctggcgccccaggacaagtcataggcggggaggggcctggcctgccgggcaggaagggcgacccaggcccttccggccctcccggacctcgtgggccactgggagaccctgggccccgtggtcctcccggccttccaggcacagctatgaagggcgataaaggcgacagaggtgagagaggccctcccggacccggcgaaggggggatcgcccccggcgagcccgggttacctggcctgcccgggagcccaggccctcaggggccggtcggcccacccggaaagaagggtgagaagggtgacagcgaggatggggcccccggcctgcccggtcagcctggatctcccggggaacagggaccccgggggccccccggggcaattggaccaaagggggataggggctttcccggccctttgggtgaagctggggagaagggggagcgtgggccacccggtcccgccggttcaagaggtttgccgggcgtggctggtaggccaggagcaaagggtccagaaggcccccccgggccaaccggtcgccaaggcgagaagggcgagcctggacggcccggagatcctgctgtggtcggtcctgctgtcgccggtcccaaaggcgaaaaaggggatgtgggacctgccggtcctcggggggctactggcgttcagggtgaaagagggccacctggcctggtgttgccaggggatccaggccctaagggtgaccctggcgaccgaggtccgattggtctcactggcagagctggcccaccaggagacagtgggcccccaggcgagaagggggaccctggcaggccaggacctcccggaccagtcgggccgcggggacgtgatggggaagtaggcgagaagggtgacgagggtccacccggcgatcctggactgccgggtaaagccggggagcggggcctccggggagccccgggcgttaggggccctgtgggcgaaaaaggtgatcagggggacccaggcgaggatggacgcaacggcagcccaggctccagtggaccaaaaggagaccgaggggagccgggcccccccggcccccctggacgcctcgtggacaccggtccaggggccagggagaagggggaaccgggcgatcgtggccaggaagggcccaggggccccaagggggatcccgggttacctggtgctccgggtgagcgtggcatcgagggattcaggggtccaccagggccccagggtgatccgggggtcagggggcctgccggcgaaaaaggagatagaggtccacccggactggacgggcggtctggactcgatgggaagcctggggcagccggacccagcggccccaatggcgctgcagggaaagcgggcgaccctggaagagatggcctccctggacttcggggcgagcaggggctgccaggccccagcgggccgcctggacttccaggaaagcctggagaggatggaaagccgggcctgaacggcaaaaacggcgagccaggggaccccggggaggacggcaggaaaggagaaaagggggattctggtgcctctggcagagaaggattccctggggtgcctggaggtacgggcccaaaaggcgaccgaggagagaccggaagcaagggcgaacaagggctgcccggggagagaggattaaggggggagccgggttccgtccctaacgtcgacagacttttggagactgcaggtatcaaagccagcgcattacgggaaatagtcgagacctgggacgaatcttcaggcagctttctgcccgttcctgaacgaaggcgtggaccaaaaggcgacagcggtgagcaggggccacctggtaaggaagggcccataggatttccgggcgaacgcggactgaagggtgatagaggagacccaggacctcagggccccccaggactggccttgggtgagagaggtccgcccggcccaagtggcctggcaggagaaccaggaaagccaggtatccctggcctgccaggccgcgctggtggcgtcggagaagccggtcgtccaggagagcgcggagaaagaggagaaaagggggagagaggggagcaggggcgggacggaccgccaggccttcccggaacgcctggcccacctggcccccctggacctaaagtctccgtcgacgagcctgggcccggcctctctggcgaacagggtccgcctgggctgaaaggagctaagggggagccaggaagcaacggggatcaaggccctaagggcgaccggggcgttcccgggatcaagggcgacaggggtgaacccggcccaaggggacaggatgggaatcccggcctgccaggggaacgcggtatggccggacctgaggggaaaccaggcctgcagggaccaaggggccccccaggccctgtaggtgggcatggggatcctggacctccaggggcccccggattggccggacccgcagggccccaggggccttctggattaaaaggtgagcctggcgagaccggaccacccggtcgaggactaactggccctacaggggcagtgggcctccccggcccccccggcccatctgggctggttggaccgcaaggatctcctggcctaccgggccaggtgggagagacgggaaaaccaggtgccccaggaagggacggggccagtgggaaggatggcgatcgcgggtctccgggagtaccaggctcacctggcctgccaggccctgtgggcccgaagggagaacctgggcccaccggggcccctggtcaggccgtcgtgggcctgccaggcgcaaagggggagaagggtgccccagggggactggccggcgacctggtcggagaacccggcgctaagggcgatcgaggtctccccggaccacgcggtgagaagggggaggctgggcgtgccggcgaaccaggagatcctggggaagacggacaaaagggtgcacccggccccaagggctttaaaggggaccctggggtgggtgtccctggcagtccgggtcctcctgggccccccggtgtgaaaggagatctcggactgccaggcctgcccggagcacccggagttgtgggtttcccaggccagaccgggccgcgaggggaaatgggccagccagggccatcaggggagagaggcttggccggtccgcctggacgggaagggattcccggcccactcggtccccctggccctcccggcagtgtgggacctcccggcgcgagtggccttaagggcgataagggggatccgggggtcggacttccgggaccccggggcgaacgtggcgagcccggaattaggggcgaggatgggcggccgggccaggaaggtccaagggggctcacaggcccgcctggatctcgcggggagagaggggaaaagggcgacgtcggcagcgccggtctgaaaggagacaagggggactctgctgttatcctcgggcctccaggaccaaggggggctaaaggcgacatgggtgagaggggcccgaggggtctggatggtgacaaaggtcctcggggcgataacggcgatcccggcgataagggctcaaaaggcgagcctggcgacaagggctcggccggcctgccaggactgcggggtctgttaggaccccagggccagcccggggctgctggaattcctggggatccgggaagccctggcaaggacggcgtccctgggattagaggcgaaaaaggcgacgtgggcttcatgggcccaagaggactgaaaggtgagaggggtgttaagggcgcttgtggcttggacggagagaagggagacaagggagaagccggcccacctggtagacccggactcgcaggtcataaaggcgagatgggtgagccaggagttcccgggcagagcggagcccctggcaaagaagggttaattgggccgaaaggagataggggctttgacggacagccaggacccaagggcgatcagggggagaaaggcgaaagaggcacacctggtattgggggcttccccggaccttctggcaatgatgggtctgctggcccgccgggcccccccggctcagttggccccagaggacccgaggggctgcagggccagaagggggaaagaggtcccccaggcgagcgggtagttggggcccccggggtgcctggggcacccggtgagaggggggaacagggtaggccaggtccagccggtccccgtggcgagaagggggaagccgccctgaccgaggacgatatcagaggatttgtgaggcaggaaatgtcccagcactgcgcgtgccagggtcaatttatcgcttccggttctcgcccacttccctcctacgccgcagacaccgcagggagccagttgcacgctgtcccagtattgcgggtgagtcacgcagaggaagaagaaagagttccacctgaggatgacgagtacagcgagtattccgaatactcagtggaagagtatcaggatcccgaggccccctgggattccgacgatccctgttccctaccgctggacgaaggaagctgcaccgcctataccttgcgttggtaccacagagcagtaacgggctcaacagaagcttgccacccatttgtgtacggtggctgcggtggaaacgcaaatagattcgggacccgcgaggcctgcgagcgacggtgccccccacgcgttgtccagtcccaaggaactggaactgcccaagattag

SEQ ID NO: 3683 - DNA, 435 bp, Artificial Sequence
  Description of Artificial Sequence: Synthetic coding sequence
atgtggctgcagagcctgctgctgctgggcaccgtggcctgcagcatttcagcgcccgcccgttcaccttccccctccacccaaccttgggaacatgttaatgccatacaggaggctagacggcttctcaatctgtccagggacactgcagccgaaatgaacgaaactgtggaggttatatcagaaatgttcgacctgcaagaaccgacctgtctacagacccgattggaactatacaagcaaggactgagagggtcgctcactaaattgaagggccctctgacaatgatggcaagtcattacaaacagcattgtcccccaaccccagagacgtcgtgtgctacccagatcatcacttttgagtctttcaaggagaatctgaaagatttcctgctcgtgattccctttgattgctgggaacccgtccaagagtag

SEQ ID NO: 3684 - DNA, 1218 bp, Artificial Sequence
  Description of Artificial Sequence: Synthetic coding sequence
atggaggccagcttcgtgcagaccaccatggccctgggcctgagctcgaaaaaagcatctagccgcaatgtggccgtggaacgtaaaaatctgattaccgtctgcaggttcagcgtcaagaccctcctggaaaaatatactgccgaaccgatcgacgattctagcgaggaattcgtaaacttcgccgccattcttgagcagattctgagccacaggttcaaagcatgtgcgccagctgggcccgtgtcctggttttcctccgacggccaacggggtttttgggattatatccgcctggcgtgcagtaaggtgccaaataactgcgtgtcttccatagaaaatatggagaatatctctacggcgcgcgccaagggcagggcatggatccgggtggcactgatggagaagcggatgtccgagtacattactactgctcttcgagacactcgaactactcgtcgtttctacgacagtggggctattatgctgagagacgaagccacaatcctgaccggcatgctgatcgggctctccgccattgatttttcattctgcctgaagggggaagtcctggatggcaagacaccagttgtcatcgattacacaccgtatcttaagttcactcagtcttacgattacctgacagatgaggaggagagacattcggccgagagctccacgtccgaggataacagtccagaacacccgtacctgcctcttgtgaccgatgaagactcgtggtatagcaaatggcacaagatggaacagaaattcagaatcgtctatgctcaaaagggctacctcgaagagctcgtacgcctgcgggagtcgcaactgaaagatctcgaggcagaaaaccgcagactgcagttgcaattggaggaggcggccgctcagaatcagagagaaaagagggaactcgaaggcgtgatcctcgagctgcaggagcagctgaccggattgatcccttcggaccatgccccactcgcccagggaagtaaggagcttacgacaccattggtgaaccagtggccaagcctggggacactgaatggtgcagaaggtgcttcaaattctaagctgtatcggaggcactctttcatgagcaccgaacctctttcagccgaagccagtcttagcagtgactctcaaagactgggcgaagggacccgtgacgaagagccatggggccctatcgggtcttctgagcctaattag

SEQ ID NO: 3685 - DNA, 603 bp, Artificial Sequence
  Description of Artificial Sequence: Synthetic coding sequence
atgagccccgagcccgccctgagccccgccctgcagctgctgctgtggcatagcgcgctttggactgttcaggaagccaccccgctgggtccagctagttcgctcccgcagtcatttttgttgaaatgcctggaacaggtgagaaaaatacagggcgacggcgctgctctccaggagaagctgtgcgccacctacaagctctgtcatccggaggaactcgtgctgttgggacacagtttgggaatcccctgggcacccctctcaagctgtccttcacaggccctgcagctagctgggtgcttgagccagctgcactcaggtctgtttctgtaccaaggcctactgcaggccttagaaggtatcagccccgaattgggacccacgctggacacactgcaactggatgtggctgacttcgccacaacgatctggcaacagatggaggagttgggtatggcccccgcattacagccaacccagggagctatgcctgccttcgccagcgccttccagcgccgtgccgggggcgtgctggtggcaagtcacctgcagagctttctggaggtgtcttatagggtgctccgtcacctggctcaaccatag

SEQ ID NO: 3686 - DNA, 516 bp, Artificial Sequence
  Description of Artificial Sequence: Synthetic coding sequence
atggccggccccgccacccagagccccatgaagctgatggccctgcagctgctgctgtggcatagtgccctgtggactgtgcaggaggccaccccactgggaccagcctcctctctgccgcaaagcttcctcttaaaatgcttggaacaggtccgcaagattcagggcgacggtgccgcactgcaggaaaaactggtctctgaagccggctgcctctcacagctgcacagcggactgtttctgtatcagggcctgcttcaggccctggaaggaatctctccagaactgggtccaacgttggacaccctgcaactggatgtggccgactttgccacgacaatctggcagcaaatggaagaactaggtatggccccagcacttcagcctacccaaggggccatgcccgcattcgcgtccgcattccaacgaagggccggaggcgtgcttgtcgccagccacttgcagtcttttttagaggttagctacagggtcctgagacatcttgcccagccttag

SEQ ID NO: 3687 - DNA, 615 bp, Artificial Sequence
  Description of Artificial Sequence: Synthetic coding sequence
atggccggccccgccacccagagccccatgaagctgatggccctgcagctcctgctgtggcattcagctctttggacagttcaggaagctactcctctcggaccagccagttccctgccgcagtcatttctacttaaatgcctcgagcaggtacgcaagattcagggtgacggcgccgccttacaggagaaattatgcgccacctataaactgtgccaccctgaggagctagtgctgctggggcactctctggggatcccctgggctccattgtccagctgcccatctcaggctctccagctggccgggtgtctgtcccaactgcactcgggtttgtttctgtaccagggactgctacaggctctggagggaatttctcctgaacttggtccaaccctggataccctgcagttggacgtcgcggactttgcaaccacaatctggcagcagatggaggagctgggaatggcacccgcattgcagccaacccagggcgctatgcccgcttttgcgtctgcattccagaggcgtgccggcggagtcttggtggcttctcacctgcagagcttcttggaggtgtcgtatagagtcctccgccatcttgcccagccatag

SEQ ID NO: 3688 - DNA, 3696 bp, Artificial Sequence
  Description of Artificial Sequence: Synthetic coding sequence
atgcggctgctggccaagatcatctgcctgatgctgtgggccatctgtgtcgcagaggattgcaacgaacttcctccaaggagaaacaccgagattctgactggatcttggtcggaccagacatacccagaaggcacccaggctatttacaaatgcagaccaggctacaggtcgcttgggaacgtcattatggtgtgcaggaagggcgaatgggtcgctctgaatccccttcgcaagtgtcagaagagaccctgtggccaccctggagacactccattcggaacattcacactgactggaggaaacgtgttcgagtacggggtcaaagccgtctacacatgtaatgagggatatcagctgctaggcgaaatcaactaccgagagtgcgacacagatggatggaccaatgatattccaatttgcgaagtggtgaaatgtctgcccgtcaccgcccccgagaacggcaagatcgtctcctctgccatggagcccgacagggaataccacttcggacaggcggtccgatttgtttgcaactctggttacaaaattgagggcgacgaggaaatgcactgtagcgacgatggcttctggagcaaggagaaaccaaagtgtgtggagattagctgcaagagtcctgatgttatcaacggtagccccatctcccagaaaatcatatacaaagaaaacgagcggtttcagtacaagtgcaacatggggtatgaatactctgagaggggtgatgccgtctgtactgagagcggctggcgtcctctcccctcttgtgaggagaagtcctgcgacaatccctacatcccaaacggcgactattcgccactcaggatcaaacaccgaacgggggatgagatcacttaccaatgcaggaacggattttaccccgcaacaagaggaaatactgccaaatgtaccagcacaggatggattccggcccccaggtgtacgttaaaaccttgcgattacccagatatcaaacatggcggtttgtaccatgagaatatgcgcaggccatacttccccgttgcagttggcaaatattactcttactattgtgacgaacacttcgaaacccctagcgggtcctactgggaccatatacactgtactcaggacggctggtcacctgcagttccatgcctaaggaaatgctatttcccttatctagagaatgggtataaccagaatcatggccggaaattcgtgcagggaaagtccatcgacgttgcctgtcaccccggatacgccctgccgaaagctcagactaccgtgacatgtatggaaaatggttggtccccaacccctagatgcattcgtgtgaaaacctgctcgaagtcctccatagacatagagaatgggttcatttccgaatctcagtacacatacgcccttaaggaaaaagctaagtaccaatgcaagctggggtacgtcactgctgacggtgaaacctccggctccatcacctgcggaaaggacggttggtctgcccaacccacgtgtataaagagttgcgatatacctgtgtttatgaatgcacgcacaaagaatgactttacttggtttaaactgaatgataccctggattacgaatgtcatgacggttacgaaagcaacactggctcgacaacagggagcatagtgtgcggatacaacggatggagcgacctgcctatatgttacgagcgcgagtgtgagctgcctaagattgacgtgcacttggtgcccgatcgaaaaaaggaccaatacaaggtgggggaggtgctgaagttctcgtgcaagcctggatttacgatagtgggtcctaacagcgtgcagtgttatcacttcgggctcagtcccgatctgcctatatgcaaggagcaagttcagtcctgtggacccccaccagagctgctgaatggcaatgtcaaggagaagaccaaggaggaatacggccacagtgaggtggttgaatactattgcaatcctcgattcctgatgaaagggccaaacaagattcaatgcgtggatggcgaatggacaaccctgcctgtgtgtattgttgaagagtctacgtgtggcgatatacctgagctggagcacggttgggcgcaattaagctcccctccatattattacggggactctgtcgaatttaactgttcagagagtttcactatgattgggcacaggtccattacatgcatccacggtgtttggactcaacttccacagtgtgtggctattgataaactgaaaaagtgtaagtctagtaatctcatcatcttagaggaacatcttaaaaacaagaaagaatttgatcacaattccaacattcgctatcgctgccgaggcaaagaaggctggattcacacagtatgcatcaatgggagatgggatccagaggtgaactgtagcatggcccagattcagctttgcccacccccaccgcaaatcccaaacagtcacaatatgacgacgaccctcaactacagggacggcgaaaaagtgtctgttctgtgccaggagaactacttgatccaggagggggaggagatcacctgtaaagatgggcggtggcagtccattccactgtgtgtggagaaaattccgtgttcgcagcccccccagatcgagcatggtactattaattcatcgcgttcatctcaggaatcatacgcccatgggactaagctgtcatacacatgtgaaggcggattccggatctcagaggaaaacgagactacatgttacatgggcaagtggtcctcaccaccgcagtgcgagggactgccctgcaagtctccgccggaaattagccacggcgtggtggcccatatgtccgattcataccagtatggggaggaagtaacatacaagtgctttgaaggattcgggattgatggacccgccattgccaagtgcctgggcgagaagtggtcacacccaccctcttgtattaagactgactgcttaagtcttcctagcttcgaaaacgctattcccatgggcgagaaaaaagatgtatacaaagctggagaacaggtgacttatacgtgtgctacatattataagatggatggggcttcaaatgtgacctgcatcaactcgcggtggactggtcgacctacatgccgggacacttcatgcgtcaaccctcctacagtccagaacgcctacatcgttagcagacaaatgtcaaagtaccctagcggcgaaagagtgaggtatcagtgtaggtctccttacgagatgtttggagatgaggaagttatgtgtttgaatgggaattggacagagccaccgcaatgtaaagatagtactggcaagtgcggaccaccccctcccatcgacaatggagatatcacaagcttccccctttctgtctacgcaccggcttcttcagtggaatatcagtgccaaaatctataccaactggaaggcaacaaaagaattacctgcagaaatggccagtggagcgagccccctaaatgcctgcacccatgcgtgatcagcagggagataatggagaattacaatatcgccctgagatggacagctaagcagaagctctactccagaacaggcgaatccgtcgagttcgtgtgtaaacgcgggtatcgcctttcgagtagatcacacacattacgcaccacttgctgggacgggaagcttgaatatccaacctgcgccaagcgatag

SEQ ID NO: 3689 - DNA, 1350 bp, Artificial Sequence
  Description of Artificial Sequence: Synthetic coding sequence
atgcggctgctggccaagatcatctgcctgatgctgtgggccatctgcgtcgccgaagactgcaatgaactgcctccacggagaaacactgagatcttaactggctcctggagtgaccagacataccctgaaggcacccaggccatatacaaatgccggcccggataccgtagtctgggtaatgtcataatggtttgccgcaaaggtgagtgggttgcacttaacccccttagaaaatgtcagaaaagaccatgcggtcatcctggggatacaccgtttgggactttcacccttacaggaggtaatgtgttcgagtatggggtcaaggctgtgtatacatgtaatgagggctatcagcttctcggagagattaattaccgggaatgtgataccgacggctggaccaatgacattccaatttgtgaggtggtcaaatgtctgcctgtcaccgcaccggaaaacggaaagattgtgagttctgccatggaaccagacagggaataccatttcggtcaggcagtacgctttgtttgcaactcaggttacaagatcgagggagacgaggaaatgcactgttcagacgatggcttttggagcaaggagaaaccaaaatgcgtcgaaatcagttgtaagagccccgatgtcatcaacggctctcccatttctcagaaaatcatttacaaggagaatgaacggtttcagtacaaatgcaatatgggctatgaatatagtgaaagaggagatgccgtgtgtaccgagtcaggctggcggcctctgcccagttgcgaggagaagagttgcgacaatccttacatccccaacggtgactactctccacttaggataaagcataggactggcgatgagatcacgtatcaatgtagaaatggattttatcctgcgactcgcggaaatactgctaaatgcacttctaccgggtggatacccgccccacggtgcactctgaagccttgtgattacccagatatcaagcacggcggcctgtaccacgagaacatgcgacggccgtattttcctgtcgctgtcggcaagtattactcgtattactgcgatgagcacttcgagaccccatccgggtcctactgggatcacatacactgtactcaggatggctggtctcccgccgttccctgtctgcgaaagtgttacttcccatacttagaaaacggatacaaccaaaaccacggccggaaatttgtacagggtaaatccattgatgttgcctgtcacccaggatacgccctgcctaaggcacaaaccacagtgacgtgcatggaaaatggctggtcacctacccccagatgcattagagtcatcttccagttgtag

SEQ ID NO: 3690 - DNA, 1350 bp, Artificial Sequence
  Description of Artificial Sequence: Synthetic coding sequence
atgcggctgctggccaagatcatctgcctgatgctgtgggccatctgcgtagcagaggactgcaatgagcttcccccgcggcgtaacacagagatactaactggatcatggagcgatcagacatacccggaaggcacccaggcgatctataagtgccgccccgggtaccggtctctgggaaatgtgatcatggtgtgccggaagggggagtgggtcgctctcaaccctctgcgaaagtgccaaaaaagaccgtgcggacatccaggcgatactccatttgggacctttactctgacggggggtaatgtgtttgaatatggggtgaaggcagtgtacacctgcaacgagggttatcagctgctgggtgaaatcaattatcgtgagtgtgacaccgatggctggacaaatgatatccccatctgtgaggtggtgaagtgtttacctgttaccgcccccgagaacgggaagatcgtcagctccgctatggagccagatagggagtaccattttggtcaggcagtcaggttcgtttgcaacagcgggtacaagatcgagggcgatgaagaaatgcactgcagtgacgacggcttttggagcaaagagaagccaaaatgtgttgagatctcttgcaagagtcccgatgttatcaatggcagcccaatcagccaaaaaatcatctacaaagagaacgagcggttccaatacaagtgtaacatggggtatgagtacagtgaacgcggtgacgccgtgtgcactgaatccggctggaggcccctgccaagctgcgaggagaagagttgtgacaacccttatattccaaatggggactactcacccctgcggatcaagcataggacaggtgacgaaatcacttaccagtgccggaacggcttttaccctgccacacggggaaacactgccaaatgcacgagcacaggttggatacccgcccccaggtgcaccttaaagccatgtgattatcctgatataaagcatggcgggctctaccacgagaatatgcgccggccatattttccagtagccgtgggcaagtattattcatattactgcgacgaacatttcgagaccccaagcggttcgtattgggaccatatccactgtacacaggatggctggtccccggctgtcccatgtcttaggaaatgttacttcccatatctggaaaacggctacaaccaaaatcacggcagaaagttcgtgcaaggaaagtctatcgacgtggcctgtcatcccggatacgctttacccaaagcacaaaccactgtcacctgcatggaaaacgggtggtcacccaccccacgttgcatcagggtgtcttttaccctgtag

SEQ ID NO: 3691 - DNA, 573 bp, Artificial Sequence
  Description of Artificial Sequence: Synthetic coding sequence
atggccgccggcgagctggagggcggcaagcccctgagcggcctgctgaatgccctggcccaggacacatttcatggttatccgggaattaccgaggagcttttacgtagccaactgtatccggaggtgcctcccgaggaatttaggccgttcctggctaagatgcgagggattcttaaatctatcgctagtgcagacatggattttaatcagctggaagctttcctgaccgcccagactaagaaacaaggcggcatcacaagcgaccaggccgccgtgatcagcaaattttggaagagccataagaccaagattcgcgagtctctgatgaatcagtctcggtggaatagtgggctgcgcggactgagttggagagtggacggcaagtctcagtcccgacatagcgcccagattcacactccagttgctatcatcgagctggagcttgggaagtacgggcaggagagcgagttcctctgcctggagtttgatgaagtgaaagtcaatcagattctgaagactctgagtgaggtggaggagtcaatcagcaccttaatctcacagccaaactag

SEQ ID NO: 3692 - DNA, 117 bp, Artificial Sequence
  Description of Artificial Sequence: Synthetic coding sequence
tgacaggagagcgagttcctgtgcctggagttcgacgaggtgaaggtcaaccaaatcctgaaaactctaagcgaggtggaggagagcatttcaactttgatttcacagcctaattag

SEQ ID NO: 3693 - DNA, 99 bp, Artificial Sequence
  Description of Artificial Sequence: Synthetic coding sequence
tgatgcctggagttcgacgaggtgaaggtgaaccagatcctgaagacactaagcgaggtcgaagaaagcatttcaaccctgatctctcagcccaactag

SEQ ID NO: 3694 - DNA, 117 bp, Artificial Sequence
  Description of Artificial Sequence: Synthetic coding sequence
tgacaggagagcgagttcctgtgcctggagttcgacgaggtgaaggtcaatcagattttgaagaccctctctgaagtggaggaatccatctcgacacttatctctcagcctaactag

SEQ ID NO: 3695 - DNA, 480 bp, Artificial Sequence
  Description of Artificial Sequence: Synthetic coding sequence
atggccgccggcgagctggagggcggcaagcccctgagcggcctgttgaacgccctggcccaggacacattccatggttatccgggcattaccgaagagctgctgagatcccagctatatccagaagtgcctccggaagagtttaggccttttctggccaagatgcgtgggatcctgaaatctattgctagtgccgacatggacttcaaccagttagaggcttttttgactgcgcagacaaaaaagcagggtggaatcacttctgaccaggcagcagtgatttccaagttctggaagtcacataaaacaaagatccgggagtcgcttatgaaccagagtaggtggaattctggactgcgtggtctcagctggcgtgtcgacgggaaaagccagtcccgccacagcgcccagattcacactccagtggcaatcattgagctggaactaggcaaatacggccaagtgcactgcaatcagtag

SEQ ID NO: 3696 - DNA, 591 bp, Artificial Sequence
  Description of Artificial Sequence: Synthetic coding sequence
atgcggctgcccctgctggtgagcgccggcgtgctgctggtggccctgcttccctgccccccttgccgcgccctcctgtcaaggggtcccgtgcctggtgctcggcaagccccccagcatcctcagcccctggacttttttcagcctccaccccagtcagagcagccacagcagcctcaggcccgtccagttctcctccgtatgggcgaagagtatttcttacggctcggcaacctgaataaaagcccagccgctcccctgtcacccgccagttctctccttgcagggggaagcgggtcaagacctagccctgagcaggctacagcaaattttttcagggtgcttctgcagcaattacttttgccacgcagatctctggattcccccgccgcacttgcagagcgcggtgcaaggaatgccctcggaggccaccaagaggcccctgaacgcgaacgccgttctgaggagccacccatatcactagatctcaccttccaccttctgcgcgaggtcctcgagatggcccgggcagagcagctcgcacagcaggcgcattccaatcgaaagctcatggagatcatcggcaaatag

SEQ ID NO: 3697 - DNA, 4443 bp, Artificial Sequence
  Description of Artificial Sequence: Synthetic coding sequence
atgcagcggagccccctggagaaggccagcgtggtgagcaagctgttctttagctggacacgtcccattctccgcaaaggctacagacaaaggctggagctcagtgatatctaccaaatcccctctgtcgactccgctgacaacctgtcagaaaaactcgagagagaatgggaccgcgaactcgcctccaagaagaacccaaagttgataaacgcccttcgacggtgtttcttctggaggttcatgttctatgggattttcttgtatctgggagaggtaacaaaggccgtccagcctctgctcctgggtcgcatcatcgcgagctacgatcctgataataaagaggagagaagcattgccatatatcttggaatcggcctttgcctcctgtttatcgtaagaacactattactccaccccgccattttcgggttacatcatattggtatgcaaatgcggatcgccatgttctcgctcatatacaaaaagactcttaagctgtcctcccgggtgctggataagatatccataggacaactggtgagcctgctatctaacaatctgaataaatttgacgaaggtctggcgctggcccatttcgtgtggattgcacccctccaagtggccctgttgatggggttgatctgggagttgcttcaggcctctgccttttgtgggctggggttcttaatcgttctggccctgttccaagcggggttgggtcgtatgatgatgaagtaccgggaccagcgggccgggaagatctcagaaaggctggtgattactagcgagatgattgagaatattcaaagtgtcaaagcatattgctgggaagaagccatggaaaaaatgattgagaatctgcgccagaccgaactgaaactcacaaggaaggcagcttatgtccgctatttcaattcaagcgccttcttcttcagcggattcttcgtggtgttcttgtcagtcctgccatacgccctcataaagggaatcattctgcgcaaaatcttcacaaccatatcgttttgcatagtgttacgaatggcggtgacacgtcaattcccttgggcagtgcagacttggtacgattctctgggcgccattaataaaatacaggacttcctacaaaagcaggaatacaagaccttggaatacaatctcactactaccgaggtcgtaatggaaaacgtgaccgctttttgggaagaagggtttggcgagctgttcgagaaggccaagcagaacaacaacaaccggaagaccagtaacggggacgattcattattcttttcaaacttctccctgctgggaaccccagtgctgaaggatatcaattttaaaattgagagggggcaattgctcgcggtcgcgggttcaacaggggctggcaaaacctcattactgatggttataatgggcgaactcgaacctagtgaaggtaaaattaagcactccggcagaattagcttttgtagtcagttcagctggatcatgcctggaacaattaaggaaaacattatcttcggagtcagctatgacgaatatcggtacagaagcgtcattaaggcctgccagctggaagaggacatctccaaatttgctgaaaaagataacatcgtgctcggcgaaggggggattacactttctggcggccagagagcacgtatttcactagcccgggctgtgtataaggatgcagacttgtacctgctggactcccctttcggctatctcgacgtgcttactgagaaggagatctttgaatcgtgtgtgtgtaaactgatggctaacaaaacaaggattctggtgacgagcaaaatggagcacctgaagaaagcagacaagattctcatcttacatgaaggaagcagctacttttacggaaccttctcagagctgcagaacctgcagcccgactttagcagcaaactaatgggctgtgatagtttcgatcagttctcagccgagcgccgaaattcaatcctgactgagactctccaccgtttctcgcttgaaggggacgctcctgtcagttggactgagacgaaaaagcagagctttaaacaaactggtgaattcggggaaaaaaggaaaaattctattcttaatcccatcaactctattaggaaattttcaattgttcagaagacgccactgcaaatgaatggaatcgaagaagattccgatgagccactggagcgccgtctgtcgctcgtgccagattcagaacaaggggaggctatcttgcctaggatcagcgtgatctccactgggcccactctgcaggcaaggaggcgccaatccgtcctcaatctgatgacacatagcgtgaaccaaggacagaatatccatcgcaagactaccgcgagcacaaggaaggtgagccttgccccacaggcgaatctgactgagctggacatttatagcaggagattgtcccaggaaactggattggaaatttcagaggagatcaacgaagaggacctgaaggagtgtttctttgacgatatggagagtattccggccgtaacaacatggaatacataccttagatacatcacagtacacaagtctctaatttttgtattaatttggtgcttggtgatcttccttgcggaggtagcagcctcactcgtcgtgctttggcttttaggcaatacaccactccaagataagggaaattccacccactcaaggaacaacagctatgccgtgattattacaagcacgtccagctattatgtgttctacatatatgtgggtgtggccgatacgcttctggcaatggggttctttagaggcttgcccttggtgcacaccttaatcacagtttccaaaatcctgcaccataaaatgctgcatagcgtgctccaggcaccaatgagtaccctcaacacactgaaggccggcggaatccttaatcggttcagcaaagacatagctatcctggatgatctgctgccactcaccattttcgactttattcaactgcttctaatcgtcatcggcgctattgctgtggtggccgttctgcaaccgtatatttttgttgccactgttccagtgattgttgcctttatcatgcttagagcttactttctgcaaactagtcagcagctgaagcagctcgagtccgaagggcggagtcccatatttacgcacctggtgacctccttgaaggggctgtggactttgcgcgctttcggacgccagccctacttcgagaccctgttccataaggcattaaacctgcatacagccaattggttcctctatttgagcaccctgaggtggtttcagatgaggatagaaatgatctttgtgatttttttcatcgccgtgaccttcatttcgattttaacaactggtgagggcgagggacgtgttgggatcatccttacccttgccatgaatataatgtccacgctgcagtgggccgtcaatagttcgattgatgttgacagtctcatgagatccgtgtcgagagtgtttaaatttatcgatatgccaacagagggaaagccaaccaagtctactaagccctataaaaatggccagctgagtaaggtgatgatcatcgagaactcccacgtgaagaaggatgacatctggccaagcggcggccagatgacagtcaaagacctgaccgctaaatacaccgagggtggcaacgcgatcctggagaacatttcattcagtatttcccctggccaacgtgtcgggttactgggccgaacaggaagtggaaagtcgaccctcctcagtgcctttctcagattactgaataccgagggcgaaatccagatcgatggtgtctcctgggactctattacattacagcagtggaggaaagcctttggcgtgatccctcaaaaagtttttatcttttccggaacattccggaagaacttagatccgtatgaacagtggtccgatcaagagatttggaaagtggccgatgaagtgggtctacgttcagtaatagaacagttccccgggaagttggattttgtgcttgtggacggtggatgcgtgctctcccatgggcacaagcagttgatgtgcttggctcgctccgtcctgtcgaaagccaaaatcttgctgctggacgaaccctcagcccacttggaccccgtgacatatcagataataaggcggaccctcaaacaagcttttgctgattgcacggtgattctatgtgaacatcgaatcgaggccatgctggaatgccagcagttcctggtcattgaggagaataaggttcgccagtacgatagcattcagaaactattgaacgagcgcagcctgtttaggcaggctataagtccttctgatcgggttaagctattccctcacagaaacagctcaaaatgcaagtccaagccacagatcgctgctctgaaggaagagactgaggaggaggtgcaggacaccaggttatag

SEQ ID NO: 3698 - DNA, 4317 bp, Artificial Sequence
  Description of Artificial Sequence: Synthetic coding sequence
atgcagcggagccccctggagaaggccagcgtggtgagcaagctgttcttttcttggaccagacccatactgcgcaagggctaccgacagagactggaactgtcagacatttaccagattcctagtgtagatagcgcggacaacttatctgagaagttagagagagagtgggacagagagctggcctctaaaaagaaccccaagctgattaatgccctaaggcgctgttttttctggagattcatgttctacggcatttttctgtacctcggggaagtaactaaggctgtgcaacccctattgctaggccggatcatcgcatcctatgacccagataacaaagaggaacgttccattgcgatctacctgggaatcgggctatgcctgcttttcattgttcggactctcttactccatcccgcgattttcggtctacatcatatcggcatgcagatgagaatcgcgatgttctccctgatctacaaaaaaggcctcgctctcgcccacttcgtgtggatcgcacctctgcaggtagccctgctgatgggtctgatctgggagctgcttcaggccagcgcattctgcggccttggcttcctcattgtgttagccctttttcaagctgggcttggacggatgatgatgaagtatcgcgaccagcgcgctggaaagattagtgagagacttgtgataacatcagagatgattgagaacattcagagtgtgaaggcctattgctgggaggaagcgatggagaaaatgatcgagaatctacgccaaaccgagctgaagctcacacgcaaagctgcatacgtgcgctactttaatagctcagcttttttctttagtggattcttcgtggtgttcctttcagtgctcccttatgccctgatcaaaggaataatcctccgaaagatctttacaaccatctcgttttgcatcgtcttgaggatggccgtcacgcgtcagtttccatgggctgtccaaacctggtacgacagcctcggagctataaataagatccaggacttccttcagaaacaggagtacaagacgctggaatacaatctgacgactactgaggtcgtaatggagaatgtgactgcattttgggaagaaggcttcggtgagttgtttgaaaaggctaagcaaaataataataaccgcaagaccagtaacggcgacgactccctattcttttccaacttttccctgctcggtacccccgttctcaaggacataaacttcaagatcgagcggggacaactactcgcagtggcagggagtacaggcgcggggaaaacgtccctcctcatggtgattatgggcgaacttgagccctctgaaggtaagattaagcattctggccgaataagtttctgctcacagttcagctggataatgcctggcacaataaaagagaatatcatcttcggagtatcttacgacgagtatcgatataggagcgttataaaagcatgtcagctggaagaggatatctcaaaattcgcagaaaaggacaatatcgtcctgggagagggcggtatcacactgtccggcggacagagagcacggatatccctagcccgcgctgtttataaggacgcagatctgtatctgttggacagccctttcgggtacctggacgtgctcacagagaaagagatcttcgagtcatgcgtctgtaaattaatggctaacaagacacgaatccttgtcacatcaaaaatggagcacctgaaaaaggctgataagatcctcattctgcatgaggggtcctcgtacttttacggtactttcagtgagctccagaacttacaacccgacttctcatcaaaactcatggggtgtgactccttcgaccagttttccgccgagagaagaaactccatccttaccgagaccctgcaccgtttcagcttggaaggtgatgctccagtttcatggactgagaccaagaaacagagcttcaagcagacaggggagttcggtgaaaagcgcaaaaattctattttaaatccgattaacagcatcagaaagttttctatcgtccagaagactcctctccagatgaacggcattgaagaggattcagatgagcccctggaaaggcggttgagcctggtaccggatagtgaacaaggcgaggccattcttcctcgcatcagtgtgatctctaccggccccactctccaagccagaagacggcagtccgtgctgaatctgatgacacactcagtcaatcaggggcaaaatattcatcgaaaaacaaccgcaagcacgcgtaaagtatccttggccccccaggctaacctgactgagctggatatctacagtcgaaggctttctcaggaaacgggactggaaatatctgaggagataaacgaagaggaccttaaggaatgctttttcgatgacatggagtccattcccgcagttacaacgtggaatacatacctgcgctatataacggtgcacaagagtctgatcttcgtgctgatctggtgtctggtcatctttctcgccgaggttgcagcaagtcttgtggttttatggctgctcggcaataccccactacaagataaagggaattcaacgcacagcaggaataacagttatgcagtaatcattactagcacaagctcatactacgtgttttatatctatgtcggcgtggcggacacccttctagccatgggtttcttcaggggactgccactggtgcatacactgatcaccgtgagtaaaatactccatcataaaatgttgcacagcgtgctgcaggcacctatgagcactctcaatactcttaaagctggcggtatcctgaatcgcttctccaaagatattgccattctggacgacctgctgccactgactatctttgactttattcaactgcttctcattgtgattggagccatagcagttgtggccgttcttcagccgtatatattcgtggccaccgtcccagtaatcgtggccttcataatgctgcgtgcttacttcttgcagactagccagcagctgaagcagctggagtctgagggacgctctccaatctttacgcacctcgtgaccagtctcaagggactgtggacactgcgggcattcggtaggcaaccatattttgagaccctcttccacaaggcactaaacctacacaccgcaaactggtttttgtatctgtctactctcaggtggtttcagatgcggatcgagatgatcttcgttattttcttcatcgcggtcaccttcatcagcatcctgacaactggcgaaggagagggacgggtcggaattatcctgacactagccatgaacattatgtccacacttcaatgggccgtaaactctagcattgatgtggattccctgatgaggtcagttagcagggtgttcaagttcatagatatgcccactgaggggaaaccgacaaagagcacgaagccctacaagaatggccagttgtccaaggtcatgattatcgaaaatagtcacgtgaaaaaggatgatatatggccttcaggaggccagatgacagtgaaggacctcaccgccaagtacactgaggggggtaatgccatacttgaaaatatttcattttccatctctcctggacagagggtcggtctcctggggcgtacgggttcaggcaagagcaccttactgagcgcctttctccgactgctgaatactgagggcgaaatccaaattgacggcgtctcatgggactcaatcacactgcaacagtggcgtaaggcatttggcgtgatcccccagaaggtctttatatttagcgggacctttcgtaagaacctggacccctatgagcagtggtctgatcaggaaatctggaaagtggctgatgaggtggggcttcggtcagtgattgagcaattccctggcaaacttgactttgtgctggtggacggtggatgcgtactaagccacgggcacaagcagctgatgtgcctggcacgttccgtgctgtccaaggccaaaatactactgctggacgagccgagcgcccacctggaccccgttacataccagattatccggagaactctgaaacaggctttcgccgattgcactgtcattctctgcgagcacaggatcgaagccatgctggagtgccagcagttcctagttatagaagagaataaagtaagacagtacgactcaatacagaaactcctcaacgagcgctccctcttccgtcaggccattagcccatctgaccgagtcaaactgttcccgcatcgtaacagtagcaaatgcaagagtaaaccccagatcgccgccctcaaatag

SEQ ID NO: 3699 - DNA, 4260 bp, Artificial Sequence
  Description of Artificial Sequence: Synthetic coding sequence
atgcagcggagccccctggagaaggccagcgtggtgagcaagctgttcttcagctggacgaggccaatactacggaaaggctaccgtcagcggctcgagctgtcggatatttaccaaatcccaagcgtggactctgctgataatttatcagaaaaactggagcgggagtgggacagagaactggcgtcaaagaaaaatccaaagctgattaacgcactcaggcgctgtttcttttggaggtttatgttttatggcatttttctctaccttggggaggtgacaaaagcagtgcagcctctcctgctgggccgtataatcgcgtcctatgacccagacaacaaggaggagcgctccatcgccatatacctgggtatcgggctctgcttactgtttatagtgcgcaccctgttgttacaccccgccatcttcggacttcaccacattggaatgcagatgcgcatcgccatgttttctttgatctacaaaaaaaccttaaagctttccagccgagtgctcgacaaaatatcgatcggtcaactggtttctctgctctccaacaaccttaataagtttgacgagggactggccttagcccactttgtttggatcgcacctctgcaagtggccctgctaatggggcttatttgggaactgctgcaggcctccgccttctgtggcctcgggtttctcatcgtgttagcactgttccaggccgggctcggaagaatgatgatgaagtacagggaccagcgggctggtaaaatttctgaaaggctcgttattacgagcgagatgatcgagaacatacagtccgtgaaggcgtactgctgggaggaagccatggagaagatgatcgaaaacctgcgccagaccgagctcaaactgacccgtaaggctgcgtacgtgaggtacttcaactccagtgcatttttcttttcaggctttttcgtcgtgtttctgagcgttcttccctacgcactgatcaagggaatcattctgcgaaaaattttcactaccatctcgttctgcattgtcctcaggatggctgtgacaaggcagttcccttgggctgtccaaacctggtatgatagtcttggggccattaacaagattcaggactttcttcagaagcaggaatacaaaacactggaatataatttgactactacagaggtggttatggagaatgttaccgcattctgggaagaaacttcactgctcatggttatcatgggagagctagaaccttccgaaggcaagataaaacattctggcagaattagcttttgctcgcagttttcttggatcatgcctggtactataaaggaaaatatcatcttcggagtgtcatacgacgagtaccgatacaggagtgttattaaggcatgccagctggaggaagatatctctaagttcgccgaaaaagacaatattgtgctgggcgagggggggatcaccctgtccggcggtcagagggctagaatctcgctcgccagggccgtgtacaaggatgctgacttatatttgttggacagcccattcgggtatctggacgtactcaccgaaaaggagatcttcgagagctgtgtctgcaaactgatggccaataagaccagaatactagtgactagtaagatggagcacctaaaaaaagcagataagatacttattctccacgagggttctagttacttttacggcacattctccgagctccaaaacctgcagccagacttctcttctaagctaatgggatgcgatagtttcgaccagtttagcgcagaaaggaggaattctattctgaccgaaaccctccaccgatttagtctggaaggtgatgcaccagtaagctggacagagacaaaaaagcaatctttcaagcaaacaggcgagttcggcgaaaaacgcaaaaatagtatcctgaatccaataaacagcattagaaagttcagtatcgtacaaaagacaccgttacagatgaatggaatagaagaggactcagacgagcccctcgagcggagactttcactggttcctgactccgaacagggagaagctatattgccacgcatctctgtgatctctactggacccaccctgcaggcccgccgacgacagagtgttctgaacctaatgacacattcagtgaaccaggggcaaaacatccaccgtaaaaccaccgcttctacccgcaaagtctcactagctcctcaggctaatcttacagaactcgatatctacagcagacgcttaagccaggaaacaggtctggagatctccgaagaaatcaacgaggaagatctgaaagaatgcttctttgacgatatggagtcgataccggccgtgactacatggaatacttatctacggtatatcacagttcacaaatccctgatcttcgtgctgatatggtgccttgttatttttctcgctgaagtagccgcgtccctcgtcgttctttggttgcttggaaacaccccactacaggacaaaggtaactccacccactcccgcaacaatagctacgctgtgattattacatccacctcaagctattacgtgttttatatctatgtgggagtggcagatacgttgctcgccatgggcttttttcgcggcctgcccctcgtgcacaccctcataactgtcagcaagatcctgcaccataagatgctccacagcgtactgcaggctccaatgagtactttaaataccctgaaagccggcggcattttaaacagatttagcaaagacattgccatccttgatgatttgcttcccttgactatattcgactttatacagctcttgctgatcgtcattggagccattgcagtggtagcagtgctccagccctatattttcgtggccacagtacctgtgatcgtggcattcataatgctacgcgcatatttccttcaaacctcccagcagctaaagcagctggagtcagagggtaggtcaccaatttttacacacctcgtgacttctctgaagggtctgtggaccctgcgcgcctttggtcgccaaccttatttcgagaccctgttccacaaggccctgaacctgcacaccgctaactggtttctatatctgagcaccctgcgctggtttcagatgagaatagaaatgatctttgttatcttctttatcgccgtaactttcataagcattctcactactggcgagggggagggacgcgttggaattatcctcaccttggcgatgaacataatgtccaccttgcagtgggccgtgaactctagtatagacgtggattccctgatgaggtcagtttcccgcgtattcaaattcatcgacatgccaacagaaggtaagcctacaaaaagtaccaagccctacaagaacggccagctgtctaaagtaatgattatagaaaacagccatgtgaagaaggacgatatctggccgtctggtgggcagatgactgttaaagatctgacggcgaaatacactgagggcgggaacgcaatcttggagaatatcagtttcagcattagccctggccaacgggtcggcctgttaggacgtactggctctggaaagtcaaccctccttagcgcattcctgcgactgctcaatactgaaggcgagatccagatcgatggagtgtcttgggatagtatcaccttacagcagtggagaaaagcctttggagtcatcccccagaaggttttcatctttagtggaacgttcaggaaaaacctggatccctatgagcaatggagtgatcaagagatttggaaggtggccgatgaagtgggcctgaggtccgtcatcgaacagtttcctggcaagctcgacttcgtacttgtcgacggaggatgcgtgctgtcacacggacacaaacagctgatgtgccttgcacggagtgttttgagtaaggccaagatactgttgctggatgaaccttccgcccatctggatcccgtcacttaccagattatccgaaggactctgaaacaggctttcgccgattgcacagtgattctttgtgagcacaggattgaggctatgctggagtgccagcaattcctagtgatagaagaaaataaagtccggcagtacgacagtattcagaaactgttgaacgagagatcactgtttagacaggctatttcccccagcgatcgagtcaaattattcccacaccgtaactcttccaagtgtaagtcaaaaccccagattgctgcgctcaaagaggagactgaggaggaagtccaggacactcgactgtag

SEQ ID NO: 3700 - DNA, 573 bp, Artificial Sequence
  Description of Artificial Sequence: Synthetic coding sequence
tgaaagggcctgtggaccctgcgggccttcggccggcagccctactttgagaccttgttccacaaagccttaaatttacatactgcaaactggttcctgtacctgagcacactgcgttggttccaaatgcgaatagagatgatttttgttatcttctttatcgctgtgactttcatctccatcctgacaaccggtgagggagagggcagggtaggaatcattctgacactcgctatgaatattatgagcactctgcagtgggcagtgaattctagtatcgatgttgatagcctgatgcgttcggtgtcaagagtcttcaagttcatcgatatgcctactgagggaaaacctaccaagagcacaaagccttacaagaacggacagctttccaaggtgatgatcatagagaactctcatgtgaagaaagatgacatctggccatcgggagggcagatgaccgtgaaggacctgaccgcaaaatatacagaaggcggtaacgcaattttggagaatattagcttcagtatatcgcctggtcagcgcgttagattcgagcactgcctactgtgttag

SEQ ID NO: 3701 - DNA, 1203 bp, Artificial Sequence
  Description of Artificial Sequence: Synthetic coding sequence
atgatccggaactggctgaccatcttcatcctgttccccctgaagcttgtggaaaaatgtgaatcatctgtatccctcacagttccgcctgtcgtcaagctcgaaaatggctccagtactaacgttagtctgacactgcggcccccgctcaacgctacccttgtgatcaccttcgaaatcactttcaggagtaaaaacattactattcttgaactcccggacgaagtcgtggttccccctggagttaccaactcttccttccaggtcacaagtcaaaacgtggggcagctgaccgtgtacctccatggcaatcatagtaatcagacagggcctaggatccgatttttagttattaggtcaagtgccatttccattattaatcaggtgatcggttggatatactttgtcgcctggtctatctccttctatccccaggtaataatgaactggagacggaagagcgtgattggcctgtcttttgacttcgttgctttgaatttgaccggctttgtagcatacagtgtttttaatatcggcctgctgtgggtgccctacatcaaagagcagttcctgctcaagtaccccaacggagtgaatcctgtgaattccaatgatgtcttcttcagcctgcatgcggtggttttgactcttatcatcatcgtgcagtgttgtctgtatgagcggggcggacaacgagtttcctggccagctattggtttcctagtgctggcctggctcttcgcattcgttactatgattgttgcagccgtcggcgtgaccacgtggctgcagttcctgttctgcttctcctacattaaactcgccgtaacgttagtgaaatatttcccacaggcatatatgaatttttattacaagagcacagagggctggtcaatcgggaacgtgctgcttgactttacaggcggcagcttcagtctactgcagatgttcctccagtcctataacaacgaccagtggacactcatattcggagatcctactaagttcggactcggcgtctttagcatcgtttttgacgtggtatttttcatccagcatttttgtctctatcgtaagcgcccaggcctgcaagcagcgcgaaccggttcgggtagccgactcaggcaggactgggccccctcccttcagcccaaggctctgccccagaccacatcggtgtctgcctcttccctcaaggggtag

SEQ ID NO: 3702 - DNA, 1104 bp, Artificial Sequence
  Description of Artificial Sequence: Synthetic coding sequence
atgatccggaactggctgaccatcttcatcctgttccccctgaagctggtagaaaaatgcgagagctcagtctccctgacagtcccgcccgttgtgaagttggaaaacgggagcagcactaatgtcagccttaccttaaggccccccctgaacgccacactggtcatcacattcgagattacattccgaagcaaaaacataactatccttgaattgccagacgaagtcgtggtgcctccaggggtcacgaattcttcatttcaggttacctctcagaatgttgggcagctgactgtttatttacacggaaatcactctaaccagacagggccacggatcaggttcctggtaatcagaagctctgcaatatccatcattaaccaggtgatcggatggatttattttgtcgcctggtctatctcattttatcctcaggtaattatgaactggaggcgtaagagtgtgatcggactgtcattcgattttgtggcgttaaacctcacgggattcgtcgcatacagcgtgtttaatataggtctgctgtgggttccatatattaaggagcagtttctgctcaagtatcccaatggagtcaaccccgtgaacagcaatgacgtttttttcagtctgcacgcagtggttctcaccctgataatcattgtacagtgctgtctgtacgagcgtgggggacagagagtttcctggcccgccatagggtttctcgtgctggcctggttgttcgccttcgtgaccatgatcgtggctgctgttggagtgacgacgtggctgcaatttttgttctgcttttcctacattaaactggccgtaacgttggtaaaatacttccctcaagcatacatgaacttttactataagtccaccgaaggctggtctataggtaacgttttattagactttacaggaggatcattcagcctccttcagatgtttctgcagtcatacaataacgaccagtggaccctgatttttggagatcctaccaaattcggactgggggtgttcagtatcgtctttgacgtggtgttttttatccaacacttctgcctgtacagaaagagacctggttacgatcagctgaactag

SEQ ID NO: 3703 - DNA, 663 bp, Artificial Sequence
  Description of Artificial Sequence: Synthetic coding sequence
atgaactggcggcggaagagcgtgatcggcctgagcttcgacttcgttgccttgaaccttacgggcttcgtcgcctactctgtgtttaatattggcctactctgggtgccctatattaaggagcagttcctgctgaaataccctaatggcgtgaacccagtcaactccaacgacgtgttcttttctctccacgccgtcgtgctgactctcatcatcattgtccagtgttgtctttatgagaggggaggtcaacgtgtaagctggccggctatcggattcctcgttctggcttggctttttgcctttgtgaccatgattgtggctgccgtcggggtgacaacatggctgcagttcctgttctgctttagttatattaagctggcagttacattagtgaaatattttccccaggcatatatgaacttctactataaaagtactgagggatggagtatcggcaacgtgctactcgacttcactggtgggtcattttcacttttacagatgtttttgcaatcctataacaatgaccagtggactctcattttcggagatcctaccaagttcggtctaggagtgttcagtattgtgttcgatgttgtgttcttcattcagcatttctgtctgtacagaaaacggccaggttatgaccagctgaactag

SEQ ID NO: 3704 - DNA, 879 bp, Artificial Sequence
  Description of Artificial Sequence: Synthetic coding sequence
atgtgcccccggatccggttcctggtgatccggagcagcgccatctccataatcaaccaggtcattggctggatttacttcgttgcctggtcaatttcattctatccccaggtgatcatgaattggcgccggaagtccgtcatcggcttgagtttcgacttcgttgccctcaatcttaccgggttcgtggcgtattcagttttcaacattggtctgctttgggtcccatatataaaagaacagttccttctgaagtacccaaatggcgtgaacccggtcaactccaacgacgtgttcttcagcctacatgccgtcgtccttacccttataataatcgtccagtgctgcctgtatgaacggggtggacaacgggtatcctggccagccataggtttcttggttctcgcctggctttttgccttcgtaaccatgatagtggctgccgttggggtgacaacctggctgcagttcctgttctgtttttcttacattaaactggcagttacattagtgaagtacttcccccaggcctacatgaatttttattacaaaagcaccgagggctggtctatagggaacgtccttctagatttcacaggcggttcattttctctgttgcagatgtttctccagagttataataatgaccagtggacgttgatttttggcgaccctactaagtttggactgggggtgttcagcatcgtatttgacgtggtattctttatccagcacttttgcctttatcgcaaaagaccgggattgcaagccgcaaggaccggctcagggagccgcctgcgccaggattgggccccgtcactccagcccaaagccctcccacagaccacatcagtttctgcatcctcactcaagggctag

SEQ ID NO: 3705 - DNA, 228 bp, Artificial Sequence
  Description of Artificial Sequence: Synthetic coding sequence
atgatccggaactggctgaccatcttcatcctgttccccctgaagcttgttgagaagtgcgagtcatccgttagcctaacagtgcctcctgtggtcaagctcgagaatggcagttccacgaacgtgtcgctgactctcaggccccctttaaacgctacccttgtgattacgtttgagataacatttcggtccaagaatattacaatcctcgaactacccgacgagtag

SEQ ID NO: 3706 - DNA, 204 bp, Artificial Sequence
  Description of Artificial Sequence: Synthetic coding sequence
atgcggatccactacctgctgttcgccctgctgttcctgttcctggtccctgttccagggcacgggggcatcattaacacccttcagaaatattactgccgggtgcgaggtggccgatgcgccgtgcttagctgcctgcccaaagaggaacagattgggaagtgctcaactagggggcggaaatgctgccggcggaagaagtag

SEQ ID NO: 3707 - DNA, 204 bp, Artificial Sequence
  Description of Artificial Sequence: Synthetic coding sequence
atgcggatccactacctgctgttcgccctgctgttcctgttcctggtaccagtacctggacacggcggtattattaatactttgcaaaagtattattgcagggtgcgggggggacgctgcgcggtcctatcgtgcctgcctaaagaggagcagatcgggaaatgcagtacccgggggcgcaagtgctgccgacgtaagaaatag

SEQ ID NO: 3708 - DNA, 195 bp, Artificial Sequence
  Description of Artificial Sequence: Synthetic coding sequence
atgcgggtgctgtacctgctgttcagcttcctgttcatcttcctgatgcccctgcccggagtttttggaggaataggagatcctgtgacttgtttgaaatccggagcaatttgccatcccgtcttctgccccaggaggtacaagcagatcggtacgtgtggactcccgggaaccaaatgctgcaagaagccatag

SEQ ID NO: 3709 - DNA, 195 bp, Artificial Sequence
  Description of Artificial Sequence: Synthetic coding sequence
atgcgggtgctgtacctgctgttcagcttcctgttcatcttcctgatgcccttaccaggggtgtttggaggcattggggacccagtcacttgccttaaatccggcgctatctgccatccagttttctgccctagacgttataagcagattggaacctgtggccttccaggcacaaaatgttgtaagaagccatag

SEQ ID NO: 3710 - DNA, 849 bp, Artificial Sequence
  Description of Artificial Sequence: Synthetic coding sequence
atgcggggcatgaagctgctgggcgccctgctggccctggccgccctgctacagggggctgtcagcctcaagattgcggcgtttaatatacaaacattcggtgaaactaagatgtcaaacgcaacactggtgtcctacattgtgcagattctgtcaagatatgatatagcgctagtgcaggaggttagagactctcacctcacagccgtggggaaactcctagataacctcaatcaggatgctcccgacacttaccactacgtggtgtctgagccccttgggagaaattcttataaagaacgttacctatttgtttaccggccggaccaggtgtccgccgtagacagctactactacgacgacggatgtgaaccatgcggtaacgacacttttaatcgcgagccagccatcgttaggttttttagccgcttcacagaggtaagggagttcgcgattgtcccgctgcacgctgccccgggagacgcagtggcagagattgacgctctttatgatgtgtatcttgatgtccaggaaaaatggggcctggaggacgtaatgctcatgggggactttaatgccggatgcagctatgtcagaccttcacaatggagcagcattaggctgtggacttcaccgactttccagtggctcatccccgacagcgcagacactaccgcaactccaacacattgcgcatacgatcggattgttgtggcaggcatgctgttacgaggggcagtagtgcccgattccgcgctgcccttcaactttcaggccgcatatggcctgagtgatcagctggctcaggcaatttccgatcactacccagtagaggtaatgctgaaatag

SEQ ID NO: 3711 - DNA, 849 bp, Artificial Sequence
  Description of Artificial Sequence: Synthetic coding sequence
atgcggggcatgaagctgctgggcgccctgctggccctggccgccttgcttcagggcgccgtgtccctcaagatagctgctttcaatattcaaacctttggcgaaacaaaaatgagtaatgctaccctggtgtcgtacatcgtccagattctctcccggtacgatatagcattagttcaggaggtacgggactcccacttaaccgccgttggaaagctcctagataatctgaatcaggacgctccagatacatatcattacgtcgtgtcggaaccactaggcaggaattcatataaagaaagatatctatttgtgtatcggccagaccaggtctcggcagtggactcatactattacgacgacggatgcgagccctgcggaaatgacaccttcaatagagaacctgccatcgtacgtttcttttcccgttttaccgaagtacgcgagttcgccatcgtgcctctgcatgcggccccaggagacgccgtcgctgagatcgacgcgctgtacgatgtgtacctggacgtgcaggagaagtgggggcttgaggatgtcatgttaatgggagacttcaatgcagggtgcagctacgtccgccccagtcagtggtcgtccattcgtctgtggacatctcctaccttccagtggctgatacctgattccgccgacactacggcaacccccacacattgtgcatatgatcggatcgttgtagcagggatgcttttgcgcggggctgtggtgccggactctgcacttcctttcaatttccaggccgcatacggtctgtccgaccaactggcacaggcaataagtgatcactaccctgtggaggttatgctgaagtag

SEQ ID NO: 3712 - DNA, 564 bp, Artificial Sequence
  Description of Artificial Sequence: Synthetic coding sequence
atgcaccagacccccatcaccacctggagcgtgagccactgggacggtacagcaattaggagcgccacatgctcatgcacaggactgacacgttgcttgagatggaccgctacaactaccatgatggctgcctctcccgccggtactaccccttcaactgaaagtcagccccttagtggaagctccccagggagccaggatgtcatgctaatgggcgacttcaacgccgggtgcagctacgttcgacccagtcaatggtccagtattcgcttgtggacaagccccaccttccagtggctcattcccgactccgcggacacaaccgccacccctacacattgcgcgtacgacaggatagtggtcgcaggcatgttgctgcgcggcgctgtggttccagattcagccttaccatttaacttccaagccgcctacggcctgagtgaccagttatttagcgttcacacatgttccggcgccggactgggcgagaggcacggtttacccgcatcggctgccctgccatctaacacttgtcgggccggtacacaccgcgtcagcacatag

SEQ ID NO: 3713 - DNA, 6243 bp, Artificial Sequence
  Description of Artificial Sequence: Synthetic coding sequence
atgctgcgggtgttcatcctgtacgccgagaacgtgcacacccccgatacagacatttctgatgcctattgtagcgccgtgtttgccggagtgaagaagaggacaaaggttatcaaaaactccgtgaatccggtctggaatgagggcttcgagtgggatctgaaaggtatccccttggatcagggcagcgagttacacgttgtcgtcaaggatcacgaaactatggggcgcaaccggttcctcggcgaggcaaaagtgccactgcgcgaggtgctggccactccttctttgtctgcaagcttcaacgcacctcttctggatacaaagaaacagcccaccggggcaagtctggtactccaggtgtcctacaccccactgcccggggctgtgcccctgtttccccctccaactcctttggaacccagccccacattgcccgacctggatgttgtggctgacactggcggagaggaagatactgaggaccagggcctaaccggcgatgaggctgaaccctttctcgaccagtctggcggccctggtgcccccacaacgccccgtaagttgccgtcccgacctcccccgcattatcccggaataaagcggaaaaggtccgctccgacctcaaggaaactcttgtctgataagccccaagacttccagatccgcgtacaggtgatcgagggaagacagcttccaggtgttaacatcaaacctgtggtgaaggtaaccgccgcgggacaaacgaagcggacacgaatccacaagggcaactcccctctgtttaatgagacacttttcttcaatctgttcgatagtcccggcgagcttttcgatgagcctatttttataaccgtcgttgatagtcggtctctccgcaccgacgcacttcttggagaattcagaatggacgtgggaacaatctatcgggaacctagacacgcttatttaagaaagtggctgctactgagcgatcctgacgacttcagtgctggcgcaagagggtatctaaagacttccctctgcgtgcttgggccaggagatgaggcacctctggagaggaaggatccaagcgaggacaaggaagacattgagtcgaatctgctacggccgaccggtgtggctttgcggggcgctcacttctgtctgaaggtgttcagagccgaagacctccctcagatggacgacgccgttatggacaacgttaaacagattttcggttttgagagtaacaagaaaaatttggttgaccccttcgtggaagtgtcatttgcaggtaagatgctgtgtagcaagatcctcgagaaaaccgcaaacccccagtggaaccagaacataacactgcccgctatgttccccagcatgtgcgagaaaatgcggattcgtattatcgattgggatcgcctcactcacaatgacatcgtcgcaaccacgtacctgtcaatgtcaaaaatctccgccccaggcggagagattgaggaggaacccgccggagccgtgaagccttcgaaggccagcgatttggacgattatttgggcttcctccccacgtttgggccctgttacatcaatctctacggaagcccaagggagttcaccggatttcctgatccctacaccgagctaaatacaggtaaaggagaaggggtagcctaccgtggccgacttctcttgtccctggagaccaagttagtagaacacagtgagcaaaaggtagaggatttgcccgctgacgacattctgcgggtggaaaaatatctccgcagaagaaagtattccttattcgccgccttttactccgcgaccatgcttcaggatgtggatgatgcgatccagttcgaagttagcattggtaattatggcaacaagttcgatatgacatgtctgcccctggcttcaacaacacagtattccagggccgtctttgacgggtgccattactactacctgccttggggcaatgtgaagccagtggtggtgctgtcaagctactgggaggacatctctcaccgcattgaaacacaaaatcagctgctgggaatagcagatcggcttgaggccggactagagcaggttcacttggccttgaaggcccagtgcagtacggaggacgtagattcactggtggctcagctgaccgatgagctgatagctggatgttcccagccccttggagacatccatgaaaccccatctgctacacatctggatcagtacttgtatcaacttcggactcatcacctgagccagatcactgaggctgcactggccctcaaactggggcacagcgagctacccgcggccctggaacaggctgaggactggctactgaggctgcgggcactggctgaggagccgcagaactcactgcctgacatcgtaatctggatgttgcagggggataaaagggtggcctaccaacgggttccagcccatcaagttctgttctccagacgcggcgctaattattgcggcaagaactgtggtaagctgcagacaatattcctgaaatatccaatggagaaggtacccggggcaaggatgcccgtacagattagagtgaagctctggttcggtctctccgtagatgagaaagaatttaaccagttcgcagagggaaaactatccgtcttcgccgaaacatatgaaaacgagacaaagcttgcgctcgtcggtaactggggcacaacagggttaacataccctaaatttagcgatgtgactgggaaaatcaaattacccaaggactccttccgcccgtctgccggttggacctgggctggcgactggttcgtgtgccccgaaaaaaccctgctgcacgatatggacgccgggcacctatcattcgtcgaggaagtctttgagaatcaaactagactccctggcggccaatggatctacatgagcgataattataccgacgttaatggcgaaaaagtcctccctaaggacgatatcgagtgccctcttgggtggaaatgggaggatgaagagtggtccactgacctaaacagagccgtcgatgagcagggctgggaatacagcatcactatccctcctgagaggaaacctaagcactgggtgcccgccgaaaagatgtactatacccacagacgcagaagatgggtgcgcctgagaaggcgcgacctcagccagatggaagccttgaagcgccaccgccaggcggaagccgaaggagaggggtgggaatacgcttcgttatttgggtggaagttccacctggaatatcggaagacagacgcgttcaggcggcgacgctggcgtcgacggatggagccactcgagaaaacagggcctgccgccgtcttcgccctggaaggagccttaggaggtgtaatggatgataagtccgaggatagtatgagcgtatctacccttagcttcggcgtgaatcgaccaacaattagctgcatcttcgactacggcaaccggtaccatctccgctgttatatgtaccaggcaagagacttggccgccatggacaaggattcttttagtgacccttacgccattgtctctttcctacaccagtcccagaaaacagtcgtagttaaaaacaccctgaatccgacttgggatcagaccttgatcttttacgagatagagatttttggcgaacccgccacagtggccgagcagccgcccagcatagtagtcgaattatacgaccacgacacctacggtgcagatgaatttatggggaggtgtatctgccagcccagtttggagaggatgcctaggctggcctggttccccctgacacggggatcccagccttccggagaattgctggcttcattcgaactcatccagagagagaagccggcaatccatcatattccaggattcgaagttcaggagacaagccgcattctggacgagagtgaggacacagacctgccttatccccccccccagagagaggctaacatctatatggtgcctcagaacatcaaaccagctttgcagcgcacagcgatcgagatactggcatggggtctccgaaacatgaaatcctaccagctggccaatataagttctcctagcctggtggtggagtgcgggggccagacggtgcagtcctgcgtgataagaaacttacgcaaaaatcccaacttcgatatatgtacactgtttatggaagtcatgttgccacgggaagagctttattgcccccctatcacagttaaggtaatcgataacaggcagtttggaaggcgccctgtagttggacagtgcacaatccggtcactggaatccttcctgtgtgacccatatagcgctgaaagtccaagcccccagggtgggcctgacgacgtaagcttactcagccctggtgaagatgtgctgattgatatcgatgacaaggagccccttattcctatccaagaggaagaatttatcgactggtggagtaaattttttgcgtcaataggagagagggagaagtgtgggagctatctggagaaggactttgacacactgaaggtctacgatacccagctggagaatgtcgaggctttcgaaggactgagcgatttctgcaacacattcaagctgtatagaggaaaaactcaggaagagacagaggaccccagcgtcattggtgaattcaagggactgtttaaaatatacccccttccagaggaccccgcgatacctatgccaccccggcaatttcaccagctggctgcccagggtccccaggaatgcctcgtgcggatctacatcgtgcgggcatttgggttacaacctaaagatccaaacggcaagtgtgatccgtatattaaaatctccatcgggaagaaaagcgtctcagatcaagacaactacatcccttgtacgttggagccagtctttggcaaaatgttcgagcttacatgcactcttcccctggaaaaggaccttaagattaccctgtacgattacgatctcctgtcgaaagacgagaaaattggagagaccgttgttgaccttgaaaaccgacttctgagcaagttcggcgcccgctgcggcctgccacagacatattgtgtctctggtcccaaccaatggcgtgaccagcttaggcccagtcagctcctgcacttgttttgtcagcaacaccgggtgaaagctcccgtatatcggacggaccgcgtgatgttccaagataaagaatacagtattgaggaaatcgaagccggacgaattcctaatccacatctcggacccgttgaggagaggctggctctccacgttctgcagcagcaaggactagtacctgagcacgtggagtcccgacccctgtactcaccgctgcagcctgatattgaacaaggaaaactacagatgtgggttgatctcttccctaaagcactgggccgacccggtccaccgtttaacataactccacgcagagcacgcaggttcttcttgcgctgcatcatctggaacactagggacgtgattcttgatgatctctctctcactggtgagaaaatgagcgacatctacgtgaagggctggatgattggatttgaggaacacaaacagaaaactgatgtccactacagatccctgggcggtgaggggaattttaactggagatttatattccccttcgattacctccccgccgaacaggtatgcactattgccaaaaaagatgcattttggcggctggacaagactgagtccaagattccagctcgtgtcgtctttcagatttgggacaatgataaattctcgttcgacgatttcctggggtctctgcaattggatctgaaccggatgcccaaaccagccaagacagctaaaaagtgctcattggaccaactggatgatgcattccatcccgagtggttcgtcagtttgtttgaacagaaaacagttaagggatggtggccgtgtgtggccgaagaaggggaaaagaaaatcttggccggcaagctggagatgaccctcgaaattgtggccgagtcagaacacgaggagcggccagcaggacaaggccgggacgagcctaatatgaaccctaaacttgaggatcccagacgccccgacactagcttcctgtggtttactagcccctataaaacgatgaagttcattctatggaggcggtttcgctgggccatcatcctattcatcattctgttcatcctgctgttgttcctcgccattttcatttacgccttccccaattatgccgctatgaaactggtcaagccgttcagctag

SEQ ID NO: 3714 - DNA, 6246 bp, Artificial Sequence
  Description of Artificial Sequence: Synthetic coding sequence
atgctgtgctgcctgctggtgcgggccagcaacctgcccagcgccaaaaaggacagaagatctgaccctgtcgcatctcttacctttcggggggtgaaaaagcgcactaaggtgatcaaaaattcggttaatcccgtttggaacgaaggattcgaatgggaccttaagggtatcccactcgaccagggcagcgaactgcacgtcgtagtaaaagaccacgagacaatgggacgaaataggttcttaggagaggctaaggtgcctctgagagaggtactggccaccccatctctttctgcatcatttaacgcacctcttttagacaccaaaaagcaacccacaggtgcctctctcgtcctccaggtatcctataccccactgcctggagccgtgcctctgttccctcccccgacacccttggagccatcccccaccctgcctgacctggatgtggttgctgacaccggcggcgaagaagacactgaggaccaaggactgaccggggatgaagccgagccgttccttgatcagtctggagggccgggcgcccccaccaccccccggaagcttcccagcaggccgcctcctcactatcccgggatcaaaaggaagcggtcggcccccaccagccgcaaactcctcagtgataagccacaggactttcaaatccgagtccaagtcatagaaggcagacagctccccggagttaacatcaaacccgtagtcaaagttaccgccgccggacaaacaaagcgaactcgtatacacaaaggcaattctcctctttttaacgaaactctcttcttcaacctattcgattcacctggtgagttattcgatgagccaatctttatcaccgttgtcgacagtcggtctctgaggacagacgcactcctcggtgagttcaggatggatgtaggcaccatctatagagaacccaggcacgcttatttgcgcaaatggctgctattgagcgatccagacgacttcagcgctggcgccaggggctacttgaagacaagcctgtgtgtgctgggccctggcgatgaagctccacttgagcggaaggatcccagtgaagacaaagaggacattgaatccaatttgctccggccgacaggtgtagcgttgcggggggctcatttctgtttgaaggtgtttagagccgaagatctcccacagatggatgatgccgtaatggacaacgtgaaacaaatcttcgggttcgagagtaacaagaagaacttggttgacccttttgtggaggtgtcattcgcaggcaagatgttatgttccaaaattctggaaaagacggccaatcctcaatggaatcagaacataacactcccagccatgtttccctcgatgtgcgaaaagatgagaatccggatcattgattgggacagacttactcacaacgacattgtggcgaccacttatctcagcatgtcgaaaatcagcgcccccgggggtgaaatcgaggaagaacccgcaggagctgtgaagccaagcaaggcctctgacctggatgattatctggggttcttacccaccttcggcccctgctatatcaacctgtacggcagcccacgcgaattcactggtttcccagatccttataccgaactgaatactgggaaaggggagggagtcgcgtaccggggtcggctgctactgtcattggagaccaaactggtcgagcattctgagcaaaaggtagaagacctgccagctgatgacatcctgcgggtcgagaaatatctgcgtaggcgcaagtatagcctgtttgccgcattctattcagctacaatgctgcaagacgtagacgacgcgatccagtttgaggtaagcattggcaattacggaaacaagtttgatatgacgtgcctgccgctggcatctacaacccaatattcacgggctgtgttcgacggctgtcactactactatctgccctgggggaacgttaaacctgtcgtggtactgtcctcatactgggaggacatctctcaccgcatcgagactcagaaccagttgttaggtattgccgataggctggaggcaggtttggaacaggtccacctggccctgaaggcccaatgcagtactgaggacgtggatagtctggtggctcagctgactgacgagcttatcgccggatgcagccagccattgggggacatccatgaaaccccaagcgcaacgcacctcgaccagtacctgtatcagttgcgtacccaccacctctctcagatcacggaggctgcactggcgctaaagctcggtcactctgaactgcccgctgcgttggaacaggcagaggactggctcctccgactgcgcgcactcgctgaagaaccacagaactccctcccagacattgtgatttggatgctgcagggtgataaacgagtggcttatcagagagtgcccgcacatcaggtcctgttcagcaggagaggcgcaaattattgcggtaaaaactgcgggaagctgcagactatttttctgaaatatcctatggagaaggtgcccggcgctaggatgcctgtccagatccgggtcaaactgtggtttggtctgtccgtagacgagaaagagtttaaccaattcgcagagggtaaactctctgtcttcgcggagacctacgaaaacgagaccaagctggcgctggtggggaactgggggactacaggattaacttacccgaagttcagtgatgtaacaggcaagattaagttgccaaaagactcttttagacctagcgctggctggacatgggcaggggattggttcgtttgtcccgagaagaccctcctgcatgacatggacgcgggccacctatcatttgtggaggaggtgttcgagaatcagacccgacttcccggaggccagtggatctacatgtcagataactataccgacgtcaatggggagaaagttctgcccaaggacgacatcgaatgccctctggggtggaagtgggaggatgaagaatggagtacagacttgaacagggccgtagatgaacaaggctgggagtactctattactatccctcctgagcgcaaacctaaacattgggtgcctgcagaaaaaatgtactatacccataggaggagaagatgggtaaggttacgtagaagggatcttagccagatggaggccctcaagcggcacagacaggctgaggcagagggggaggggtgggagtatgctagcctgttcgggtggaaatttcatctcgagtatcggaaaaccgatgccttcagacgaaggagatggcggcgaaggatggagcctttggagaaaacaggtcctgccgcggtgtttgcactggagggggcactgggtggcgtgatggatgacaagagcgaggattcgatgagcgtgtcaacgctaagctttggcgtgaacagacctacgattagctgtatttttgactatgggaacaggtatcatcttagatgctacatgtatcaggccagagacctggccgctatggacaaggactctttttcagatccctatgctatcgtgtctttcttacatcagtctcagaaaacagtagtcgtcaagaacactctcaatccgacatgggatcagacactgatattttacgaaatagagatttttggcgagcctgctacggtcgctgagcagcccccctccattgtggtggagctgtacgatcatgatacatatggagctgacgaatttatgggcagatgtatttgtcagccttctctcgagcgcatgccaagactggcatggtttcctctcaccaggggaagccaaccttcaggggagctgctggcctctttcgaacttatccagagggagaagccagcgatccatcatattcccgggttcgaagtccaggagactagtagaatacttgacgagagcgaggataccgacctgccatacccaccccctcaaagggaggcgaacatatatatggtgccgcaaaacatcaagcctgctttgcagagaacggctatcgagatcttggcttggggactgcggaatatgaaatcatatcagttagctaacatatcatccccctctcttgtggtggagtgcggaggacaaacggttcagagttgcgtgatccgcaacctaagaaagaatccaaattttgacatatgcaccttgttcatggaggttatgctgccaagagaagagctgtattgtcctcctattacggtgaaggttattgataacaggcagtttggccgacgacccgtggtaggccagtgcacaattcgatccctggaatcttttctgtgcgacccctacagcgctgaatcgccatcaccccagggtggcccagacgatgtgtctctgctgtctcctggtgaagacgttctgatcgacatagatgataaggaacctctcatacccattcaagaagaagagtttatagattggtggtccaagttttttgccagcatcggcgaacgcgaaaaatgtggaagttatctcgaaaaggattttgatactcttaaagtttacgatacccagttggaaaacgtggaagcttttgaaggattgtctgatttctgtaataccttcaaactgtaccggggtaagactcaggaagaaaccgaagatcccagcgtcattggtgaattcaaggggctctttaaaatataccccttgccagaggatcccgcaataccaatgccacctcgccagtttcaccagttagccgcacagggccctcaggaatgtctggtgcgcatctatatagtaagagcctttggcctgcagcctaaagaccctaacggtaagtgtgatccgtacattaaaatcagtattggcaagaaaagcgtgtccgaccaggacaactacatcccttgcactctggagcccgtctttggcaagatgtttgaactgacttgtactttgccactcgaaaaggacctgaaaataaccctttatgattacgatctgctttccaaggatgaaaagatcggtgaaactgtagtcgatttagagaacaggctgttgtctaagttcggtgcccgatgcggcctccctcagacatattgtgtaagtggtcccaatcagtggcgggaccaactccgaccgtcacaactgctccatctcttttgtcaacagcatagagtcaaggcgccagtgtaccggactgaccgtgtcatgtttcaggacaaagaatattccatcgaagaaattgaggctggccggatccccaatcctcatctcgggccggtggaggagaggctagctctccacgtgctgcagcagcaggggttagtgcccgaacatgtggagtctcgaccgctatacagtccgctccaacctgacattgaacaggggaaactccagatgtgggtggacttatttcccaaggccctggggagacccgggcccccattcaacatcacacccaggcgcgcgagaagattcttcctccgctgtataatttggaacactcgagacgtaatcctggatgatttgagcctgactggggaaaagatgtctgacatttacgttaaaggatggatgatagggttcgaggagcacaaacagaaaacagatgttcattaccgcagcctgggcggagagggcaacttcaactggagattcatattcccgttcgactaccttccagccgaacaggtgtgcaccatcgcaaagaaggatgccttctggcgactggataaaacagaatcaaagataccggctcgggttgtcttccaaatatgggataatgataagttctcctttgatgatttcttaggcagtttacaattggatctgaacaggatgccaaaaccagctaaaactgcgaagaaatgttcactcgaccaactagacgatgcctttcatcccgaatggtttgtatcgctgtttgagcagaagacagtgaaaggctggtggccatgtgtggccgaagaaggggaaaagaagatcctggctggcaagctggaaatgacccttgagatcgtggccgaatccgaacatgaggagcgcccggcgggacagggaagggatgagcccaacatgaaccctaaactggaagatcctcgacgtccagatactagtttcctctggttcacctcaccttacaagactatgaaatttatactgtggcgacgcttcaggtgggccatcattttattcatcattctgtttattctgctattgtttctggccatcttcatctatgcattcccaaactacgctgcgatgaaactcgttaaaccttttagttag

SEQ ID NO: 3715 - DNA, 6309 bp, Artificial Sequence
  Description of Artificial Sequence: Synthetic coding sequence
atgctgtgctgcctgctggtgcgggccagcaacctgcccagcgccaagaaagatcgcaggtccgacccagtcgcctccttgaccttccgcggtgtgaaaaaacgcacaaaggtcatcaagaattctgtgaaccccgtgtggaacgaaggctttgagtgggacctgaagggaattcccctggatcaaggatccgaactgcacgttgtggtcaaagatcacgagacaatgggccggaataggttcctcggagaagcaaaagtcccactgcgtgaagtccttgccaccccgagcctgtccgccagttttaatgctcccctgctcgacactaagaagcagcctacaggggcttctcttgtgcttcaggtgagctatacgcccctgcccggggcagttcccctgttcccgcccccaacccccctggagccatcaccaaccctgcccgacttagacgttgtggccgacacagggggagaggaggacactgaagaccagggcctgacaggtgatgaagctgagcccttcctcgaccagtccgggggcccgggtgcacccaccacaccccgcaagttgccctccaggccacccccgcattaccccggtatcaagcggaagaggagtgctcctaccagcagaaagctcttgtcggacaagcctcaggatttccagattcgggttcaggtcatagagggccgtcagcttcccggcgtgaatataaagccggtggtaaaggttaccgccgccgggcaaacaaaaagaacgcggatccacaagggcaattcacctttgttcaatgaaactctcttctttaatctgttcgacagccccggcgaactcttcgatgagccaatcttcatcacagtggttgactcacgatcactgcgaacagatgctctactcggtgaattccgcatggacgtcgggacgatatatagggagcccaggcacgcctacctgcgaaagtggcttctcttgtcagaccctgatgacttcagtgccggtgcccggggctacctgaaaacttctctgtgtgtgctgggccccggggatgaagctcctctcgaaagaaaggacccctctgaggacaaggaagacatcgaatctaatttgcttagacccactggagtggcccttaggggcgcccacttctgtctgaaagtgtttagagcggaggatcttccccagatggacgacgcggtgatggataacgttaagcagatcttcgggttcgagagtaacaaaaagaacctggtggacccctttgtggaagtttcctttgcaggaaagatgctgtgcagtaagatcctcgagaagactgccaaccctcagtggaaccaaaatattaccttaccggccatgtttccctctatgtgtgagaagatgcggattcgtatcattgactgggataggctgactcacaatgacattgtcgccacaacatacctgtccatgtccaagataagtgcgcctgggggcgaaattgaagaagagcctgccggggccgtcaaacctagtaaagcaagtgacttagacgactacctgggttttttgcctacattcggaccttgctatataaacctgtacggttcccctcgcgagttcacaggattccctgacccgtatacggaactgaataccggcaagggagagggggtggcttacagggggcggttgctgctgtcactggagacaaagctcgtggagcactctgagcagaaggtggaggacctgcctgcagacgatatactgcgggtggagaagtatctgcgccgccgcaagtactctcttttcgctgccttctattctgctactatgctgcaggatgtcgatgacgcaatccagttcgaggtctccatcgggaattatggcaataaatttgacatgacctgtctgcctttggccagcacaacccagtacagccgagctgtattcgatggctgccactactattatctgccatgggggaacgtgaagcccgtggtcgtactctcctcttactgggaagatatctcacacaggatcgagactcaaaatcagttattaggtattgcagatcgactagaggcaggcctggaacaggtacatctggctctgaaagcacagtgcagtactgaggacgttgacagcctggtcgcccagttgacggacgaattaattgcaggctgctcccagcctctgggcgacattcacgagactcccagtgctacgcatctcgatcagtacctctatcagctgaggacacatcacctgagtcagataactgaagctgcgcttgccttaaagctggggcacagtgaactgccagcggccctcgaacaggcagaagattggttgctccgcttaagagcgttagccgaagagccccagaatagtttgcctgatatcgtgatttggatgcttcagggggacaaacgggtcgcttatcagagagtgccagctcaccaggtcttgttttctcgacgaggtgccaattattgtggtaaaaactgcgggaaattgcagactatattcctgaaatatccaatggagaaagtgcccggggctaggatgcctgtgcagatcagggtcaagctgtggttcggactgagcgtcgacgagaaggagttcaaccagttcgccgaaggtaagctgagcgtttttgcagaaacctatgaaaacgaaacaaaactggccctggttggtaactgggggacaacaggactgacataccccaagttttctgatgtgaccgggaagatcaaactgcctaaggatagttttaggccaagcgcaggatggacttgggccggagactggttcgtctgcccggaaaagacacttctgcacgatatggacgccggacatttgtcttttgtggaagaggtttttgaaaatcagacaagactgcctggcgggcagtggatttacatgagtgacaactataccgatgtaaatggcgagaaagtgctgccgaaagacgacatcgaatgcccacttgggtggaaatgggaagatgaggaatggagcactgacctgaatcgggctgtggatgagcaaggatgggagtattcgatcaccattccacctgaaaggaagcccaaacactgggttccagcagagaaaatgtattacacccacagacggcgacgctgggtacggctaagaagaagggatctctctcaaatggaggccttgaaacgccataggcaggccgaggcagagggggaaggctgggagtatgcgtccctgttcggctggaagttccacttagaatatcgtaaaaccgacgctttccggagacggaggtggagacgacggatggagccgttggaaaagaccggacctgcagcggtgtttgccctagagggtgctctgggcggtgtgatggatgataagagcgaagattctatgagcgtctccacattatcattcggcgtgaatcgtcccacaattagttgtatattcgactacggaaacaggtatcacctccgatgctatatgtatcaagcccgggacctagccgccatggacaaggatagtttcagcgacccctatgcgatcgttagctttctgcaccagagccaaaaaactgtggttgtgaaaaataccctcaatcccacctgggaccagacactgatattttatgaaattgagatcttcggcgaacctgccaccgttgctgaacagccaccgagcatcgtggtggagctgtacgaccacgacacttacggtgcagacgagttcatgggtcgctgtatctgtcaaccctcactggaacgtatgcccagattggcgtggttcccacttacacgggggtcccagccttctggagagctcctggcctctttcgaactaatccagcgcgagaaacccgcaattcatcacatccccgggtttgaggtccaggaaacatcacgtatcttggacgagagcgaggacactgacttaccttacccccctcctcaacgcgaggccaatatttatatggtgccccagaatatcaagccggcacttcaacgaaccgctatcgaaatcttagcatggggactccgcaatatgaagtcatatcaattggccaacataagctcccccagccttgtggtcgaatgtggtggccaaacggtccaaagttgcgttatccggaacctgaggaagaacccaaatttcgacatctgtacactttttatggaggtgatgctcccacgcgaagaactgtattgcccaccaatcactgtaaaagtaattgacaacagacagtttggacggagacctgttgtcggccagtgcaccatccggtccctggaatccttcttgtgtgacccctactccgccgagtctccatcacctcagggtgggccggatgatgtgagccttctgagccccggcgaagacgtcctgatagacattgatgataaggagccacttataccgatccagttggccgacggactgtccagcttggctcccaccaacaccgcatcccccccgtcaagccctcacgaggaggaattcatagactggtggtcaaagttctttgcgagtatcggggagcgggagaaatgcgggtcttacttggagaaggactttgacacgctgaaggtgtatgacacacagctggagaacgtagaggctttcgagggcctttctgatttctgtaacaccttcaagctctatcgcggcaagacccaggaggagacagaggacccctctgtgatcggcgagttcaaagggctgtttaagatctacccacttccggaggatcctgccattccgatgcccccgagacagtttcatcagctggctgcacagggcccccaggaatgcctcgtgcgcatatatatcgtgagggcatttggtcttcaacctaaggatcccaatgggaaatgcgacccttatatcaaaatctcaatcggaaagaagagcgtaagtgaccaggacaattatatcccatgcactctagaacccgtgtttggaaagatgttcgaacttacatgtacgctaccgctggagaaagacctaaagatcacactgtatgattatgatctgctgtccaaagatgaaaagatcggagagacagttgtggatctggagaaccgccttctgtccaaattcggagcccggtgtggactcccacagacatactgtgtctctggtcccaaccagtggcgcgaccagctccggccatcccagctgctgcacctgttctgccagcaacaccgagtcaaagctccggtctatcggactgaccgggttatgttccaggataaggagtatagcatcgaagagatcgaggctggtcgcattcccaaccctcaccttggcccggttgaggagcgccttgcgctacatgtcttgcaacagcagggcctggtgccggagcacgttgagagtcggcctctctattcccctcttcaaccagatatagagcaaggaaaacttcagatgtgggtcgacctctttcccaaagcactcgggcgtccaggcccaccttttaacattaccccaaggcgggcccggcgcttctttttaaggtgtataatctggaacacacgcgatgtgattctggatgacctgtctttgaccggcgagaaaatgtctgatatctacgtaaaggggtggatgataggttttgaggaacataagcaaaagaccgacgtccactatcgaagtctggggggcgaaggtaattttaactggcgcttcatcttccccttcgactacctccccgcggagcaggtgtgtactattgccaagaaggatgcattctggcgcctggacaaaactgagagcaaaattccagcacgtgtggtctttcaaatctgggacaacgacaaattttccttcgacgactttctgggatcactacagctggacctgaaccgcatgcccaagccagccaagacagccaagaagtgctcgctcgaccagctagacgacgcctttcatcctgagtggttcgttagtctgttcgaacagaagaccgtcaaaggctggtggccctgtgtggctgaggagggcgagaaaaagatcctggcagggaaactggagatgaccctcgaaatcgtcgccgagtccgaacacgaggagagaccagccggacagggacgggatgagccaaatatgaaccccaagcttgaggacccaagacggccagacactagtttcctttggttcactagtccatacaagaccatgaaattcatcctgtggaggcgttttcgttgggccattatcctctttatcattctttttatcctgctgctgtttcttgctatcttcatctatgcatttcctaattatgctgccatgaagctcgtgaagccgttctcctag

SEQ ID NO: 3716 - DNA, 6357 bp, Artificial Sequence
  Description of Artificial Sequence: Synthetic coding sequence
atgctgcgggtgttcatcctgtacgccgagaacgtgcacacccccgataccgacatatctgacgcgtattgcagcgcggtgttcgccggggtgaaaaagcgtacaaaggtgatcaagaatagtgtgaatccagtctggaacgaaggcttcgagtgggaccttaaaggcatccccttggaccagggctccgagttgcatgtggttgtaaaagaccacgagactatgggccggaacagatttctgggcgaagcaaaagttccacttcgggaggtgttggcaaccccaagtctgagcgccagcttcaatgctcctctgttggacaccaagaaacagcctacaggggccagcctggttctgcaggtgagctatacgccattacctggtgccgtgccactcttccctcctccaacccctttggaaccctccccgactcttcctgaccttgacgttgtggccggcggaggccagagccgggccgagacatggagtttactaagcgacagtacaatggacacccgctatagcggcaagaagtggcccgctcccacagatacagggggcgaagaagatactgaggatcaagggctgacaggagatgaggcagagcctttcctcgaccagagcgggggacctggagctcctaccacgcctaggaaattacctagccggccacctccccattaccctggcattaagagaaagcggtcggcacccacctcacggaaactgttgagcgacaaacctcaggactttcagattcgggtgcaagtcatcgaaggaaggcagctgcctggcgtgaacatcaaacccgtggtgaaggtcacagccgctgggcagacaaaacgcactcgtatccataaaggcaactccccgctctttaatgagacgctctttttcaatttgtttgacagtccgggtgagctcttcgatgagccaattttcatcaccgtcgtagattccagatctttgcgaacagacgctcttctcggcgagttcaggatggacgtgggcaccatctatcgagaaccacgacacgcctacttaaggaaatggttgcttctcagcgaccccgacgacttcagtgcaggcgcccggggatacctgaaaaccagtctgtgcgtgttaggcccgggggatgaagcaccgctggaaaggaaggatccttctgaagacaaggaagacattgaaagcaatttgctgcgccccacaggagtggctctccgaggcgcccacttttgtttaaaggttttcagggctgaggatttgcctcagatggatgacgcagtcatggacaatgtgaaacagattttcggatttgagtccaacaagaagaacctggtcgatcccttcgtagaagttagttttgctggtaagatgctatgcagtaaaattctagagaagacagccaacccccagtggaatcagaacatcacgctgccagccatgtttccttctatgtgtgaaaaaatgagaatacgcatcattgactgggacagactgactcataatgacattgtggctacaacttacctcagcatgtcgaagatctcagctcccggcggcgaaattgaggtagacgattatctcggattcttacccacatttgggccttgctacattaatctttacggcagcccgagagaattcaccggtttccccgacccctacacggaactgaatactggaaagggggagggagtagcttatcgagggcggcttctacttagcttggagaccaaactggtcgaacacagcgagcagaaagtggaggacctaccagctgacgacatcctgagagtagaaaaatatctgcgcagaaggaagtacagcctgtttgccgctttctacagtgctaccatgctgcaggacgttgatgatgccatacagtttgaggtgagtatcggtaattatgggaacaagttcgacatgacttgtctgcccttggcaagcactactcagtacagcagggctgtcttcgacggttgtcactattattacctcccttggggtaacgtgaaaccagtggtagtgctaagttcttactgggaagacatatcacacagaattgagacccagaatcaacttctcggcattgctgacaggctcgaagccggactggagcaagtgcatcttgcgctcaaggcgcagtgttctacagaggacgtcgattccttggtcgcacagctgacagacgagctcatcgccggctgctctcagcccctgggagacatacacgaaaccccatccgctacacacctggatcaatatctctaccagctgaggacccaccacttaagccaaatcacagaggccgctctcgcattgaaactgggccactctgagctacccgcagcgttagaacaggccgaagactggttgctccggctgagagctctagctgaggagccacaaaactctctacctgacatcgtcatttggatgctgcagggtgacaaacgcgtcgcgtaccagcgggtccccgcccatcaagtgctctttagccgtcgcggcgcgaattattgcgggaaaaactgcgggaaactccaaactatcttcctaaagtatccaatggagaaggttccaggcgctaggatgcccgtgcagatccgggtgaaactgtggtttggcttgtcagtggacgagaaggagttcaaccaatttgctgaagggaagctcagcgtattcgccgaaacatatgagaacgagactaagctggccttagttggcaactgggggacaaccggcctaacgtaccccaagttctccgatgtcaccggcaagatcaaactgcctaaagattcatttcggccaagcgccggatggacctgggcgggcgattggtttgtgtgtcctgagaaaacattactgcacgacatggacgccggccacctcagctttgtcgaggaggtcttcgagaaccagactcgacttccaggagggcagtggatctatatgtctgataattatacagacgtgaacggagaaaaagtgctgcctaaggacgacatagaatgccccttaggttggaaatgggaggacgaagaatggagcaccgatctaaacagagccgttgatgagcagggatgggagtatagcataactattccccccgaaaggaaacctaaacattgggtccctgctgagaagatgtactatacccacagaagacgtcggtgggttcgcctgcgccgccgtgatttgagtcagatggaagctctgaaaagacacagacaagcagaggcggaaggagaaggctgggaatatgcctcacttttcggctggaagttccaccttgagtaccggaaaaccgatgcattccgccggcgtaggtggagacgccggatggagcctttggaaaaaactgggccagccgcagtatttgccctcgaaggtgcactgggcggcgtgatggacgataaatctgaagactccatgagcgtgtccaccctgtcattcggggtcaatcgccccaccatcagttgcatcttcgattatggaaacaggtaccacctccggtgttatatgtatcaggcaagagacctcgctgcaatggataaggattcctttagcgacccttacgccatcgtatctttccttcatcagagtcagaagactgtagtggtgaaaaataccctaaacccaacttgggaccagacgctgattttttatgaaattgagatctttggagaaccggccaccgtggctgagcagcctccctccatcgtagtggagctgtacgatcacgacacctacggcgctgacgagttcatgggaaggtgcatctgccagccgtctctcgaacgaatgccacggcttgcctggtttccactgactcggggaagccagccctcaggggaacttctggcctcttttgagttaatacagagagaaaagcctgctatccaccatatcccaggctttgaggtacaggaaacctctagaatcctggacgagagcgaagacactgatttaccttatccccccccccagcgggaagccaacatttacatggtcccccagaatataaaaccggcactgcagcggacggctattgaaatcttggcctggggtttaagaaacatgaagagctatcagttagccaacatctcttccccatcactggtggttgagtgtggagggcagacagtacagagctgcgttattaggaacctgagaaagaatcccaacttcgatatctgtactctgtttatggaagtgatgctgccaagggaagaattgtactgtccccctataaccgtgaaagttatcgataatcgacagttcggacggcgacctgtggtcgggcagtgcaccatacggtcattagaatcattcttatgcgacccctactcggccgagtctccctcaccgcagggaggacctgatgacgtctccctactgagtcctggcgaggatgtgctgatagatatcgatgacaaagaacccttgataccgatccagctggctgacgggctgagttcgctcgcgccgacaaatacggcgagcccgccatcctctccacacgaggaagaatttatagactggtggagcaaatttttcgcttcaatcggcgaaagagagaaatgcgggagctatttggagaaagactttgatacattaaaagtatatgacacccagctggagaacgtagaagccttcgagggtctgtctgatttctgtaataccttcaagctttatagaggaaagacacaggaggaaaccgaggatccgagtgtaataggggaattcaaaggtctgttcaagatttatcctctcccagaggaccctgccattcctatgccccctagacagtttcaccagctcgcggcccagggtccccaggagtgcctcgtgagaatttacatcgtgcgggcatttggcctacagcctaaagaccccaatggcaagtgtgacccgtatattaagattagcatcggtaagaagtctgtgtctgatcaagacaattacataccgtgcacgctggaacctgtgtttggaaaaatgtttgagctcacatgcacgctcccattggaaaaggatcttaagatcaccctctatgactatgatctccttagtaaggacgagaaaatcggcgagacggtagtggacctagaaaatagacttttgagtaagtttggcgctagatgtggtctgccacagacttactgtgtttcaggaccaaaccagtggcgcgaccagctgcgcccttctcagcttctccacttgttttgtcagcagcacagggtgaaagctcccgtttaccgcactgatcgggtgatgtttcaggacaaggaatactccattgaggagatagaagcaggccggatcccgaatccacatttaggccccgtggaggaaaggcttgccctgcatgtgcttcagcaacaaggacttgtgcccgaacacgtcgagtctagacctctgtattcacccctgcagcctgacatagagcaggggaagctgcaaatgtgggtcgatctgtttcctaaagctttgggacggcctgggcctccattcaatattactccacgaagagctcgccggttcttcttgcgctgtatcatatggaacacgcgggatgtgatcctcgatgacttgagcctgaccggcgagaagatgtccgacatctatgtaaagggatggatgattggcttcgaagagcacaagcagaaaacagatgtgcactatagaagcttaggtggcgagggcaatttcaattggcgtttcatcttccccttcgactatctgcccgcagaacaggtatgcaccattgccaagaaggacgctttctggaggctcgacaagactgagtcaaaaatcccggccagggtcgtgtttcagatttgggataatgataaatttagctttgatgatttcctcgggagtcttcagttggatctgaacagaatgccaaaacctgctaagacggccaaaaagtgctcactcgaccagcttgacgatgcattccatcccgagtggttcgtgagtctctttgaacagaagacggttaaaggatggtggccatgtgtcgccgaggagggtgagaagaagatcctcgcaggaaagctggaaatgacattggagattgtggcggaatccgagcatgaagaaaggcctgccggacagggcagagacgagcccaacatgaatcccaaattggaagatcccagaaggccagacacctcttttctctggttcacaagcccatataagacaatgaaattcatcctgtggcggcgatttaggtgggctattatcctctttattatcctcttcattctccttttgttcttggcaatcttcatctatgcctttcccaattacgcagcaatgaagctggtgaaacccttctcatag

SEQ ID NO: 3717 - DNA, 6339 bp, Artificial Sequence
  Description of Artificial Sequence: Synthetic coding sequence
atgctgtgctgcctgctggtgcgggccagcaacctgcccagcgccaagaaagatcggcgcagcgacccagtcgcctcacttacatttcggggggtcaagaaacgcaccaaggtgatcaaaaatagcgtgaaccctgtctggaacgaaggatttgaatgggatctgaaagggatcccgctcgaccaggggtctgaacttcatgttgtcgtcaaagaccacgagaccatgggcaggaacagatttctaggggaagccaaggtccctctccgggaagtgttggccaccccaagcctgtccgcatccttcaacgcacctcttctagataccaagaagcagcctaccggtgccagcctagtgctccaagtgagttatactcccctgccgggggcagtgcccctgtttcctccccctacaccactggaacccagcccaaccctgcctgatttggatgttgtcgccggcggcggacagtcccgcgcagaaacttggagtctgttgtcagattcaacaatggacaccagatactctgggaagaagtggcctgcacccacagataccgggggcgaggaagacacggaagaccaaggtctgactggggacgaggccgagcccttccttgaccagtcagggggcccaggtgcgccgactactcctaggaagctccccagtcggccccctccgcactacccaggtattaagaggaaaagatccgcccctaccagtagaaaactgttaagtgacaaaccgcaggacttccagattagggttcaagtcatcgagggccgccaactccccggggtaaacattaagcccgtggtgaaagtcaccgctgctggtcaaactaaaaggacgcgcattcacaagggcaactcgcctctcttcaacgagactttgttttttaatttatttgatagcccgggcgagctgttcgacgagcctatcttcatcacagtggtagacagccgctcactaagaaccgacgcgcttctcggagaattccggatggacgtgggtacaatctatagggaaccacggcacgcctatttacggaagtggttgcttctgtccgacccagacgatttttcagctggagctagggggtatttgaaaacaagcctatgtgttctggggccaggtgatgaggctcccttggaacggaaagatccctctgaagacaaagaggatattgaaagcaacctgctgaggccgacaggggtggcccttaggggagcccacttttgcctgaaagtgtttcgcgccgaggatctacctcaaatggacgatgctgtgatggataacgtgaagcagatctttggcttcgagagcaacaaaaagaatctcgtggacccattcgtggaagtatcgttcgctgggaagatgctctgctccaaaatcctggaaaagaccgctaacccacagtggaaccaaaacataaccctgcccgctatgttcccgtccatgtgcgaaaaaatgaggatccgtataatcgactgggaccgcctcacccacaacgatatcgttgcgacgacctatctgtcaatgagcaagatatcagccccagggggcgagatcgaggaagaaccggccggagccgtcaaaccatccaaggcttcggatctggatgattatctcgggttcctgccaacttttggcccatgttacattaacctctatggcagcccgcgcgagttcaccggatttcctgatccgtataccgagctgaacaccggaaaaggagagggcgtcgcttacagagggaggctcctgttgtccctggaaacgaaactggtggaacatagcgaacagaaggtggaagatctccccgctgatgacatcttacgggttgaaaagtacctgcgccggaggaaatacagcctttttgccgctttttacagcgcgaccatgctgcaagatgtggacgacgcgatacagtttgaggtgtctatcggaaactatggaaacaaatttgacatgacatgtctgcccctcgctagtaccacccaatacagtagagccgtatttgacggctgtcactactattatctcccttggggaaacgttaagccggtcgtcgttctgtcaagctattgggaggatatttcacaccgcatcgagacccagaaccagctgctagggattgccgaccgactggaagccgggttagaacaggtccatttggccctcaaagcacaatgcagtaccgaggatgtggacagtctcgtggcgcagcttacagatgagctgatcgccggttgttcccaaccgctgggggatattcatgaaacaccatccgccacccatctggaccagtacctctaccaactgcgcacacatcatttgagccaaattaccgaagccgcactggccctcaagttgggccattcagaactgccagctgcactggagcaggctgaggactggctgttgcggctaagggcattagccgaggagccgcagaactccttacccgatatcgtcatttggatgctgcagggggacaagcgggtagcctatcaaagggtgccagctcatcaggtgctgttcagccgcaggggagccaactactgcggcaaaaactgtgggaagctccaaaccatctttctgaagtatccgatggaaaaagtacccggtgctcgcatgccagtgcagatccgcgtcaaactgtggtttggcttgtctgtagacgaaaaagagttcaatcaattcgccgagggcaaactctcagtattcgcggaaacctacgagaacgaaacaaaattagctcttgtcggcaattggggtacaaccggcctgacgtatccaaaattcagcgacgtaactgggaaaataaagctccccaaagactctttcaggccttcagccggttggacttgggctggcgactggtttgtgtgtcctgaaaagaccctgctccacgatatggacgcgggccacctctctttcgtggaggaagtgttcgagaatcagactcgtctgccaggcggacagtggatctacatgtcagacaactacaccgacgttaatggtgagaaagtgctgcccaaggatgatatcgagtgcccccttggctggaagtgggaggatgaggaatggtccacagacttaaatcgcgcagtggacgaacagggatgggaatacagcattactatacctccagaacggaaacctaagcactgggttccagctgaaaaaatgtattacacgcatcgccgcaggcggtgggtccgcctgcgtaggagagaccttagccagatggaagcactgaagcgccaccgacaagcagaggccgagggggaagggtgggagtacgcaagcctcttcggctggaaattccacctcgaatatcggaaaactgacgcttttaggagacgaagatggcggcgacggatggagcctcttgaaaagactggacccgcagcagtgttcgccttggagggggccctggggggggtaatggacgataagtctgaggattctatgagcgtctccaccttatcgtttggcgtaaacagaccaacaatttcttgtatctttgactatgggaacagatatcatctacgctgttatatgtaccaagctagagatctagccgccatggataaagatagcttctcagacccttatgccattgtttcctttctgcatcagtctcagaaaacggtcgtggtgaagaacacacttaacccaacctgggaccaaaccctcatattctacgagattgagatcttcggggaacctgccactgtagcagagcagccacccagtatagttgtcgagttgtatgatcacgatacctacggcgcggacgaatttatggggcgctgcatctgccagccttcacttgagagaatgccccggcttgcctggtttccactcacgaggggtagccagccctccggcgagcttctcgctagcttcgagctgattcagagggagaagccagcaatacatcatatccccggtttcgaggtgcaagagacgagccgcattcttgacgaatcagaagacaccgacttaccctatccacccccccagcgcgaggccaatatttatatggtaccccagaatattaaacccgctctgcaaagaaccgcaatagagatcctggcctggggactgcgcaatatgaaatcataccagctggccaatattagcagtccctccctggtggtggagtgtggcgggcagaccgtgcagtcttgtgtgattaggaatctcagaaaaaaccctaactttgatatttgtacgctgttcatggaagttatgctccctagagaagagctgtattgtccaccaatcactgtcaaggttatcgacaaccgccagtttgggcgtagacccgtcgtagggcagtgtacaatccggtccctggagagcttcctctgcgatccatatagtgcagagagtccatccccccagggcggcccagatgacgtttccctcctgtcaccaggcgaggacgtgctgatcgatattgatgacaaagaacccctcattccgatccaggaggaggagttcatcgattggtggtccaaatttttcgctagcattggtgagagagagaagtgtgggtcttatctggagaaggattttgatacactgaaagtctacgatacccaactggaaaatgttgaggcatttgagggcttgtctgatttctgtaatacattcaagctttacaggggcaaaacacaggaggagacagaggatccaagcgttatcggggagttcaagggccttttcaaaatctaccctctaccagaagatcccgcgatcccaatgccaccccgacagtttcaccagcttgcagctcagggcccccaagagtgcctggtgcgcatttatatcgtccgtgccttcgggctccagcccaaagatccgaacgggaaatgtgatccatacattaagattagcattggcaaaaaatcggtctccgaccaggataattacatcccttgcacattggagccggtgtttggtaagatgtttgaattgacctgcacactgcctctggagaaggacctgaaaattaccttgtacgactacgacctgctgtctaaggacgagaaaattggtgagacagtcgttgatctcgagaatcggctgcttagcaagtttggtgcacgctgcggtctgccccaaacatactgcgtttctggacccaaccaatggagagaccagcttaggcctagtcagctgctgcacttattttgtcagcaacatagggtaaaagctcccgtctatcgtactgaccgggtcatgtttcaagataaagaatacagcatagaagagatcgaagccgggaggatccctaacccgcacctcggccccgtagaggagcggctcgcactgcacgttttacagcagcagggcctggtgccggagcacgtggaaagccgtccattatattcgcctcttcagcccgatatcgaacaagggaagttgcagatgtgggttgaccttttcccaaaagccctagggaggcctggacccccattcaacataacacccagaagggcgaggaggtttttcctgcggtgtatcatttggaacacccgagatgtgattctagacgacctgagtctgactggcgagaagatgagcgacatctacgttaaggggtggatgatcggattcgaggagcacaaacagaaaactgacgtccactacaggtctctgggcggagaagggaatttcaattggcgattcatctttcctttcgattacctcccagccgaacaagtctgcaccattgcgaaaaaagatgccttttggcggctcgataaaactgagtcaaagatcccagcacgggtagttttccagatctgggacaatgacaagttttcattcgacgatttcttgggatccctgcagctggaccttaataggatgcctaaaccggccaagacggcaaagaagtgcagcctcgatcagcttgacgacgcgtttcacccagagtggtttgtgtcactgtttgaacagaagacggtgaaggggtggtggccttgcgtagcggaagaaggagagaagaaaattctggccgggaaactcgagatgactctggagattgtggccgagagcgagcacgaagaaagaccggcgggacagggaagggacgaacccaatatgaacccgaaactcgaagacccaagacgccccgatacttctttcctgtggttcaccagcccctacaaaactatgaaatttatcctctggcgacgctttcgatgggcaatcattctgttcataatcctttttatcctgctgttgttcctggccatctttatctacgccttccctaactatgctgcgatgaaactggtgaagccgttctcatag

SEQ ID NO: 3718 - DNA, 6267 bp, Artificial Sequence
  Description of Artificial Sequence: Synthetic coding sequence
atgctgtgctgcctgctggtgcgggccagcaacctgcccagcgccaagaaggaccgccgcagcgatcccgtggcctccctgacctttcgcggggttaagaagagaaccaaagtcattaaaaattcagtcaatcccgtgtggaacgagggatttgagtgggatctgaaaggaattccactggaccagggatcagagctgcacgtagtggtcaaggaccacgaaaccatggggcgcaatagattcctaggcgaggccaaagtccccctccgggaggtgctggctacaccaagcctgtctgcctcttttaatgcacctctgctggacacaaagaagcagccgacaggcgcctctctcgtgttgcaagttagctacacaccattgccgggggctgtgcctttgttcccgcccccgacccccttggagccatcaccaaccctcccagacctcgatgtggtggccgacaccggcggcgaagaggacactgaagaccagggcctcacaggcgatgaagctgaaccattcctggatcagagcggaggccctggggcgcctactacgcccaggaagttgccttccagacctcctccacattaccctggaattaaaaggaagcggagtgcccccacatctaggaaactgttatcagacaagccacaggattttcaaatcagggtacaggtgatcgagggccggcaactgcccggtgtcaacatcaaacctgttgtgaaagtcacagcagccgggcagacgaaaagaacgagaatccataaggggaattcccccctgttcaacgagactctattcttcaacctgtttgatagccctggcgagctgttcgacgagcccatctttataacagtggtggactctagaagcctgcgcactgacgcattgctcggagagttcaggatggacgtaggcacaatctacagggaaccaagacacgcttatctgaggaaatggctgttactcagcgaccccgacgattttagtgccggggcccgcggctatctcaagacttccctgtgcgttttgggcccaggcgacgaagcccctctagaaaggaaagacccatctgaggacaaggaagacatcgaatccaacctcttgagaccaacaggagtcgcgctccggggggctcacttttgtctgaaagtgttcagagctgaagatctgccacaaatggatgacgccgtgatggataatgttaaacagatctttggctttgagagcaacaagaagaatctcgtcgacccttttgtggaggtgtcttttgcggggaaaatgttgtgttccaagatactggagaagacggccaatccccaatggaaccaaaatataacactgccggccatgttcccaagcatgtgcgaaaagatgcggatcagaatcattgactgggaccgactgacccacaacgatatcgtcgctacaacgtatctgagtatgtccaaaatttccgccccaggcggcgagatcgaggtggacgattatctgggttttttaccgacattcggcccctgctacatcaacctttatggatccccaagggagtttacagggttccctgacccatacacagaactcaataccggtaaaggagaaggcgtcgcttatcgggggcgcctgctgctttccctggaaaccaagcttgtggaacattcagaacagaaggtggaggacctgcccgctgatgacattctgagagtcgaaaaatatctgagaaggcggaaatactctctgttcgccgccttctatagcgccacaatgctccaagatgtcgacgacgctattcagttcgaggtgtcaattggcaattacggtaataaatttgatatgacctgcctgcctttggcgtccacgacgcagtattcacgcgccgtcttcgatggttgtcactactactacctcccctggggcaacgtgaagcctgtggtggtgctgagttcttattgggaggatatatcccaccggatcgagacccagaatcagctgttaggcattgctgaccgtctggaagccggactcgaacaggtccacttggccctgaaggcccagtgtagcaccgaagatgtggactccctggtcgcgcagctgaccgatgaacttattgccgggtgtagtcaaccattgggtgacatacatgagactccctcggccactcacctggatcagtacttgtaccaactgcgcacccaccatctcagccagatcactgaagccgcactcgcactcaaacttggacactccgaattgcctgccgcactcgagcaggcagaggactggttgctgaggctgagagcacttgccgaagagccgcagaacagcctccctgacatagtaatctggatgttgcaaggggataaaagggtcgcttatcagagagtccctgcccatcaggtcctattcagtcgccggggcgccaattactgtggtaagaactgtggaaaactccagaccatttttctgaagtatcccatggaaaaggtgcctggcgcacgtatgccagtgcagattagggtgaagctgtggttcggcctctccgtggatgaaaaagaatttaatcagtttgcggaagggaaactgtctgtattcgccgagacatacgagaacgagactaagctggccctcgttggtaactggggcaccactggtctgacataccctaagttttcagatgtgacgggaaagattaagctacctaaggacagctttaggccaagcgccggttggacttgggcaggagattggtttgtgtgtccagagaagacactgctgcatgatatggacgccgggcacctgtcattcgttgaagaggtcttcgagaaccagactagattgcctggcgggcagtggatttacatgagcgataattacacagacgtcaacggagaaaaggtactcccgaaagatgacatcgagtgtcctctgggatggaagtgggaagacgaagaatggtctactgacttgaaccgagccgtggatgagcagggatgggaatattccattaccatcccccccgaaagaaaacctaagcactgggtgcctgccgaaaagatgtattacacacaccggcggcgccggtgggtgaggctgcggcgacgggatttgtcacagatggaagccctcaagcgacatcgccaggccgaagccgaaggtgaagggtgggagtacgcaagcctttttggttggaaatttcacctggaatatagaaagaccgatgccttcagacggcgcaggtggagacgtcgtatggagcctctggagaagacaggtccagccgcagttttcgcccttgagggtgccctgggtggcgtgatggatgataaatctgaggatagtatgtctgtgtctaccctatctttcggcgtgaataggccaacaatctcatgcattttcgactacggtaaccgctatcacttaaggtgttacatgtatcaagcccgcgatctagctgctatggataaggactcgtttagcgacccgtatgccatcgtctcctttctgcaccaatcacagaagacggtcgtagttaagaacaccttgaacccaacatgggaccaaacactgatattctatgaaattgaaatttttggcgagcctgccaccgtggcagagcagccaccctctatcgtggttgagctgtacgaccacgacacatatggcgcagatgaattcatgggccggtgcatctgccagccttccctggagcgcatgcccagattggcctggttcccactgaccaggggatcacagccgagcggagaactgctggccagcttcgaactgatccagagagagaagccagcaatccatcatatccctggctttgaagtgcaggagaccagcaggatcctggatgagtctgaggatacagatctcccttacccacctccccagcgagaagctaacatctatatggtgccccagaacattaagcccgccttgcagagaacggctattgagatcttagcttggggactgcgcaatatgaaatcatatcagctggccaatatcagttcgccgtcattagtcgttgagtgcggaggccagaccgtgcagagttgcgttataaggaatctccgcaagaatccgaactttgatatctgcacgctatttatggaggtcatgttgcctcgagaggaactatattgcccccccataaccgtgaaggtgattgacaacagacaattcggacggaggcccgtcgtcggacagtgtacaatccgctctctggagtctttcctctgcgatccctattctgccgaatctccgtcgccacagggaggccccgacgatgttagcttgctgagcccaggagaggacgtgctgatcgacatagacgataaggagcccctgatcccgatccaattggcagacggccttagcagtctcgctcccactaacacagcctccccaccttcttcaccgcacgaggaagaatttatcgattggtggtcaaagtttttcgcgtccattggcgaacgcgagaaatgtggcagttatttggagaaagactttgacacgcttaaagtgtatgacacgcagttggagaatgtcgaggctttcgagggcctgtctgatttttgtaacactttcaaactctatagaggcaaaacacaggaagagaccgaagacccttccgttattggcgagttcaaggggctgttcaaaatctacccactgcccgaggatcctgccattcccatgccacctagacagttccaccagctcgccgcccagggtccacaggaatgccttgtccgaatctatattgttcgagcattcggcttgcagccaaaggatcccaatgggaagtgcgacccctacattaagatcagtataggcaaaaaatcagtctcagaccaagataactacatcccctgcacactggaaccggtctttggtaagatgtttgaactgacttgcacattgcctctcgaaaaggacctgaagatcacgttatatgattatgatcttctatccaaggacgagaagattggcgaaaccgtcgtcgatttagagaatcgcttactgtcaaagttcggggcccggtgtggactgcctcagacttactgtgttagtggccccaatcagtggagggaccaactgcgtccgagccaactcctccacctgttttgtcagcaacacagagtgaaggcccccgtgtatcggacagaccgcgtcatgttccaggataaagagtatagtatcgaggagatcgaggctggtagaatacctaatccacacctgggtccagtggaggaacgtctggccctgcatgttctccagcaacaagggcttgtccccgagcatgtcgagtcacgacctctgtactcgcctctgcaacctgatattgagcagggcaagctgcaaatgtgggtcgatctctttccaaaggctctcggtcggccgggcccaccgtttaacatcactcctcgacgtgccaggagattcttcttgcgatgcatcatctggaataccagagatgtaattctggacgatttgtccctgacaggagagaagatgagcgacatctacgtgaaaggttggatgataggatttgaggagcacaagcagaaaacagacgtgcactaccggtccctgggcggcgagggcaactttaattggcggtttatcttcccattcgactacctgcccgcagaacaggtctgcaccatcgctaagaaggacgctttctggcgcctcgacaagacagagtctaaaatcccagcaagggtggtcttccagatctgggacaatgataaatttagcttcgatgatttcttggggagtctccagctggaccttaatcgaatgccaaagccggctaaaactgctaagaagtgttccttggatcaattggatgacgccttccaccccgaatggtttgtgtccctatttgaacagaaaacagtgaaaggttggtggccttgtgttgcagaagaaggagaaaagaagattctggccggaaagctggagatgacgttggagatcgtggctgaatctgaacatgaggaacggccagcgggccaggggcgtgatgaacccaatatgaatcctaaattagaggacccgcggcgcccggatacctccttcctttggtttaccagcccctacaagactatgaaattcatcctatggcgtcggtttcgctgggctattattctttttataatccttttcatcctgctgctatttttggcaatcttcatctatgcgtttccgaactacgccgcgatgaagcttgtgaaacccttttcatag

SEQ ID NO: 3719 - DNA, 6294 bp, Artificial Sequence
  Description of Artificial Sequence: Synthetic coding sequence
atgctgcgggtgttcatcctgtacgccgagaacgtgcacacccccgacacggacatctccgacgcctattgtagcgccgtctttgccggtgtgaagaagcggactaaggtaattaagaactcagtcaatccagtgtggaacgaagggtttgagtgggacctgaagggaattcccttggaccaggggtctgagctgcacgtggtcgtcaaggatcatgagaccatgggtagaaatcgatttttgggcgaagccaaggtgccactccgggaggtgctggcaactcccagcctgtcagctagcttcaacgcacccctattagacaccaagaagcagcctaccggcgccagtctcgtgcttcaggtctcttatacacccttgcccggggcggtgcctctgtttccccctcctacacctctggaaccatctccaaccctgccagatcttgatgtcgttgccggcggcggccaatctagggcggaaacgtggtcgctcctctccgacagcacaatggatacgcggtattccggcaaaaagtggcctgcccccacagataccggaggggaggaggataccgaagaccaaggattaacaggggacgaggctgaaccatttttggatcagtcaggcggccccggggcccccaccactcctcgaaagctgcccagccggccccctccccactaccccgggatcaaacgcaagcgcagcgcaccgacctcaagaaagttgctgtcggataagccacaggacttccagataagagtgcaggtaatcgaagggaggcagctgcctggcgttaacatcaagccggtggtaaaggtcacagctgctgggcaaactaagcgcacgagaatccacaaaggaaacagccctctgttcaacgaaacccttttctttaaccttttcgacagtcccggcgaactgtttgacgagccaatcttcattacggttgtggactccagatccttgcgcaccgacgcattgcttggcgagttccgcatggatgtggggactatataccgagagccaaggcatgcctatctccgtaagtggctcctgttatccgaccctgacgattttagcgccggcgccagaggttaccttaaaacttcactgtgtgtactgggacctggtgacgaagctccgctggaaagaaaggatccctccgaggataaagaagacattgagtccaatctcttacgtccaacaggcgttgctctgcggggagcacacttctgtctaaaggttttcagagctgaggatctgcctcagatggatgacgccgtgatggataatgttaagcagatcttcggttttgagagcaacaaaaagaaccttgtagaccctttcgtggaagtgagcttcgcgggcaaaatgctctgcagcaaaattctcgaaaagacggccaacccccaatggaaccagaatattacactaccagccatgttcccgtcaatgtgtgagaaaatgcggattcgaatcattgactgggaccgactcactcataatgacattgtggccactacctacttgagtatgtctaagatctctgcccctggaggcgagatagaggttgatgattacttgggcttcctgccaacgtttggcccttgttatattaacctgtacgggtcacccagggagtttaccggcttcccagatccctacacggagttgaacaccgggaaaggggagggtgttgcatatagaggaaggcttctgctatctttggagaccaaactggtagaacatagcgaacaaaaagtcgaggacctccccgctgatgacatcctgagggtcgaaaagtatctgaggaggcgaaagtattccctcttcgcagctttttattctgccaccatgctccaggatgttgatgacgcgatccagtttgaagtctcaattggcaattacggaaacaagtttgatatgacttgcttgccccttgcttcgacgacgcagtattcgagggccgtgttcgatggctgtcattattactacctgccatgggggaacgtgaagcctgtcgtggtattatcctcttactgggaagatatctcccataggatcgagactcagaatcagctacttgggattgccgaccggcttgaggccggactggagcaggtgcacctagccctgaaagcccagtgcagcacagaggacgtggattccttggtagcccaactaacagacgagttaatcgcgggctgctctcagcctctcggggacattcacgagactcctagtgcgacccatctggaccaatacctgtatcaactgcgtacccaccacctttcgcagattaccgaggcagcgctggccctcaagctgggccactcggagctaccagcagccctggagcaagcggaagactggcttctgcgccttagggccctggccgaggaaccgcagaattcactgcccgatattgtgatttggatgctccagggcgataaacgggttgcgtaccagcgggtgccagctcatcaagtgctgttcagtcgccggggagctaactattgtggtaagaactgcgggaagctccagactatttttctcaaatatcctatggaaaaagtcccgggagcaaggatgccggtgcagatcagagtgaagctttggttcgggctgtcggtggacgagaaagaatttaaccagtttgcagaaggaaagctgagcgtcttcgctgaaacatacgaaaacgaaacgaaactggccctggtcgggaattggggaaccacaggactcacgtaccctaaattttccgatgtgaccgggaaaattaagctgcccaaggactccttccgcccttctgctggctggacttgggcaggagattggttcgtctgccctgaaaaaacactcttgcacgacatggatgcaggtcacttatcattcgtggaggaagtgttcgagaaccagacaagactcccgggaggacaatggatatacatgtcagacaactacaccgacgtgaatggcgagaaagtccttcccaaagatgacattgagtgccctctcggatggaaatgggaggatgaggagtggtcaactgacttgaaccgcgcagtagacgaacagggctgggaatactccattacaattccacctgagagaaagccgaaacactgggtgcctgccgagaaaatgtactatacccaccgaaggagacgctgggttaggctgaggcggcgcgatctgagtcagatggaggccctcaaacgccacaggcaggccgaagctgagggggaaggttgggagtatgctagtctgttcggatggaaatttcatttggagtacaggaaaaccgatgcatttcggagacgccggtggcgccgccgaatggagcctctggagaagaccgggcccgctgctgtatttgccctggaaggcgctctcggtggagttatggacgacaagtccgaagactcaatgtcagtgtcgacactgagttttggcgttaacagacctacaattagctgcatttttgactacggtaatagatatcatctcagatgttacatgtaccaggccagagatcttgcagcaatggataaagattccttttcagatccttatgctattgtgagtttcctccaccaatctcagaaaactgtcgtcgtcaaaaataccctaaacccaacttgggaccagacactgatcttctatgagatcgaaatttttggggaaccagcgaccgttgctgaacaaccaccatcaatcgtggtagagctgtatgatcacgacacatatggtgctgacgaattcatggggcggtgtatatgtcaacccagcctagagcgaatgcctaggctggcgtggttccccttaactcgggggtcgcagccttctggggagctgctggccagtttcgaactgatccagcgggaaaagcctgcaattcatcatatccccgggttcgaggtgcaggaaacgtctcgaattctggacgaatcggaggacacggatctcccataccctccgcctcaaagagaagcaaacatctatatggtaccccagaacatcaagcccgccctccagcgaacggcaattgagatcctggcctgggggctgagaaacatgaaatcttatcagctggcaaacattagcagtcctagcctcgtggtggagtgtgggggacagaccgttcagagttgcgtgatccgcaacctgagaaaaaacccgaattttgacatatgcactctgtttatggaggtgatgctgccaagagaggagctctactgtccgcctatcaccgtgaaagtgattgacaatcggcagttcggacgcagacccgtggtaggccagtgcacaatcaggtcactggaatccttcctctgtgatccatacagcgccgaatccccttctccccagggaggtcccgacgatgtttctttacttagtccaggagaagatgtgcttattgatatcgatgacaaggaacccctgatcccaatacaggaagaggagtttatagattggtggtccaaattcttcgcctctatcggcgagcgcgagaagtgcggatcatacttagaaaaggacttcgatacattgaaagtttacgacactcagttagagaacgttgaagcctttgaggggctctcagatttttgtaatactttcaaactataccggggcaaaactcaggaagaaactgaggatccctctgtgattggtgaatttaaaggtctcttcaaaatttacccgctgcctgaagatcccgccatcccaatgccccccagacagtttcaccagcttgccgcacagggcccccaggagtgtctggtccgcatctatattgtgagagcatttgggttacaacccaaagatccgaatggaaaatgtgacccctacatcaagattagcatcggaaaaaaaagcgttagtgatcaagacaactacattccctgcactctcgagcccgtgtttgggaagatgttcgaacttacctgcaccctgccactcgaaaaagacttaaagatcacactttatgactacgacctactcagtaaggatgagaaaatcggggaaaccgtggtggatttggagaaccgcctccttagtaaattcggagcgcgctgcgggcttccacagacatactgcgtttcaggccccaaccagtggcgagatcagcttaggccgtcccaacttctgcacctcttttgccagcagcaccgggtgaaagctcccgtgtatcgtacagaccgcgttatgttccaggataaagagtacagtatagaagaaattgaggcaggtaggatccctaacccacacctgggacccgtggaagagcggttggccttgcacgttttgcagcagcagggactggtccccgagcacgtcgagtccagaccactatactccccactacagcctgatatagaacaaggcaagctgcagatgtgggtcgacctgttcccaaaagctctgggccgccctggcccaccatttaacataactccaagacgtgcaagacggttcttcttacgctgtattatatggaacaccagagacgtcatactcgacgatttgagcctcaccggggaaaagatgagcgacatttatgttaagggatggatgatcggattcgaggaacacaaacagaaaaccgatgtgcactaccgctccttggggggggaggggaattttaactggcggtttatcttcccatttgactatctacctgcagaacaggtgtgcacaatcgcgaaaaaagacgctttttggcggctcgataaaacagaaagtaagattcccgcgagggtggtcttccagatttgggacaatgacaaattcagctttgatgatttcctggggtcccttcagctggaccttaataggatgccaaagccagctaagaccgcaaaaaagtgttcactggaccagcttgatgacgccttccatcccgaatggtttgtgagcctgttcgaacagaaaacggtgaagggatggtggccctgcgtggcagaggaaggcgagaagaaaatcctagcaggtaaacttgagatgactctcgagatcgtcgcagagagtgagcacgaggagagacccgccggtcagggtagggacgagcccaatatgaatccaaagctggaggatccccgcagacctgacacttcctttctatggtttaccagtccttataagactatgaaattcattctgtggaggcgcttcagatgggctattatcttgtttataatactgtttatactgctgctgtttctggcaattttcatttacgccttcccaaactatgccgccatgaagcttgtaaaacccttcagctag

SEQ ID NO: 3720 - DNA, 6360 bp, Artificial Sequence
  Description of Artificial Sequence: Synthetic coding sequence
atgctgtgctgcctgctggtgcgggccagcaacctgcccagcgccaaaaaggaccggcggtctgacccagttgcctcgctaacctttaggggggtgaaaaaacgaacaaaggtgataaagaattccgtgaaccccgtgtggaacgagggatttgagtgggatctgaaaggaatacctttggaccaaggttcggaactacacgttgtagtgaaggatcacgaaactatgggaaggaacagatttttgggcgaagctaaagttcctctgagggaggttctggccactccatcattgtccgcttccttcaacgcgccccttttggatacaaagaagcaacccaccggcgcgtctctagttcttcaggtctcttatacaccactacctggcgccgtcccactcttcccaccccctacaccactcgaacctagccctactctgccggatctcgacgttgtcgccggtggtggacaaagtagagccgagacatggtcgcttctgtccgactcgacaatggacaccagatattctggaaagaagtggcccgccccaaccgataccggcggcgaagaagataccgaagatcaggggctgacaggcgacgaggcagagccttttctcgatcagagtggaggacccggcgctcccaccacccccagaaagctgccatctcgccctccacctcattacccgggtattaagcggaaaaggtcagcaccaacttcgcgaaagcttctgtctgacaagccacaagacttccagatccgggtccaagtgattgaaggtcgccagttaccgggagtaaatataaagccagtcgtaaaggtgacagcagccgggcaaacaaagagaacccgaatccacaaaggaaactccccactgttcaacgagactctattcttcaacctgtttgactctccaggggaattatttgatgaacccatatttatcactgtggtagactctagatcactaaggactgatgctctgctgggggaattcaggatggatgtagggaccatatatcgcgagccccggcacgcttatctacggaagtggttactgctgtctgatcctgatgacttttccgccggggcgcgcggctacctgaaaacctcactatgcgttctgggtcccggggacgaggctcctttggaaagaaaggacccgagcgaggataaagaagatattgagtcaaacctgctccgacctacaggtgttgccctacggggagcccatttctgcctgaaggtgtttcgagccgaggacttaccccagatggatgacgccgtgatggacaacgtgaagcagattttcggcttcgagagtaataagaagaaccttgtggatccatttgtagaggtctcctttgctgggaaaatgctctgctcaaagatactggagaaaaccgccaacccccaatggaatcagaatattacccttcccgcgatgtttccatccatgtgtgaaaaaatgaggattcgaattattgattgggaccggctgactcataatgatatagtggccaccacctacttgtccatgtctaagatcagcgctccaggcggggaaattgaggtcgatgattatcttggtttcctacctacttttggtccctgttatattaatctgtacgggtcgccgcgcgagtttactggatttccggatccctacactgagctaaacactggcaagggagagggggtggcctatcggggacggttgctcctgtctctcgagaccaagctcgtggaacatagcgagcagaaggtggaagacctgccagccgatgatatcctgagggtggaaaagtatttacggcgtcggaaatactcactgttcgccgccttctacagcgccacaatgctgcaggatgtagacgatgccatccagtttgaggtcagcattggcaactatgggaataagttcgacatgacttgtctgcctttagcctctactacccaatattcacgagctgttttcgatggttgccactattattatttgccttggggcaatgttaaacccgtggtcgtgctgagcagctactgggaagacataagtcatcgtatagaaacccagaatcagttactcggcattgccgaccgcctggaggccggcctagaacaagttcatcttgcgctgaaggctcagtgtagtactgaagatgttgattctctggtggcccagttaacagacgagcttattgcaggttgcagccagcctctgggggacatccacgagaccccttcagcaacccatttagaccagtacctgtaccagctgaggacacaccatctgagccagatcacagaagcagctcttgcattgaagctcggacactccgaactacctgctgccctagagcaggctgaggattggctgttgagactgcgtgccctcgctgaagagccccagaacagtctgcctgatatcgttatatggatgctgcaaggggataagagagtagcctatcagagggtgcccgctcaccaagtcctgttctctcgccggggcgccaattactgcggcaagaactgtgggaagcttcagacaattttcctcaaatatccaatggaaaaggtacctggggcacgtatgccagtgcagattcgggttaaactctggtttggtctgtccgttgatgagaaggaatttaatcagttcgctgaggggaagctgtctgtgttcgcagaaacctatgaaaacgagaccaagctcgcgctggtagggaactgggggacaacaggcctgacttatcctaaattcagtgatgtcacagggaagataaagctgcccaaagactcgttcagacccagcgctggctggacctgggctggagactggttcgtttgccctgagaagacgttgctccatgatatggatgccggacacctgagcttcgtcgaagaggtcttcgagaatcagacacgactgcctggcggccagtggatatatatgtctgacaactacacggacgtgaatggagagaaagtactgcccaaggatgatatcgaatgtccactgggatggaagtgggaagatgaagagtggtctaccgacctgaatagggcagtggatgaacaggggtgggaatacagcatcaccattccccccgagcgaaagcccaagcattgggtaccagcagagaaaatgtactacactcatcgcagaaggcgctgggtcaggttacggcgcagagatctgtcgcagatggaggccctaaaaagacacaggcaggctgaagctgaaggggaaggatgggaatacgcttccctgtttgggtggaagttccatctcgagtacaggaaaacagacgcgttcagacgccgcaggtggcggcgccggatggagccattagaaaaaactggacccgcagccgtctttgctctggagggtgcactggggggagtgatggatgacaagtccgaagactcaatgtccgtgtctacccttagcttcggagtcaatcggcccaccatctcttgcatattcgactacggcaatagatatcatctaagatgctacatgtaccaggcaagggatctggcggccatggacaaagatagtttctcagatccctacgcaatcgtcagcttcctgcaccagtctcagaaaaccgtggtagttaaaaacaccttaaaccctacttgggaccaaaccctgatattttacgaaatagagatctttggggaaccagcaaccgtggcagaacaaccaccatctattgtggtcgagctgtatgaccacgacacctacggtgccgacgagttcatgggtcgctgtatctgccagccatcactggaacgcatgcctcgactggcttggtttcctttgactcgaggaagtcaaccatcgggagaactcctggccagcttcgagctgattcaaagggagaagcctgcaattcatcatatacctgggtttgaggtacaggagactagccgcattctcgatgaatctgaagacaccgatttgccgtatccccctccccaaagagaagccaatatctacatggtgccacagaatatcaagcctgctctacaacgtactgccatcgagattttggcatggggtctgcggaacatgaaaagttaccaactagcgaatatctcctccccgtcgctcgtagtggagtgtgggggccagaccgtacagtcatgtgtcatccgcaatttaagaaagaacccaaatttcgatatctgcacgctttttatggaggttatgctgcctcgagaagagctgtattgcccccctatcaccgttaaagtgattgataatagacagttcggccggcgcccagtggtgggccagtgcactatccgttctctggagtctttcctgtgcgacccatattctgctgaaagcccctcacctcagggcggcccagacgatgtgtcactgctgtcccctggcgaagacgtgttgattgatatcgacgacaaagaaccgctgattcctatccagctcgctgatggactgagctctctcgcccccactaatacagcatccccacccagttctccccacgaggaggagtttatcgactggtggtctaagttcttcgccagcataggtgagagggagaagtgcgggtcgtacctggagaaggatttcgatacacttaaggtgtatgacactcagctcgaaaacgtggaggcattcgagggtctgtccgacttttgcaatacctttaagctatatcgggggaagactcaggaggagacagaagatccttccgtgatcggggaatttaaagggcttttcaaaatctatccactccccgaagaccctgctattcctatgccgcctaggcagtttcatcagctggccgcacaggggccccaggaatgtttggtgagaatatacattgtgcgcgcctttggcctgcagcccaaggatccaaatggaaagtgcgacccctacattaagatctctatcggaaaaaaatctgtatcggaccaggacaactacattccttgcacactggagcctgtctttggaaagatgtttgagctcacatgtactctgccacttgaaaaggacctaaagattacgctgtacgattatgacctgctctcaaaggatgagaaaattggagagacagtggtagacttggaaaatagattgctctccaagttcggggctcgatgcggactgccacagacgtattgtgttagcggtcctaatcaatggagggaccagctccgcccttcccagctgttgcacctgttttgccagcagcacagggtgaaggcgccagtgtaccgaaccgacagggtgatgttccaagataaggaatattcaatcgaggagattgaggccggccgcattcctaatccccaccttggccctgtggaagagcggcttgctcttcatgttctgcagcagcagggtctagtgccagaacacgtcgagtctcggccactttatagtcccttgcagcccgatattgagcagggtaaactccagatgtgggtggacctgttcccgaaagctctcggccggccggggccacccttcaatattactccccgcagggcaaggcgattctttctgcgatgcatcatttggaatacccgggacgtcattctcgacgacctgtccctcactggggaaaagatgagcgacatatacgtgaagggctggatgattgggtttgaggagcacaagcagaagaccgacgtgcactaccgctccttgggcggagagggtaatttcaactggagattcatttttccatttgattaccttccagcagagcaggtgtgcaccattgctaagaaagatgcattctggcgcttagataaaaccgagtctaagattccagctagagtggtgtttcagatttgggacaatgacaaattctcatttgacgatttcctgggctcactgcaactggacctcaatagaatgcctaagcctgcaaagaccgctaaaaagtgctccctggaccagctcgacgacgcattccaccccgaatggtttgtgagcctgttcgagcagaagaccgtgaaaggctggtggccatgtgtggccgaagaaggagaaaagaaaattctggccgggaaactagaaatgaccctggagatcgtcgccgagtctgagcacgaggagcgcccagccggacagggtagagacgaaccaaacatgaatccaaagcttgaggatccccgtcggccagacacgagtttcctctggtttacatcaccctataaaaccatgaaattcatcctttggcggagattcagatgggcgatcattttgttcataattctattcatactgttactgttccttgcaattttcatctacgctttccccaattatgccgctatgaaactagtgaagccctttagctag

SEQ ID NO: 3721 - DNA, 6297 bp, Artificial Sequence
  Description of Artificial Sequence: Synthetic coding sequence
atgctgtgctgcctgctggtgcgggccagcaacctgcccagcgccaagaaggatcggcgatcagatccagtagcctccctgacttttagaggcgtaaagaaaagaactaaggtcattaagaacagcgttaacccagtttggaatgagggattcgaatgggacttgaaagggattcctctcgatcaggggagcgaactgcatgtggtcgtcaaagaccatgaaaccatgggtagaaatcgattcctgggagaagctaaagtcccactacgtgaggtgttagcaacaccctccctgtcagccagcttcaatgccccactcctcgacacaaagaagcagccaacaggcgcctcattagtcctgcaggtaagctatacgcccctgccaggcgccgtccctctgtttcctcctccgacacccctcgagccatcaccgacactgcctgacctcgacgtcgtcgctgggggcggccaaagccgcgccgagacctggagcctgctatcagacagcaccatggacactcgttatagtgggaaaaagtggcccgcccccactgataccggcggagaagaagatacagaggaccagggactcaccggcgatgaagcggagccctttctggatcagagcggcgggccaggggcccctactacacctcggaaactcccatcacggcctccaccacactacccagggattaagagaaagcgaagcgccccaacctcgagaaaactcctgtccgacaaaccccaagactttcagattagagtccaagtgattgagggcagacaattgcctggcgtcaatatcaagccagttgtgaaggtaaccgccgcagggcagacgaaaaggacccgaatccataagggcaattctccactattcaacgagactttgttttttaacctgtttgacagccccggtgaactgttcgacgaacctatctttattactgtagtggacagcagaagtttgcgtaccgacgccctactgggtgagttcagaatggacgtgggtacaatctatagagaaccccgacatgcttacctcaggaagtggcttttactttccgatcccgacgatttctccgctggagctcgaggttacttaaagacgtcactctgcgtactgggccccggtgacgaggctcccctagaacgcaaagatccttctgaggataaagaggatatcgaatccaatctgctgaggccaaccggagtcgctttgcggggcgcgcacttctgcctgaaggtcttccgggcagaagacctccctcagatggatgatgctgtcatggacaatgtgaagcaaatctttggcttcgagtctaacaagaagaacctcgtcgacccgtttgttgaagtgtcgttcgccgggaagatgctctgtagtaagatcctggagaaaaccgccaatccccagtggaatcagaacatcaccctgccggccatgtttcctagcatgtgtgagaaaatgcggattagaatcattgactgggatcgtctgactcataacgacatcgtggccactacttacctgagtatgagtaaaatctccgccccgggtggggaaattgaggtggatgattatctgggctttctaccaacgtttggtccctgttacattaacctatatggctcccccagagagttcaccggctttccggacccatacaccgagctcaatacgggcaaaggagaaggcgtcgcatacaggggcagactgttgctgtccttagagaccaagttagtcgagcactccgaacaaaaggttgaggacctcccagcagatgacattttgcgggttgaaaaatatctcagacggagaaaatattctctcttcgctgccttttactcggcaaccatgctccaggacgtggatgatgctatacaatttgaggtcagcattggaaattatggtaacaagttcgatatgacctgtctgccgctggccagcacaacccagtactcccgggccgtctttgacggctgtcactactattatctcccctggggtaacgtgaaacccgtcgtcgtgttgagttcttactgggaagatatctcccaccgcattgaaacccaaaaccagctgctcggcatcgcagacaggttggaggcgggtcttgagcaagtccacctcgcacttaaggctcagtgtagcaccgaggatgttgactctcttgtcgcccagctaaccgacgaactgatcgccggatgctcccagcctctgggggacattcacgaaacgccatcagcgacccacttggaccagtacctttatcagctacggacgcaccatctgtcacagatcactgaagcggcccttgctttgaaattaggccacagtgaactccccgcagcactcgagcaagcagaagattggctcctacggttgcgcgctttggccgaagagccccaaaatagcctacctgatattgtgatctggatgcttcagggcgacaaacgcgtcgcataccagcgcgtgcctgcgcatcaggtgttattttccaggaggggggctaactattgcggcaaaaactgcggaaagctacagaccatctttctgaagtaccccatggaaaaggtgcccggtgctcgcatgcctgttcagatccgtgttaaactctggttcggactgtctgtagatgagaaggagttcaaccagtttgctgaggggaaacttagcgtcttcgcagagacatacgagaacgagacaaagttggccctagttggcaattgggggaccacaggcctgacctatccaaagttcagtgacgtcaccggtaagatcaaactgccaaaggattcctttcgtccttctgccgggtggacctgggcaggcgattggttcgtgtgtcctgagaaaacactcctacacgacatggacgccgggcacctgtcttttgtcgaagaggttttcgagaaccagaccaggttaccgggaggacagtggatctacatgagtgacaattacactgatgtaaacggagagaaggtcctgccaaaggacgacattgagtgcccactcggatggaaatgggaagacgaagaatggtcaaccgacctgaacagggcagtggacgagcagggttgggaatacagcatcaccatcccccctgagcggaaacccaagcactgggtacccgccgaaaagatgtactacacacatcgtcggcgccgatgggttcgtttgcgcagacgcgatctgtcgcagatggaggccctgaaacggcatagacaggcggaggctgagggcgaaggctgggagtacgcaagcttatttgggtggaagtttcacctggaatatcggaaaaccgatgcctttcgacgcaggagatggcgccgtcggatggaacccctggaaaaaactggcccggccgcagtctttgccctcgaaggcgctttggggggggtgatggatgacaagtcagaagactccatgagcgtctccacactctctttcggagtgaatagacccaccattagctgcattttcgactatgggaacagataccaccttcggtgttatatgtaccaagccagagatctcgccgcaatggataaggactccttctcagacccctatgctatagtgtccttcctccaccagagccagaaaactgtggtggttaagaataccctgaaccctacttgggatcaaactctgattttttatgagattgagatatttggggaacctgcaactgtggccgaacagccccccagtatcgtggtggaactgtacgaccacgatacatacggagccgatgagttcatggggagatgcatttgccagccttccttggagaggatgcccagattggcttggtttcccttaacccggggcagtcagccatccggtgagctgctggctagtttcgagctcatacagagagaaaagcccgcaattcatcatattccagggtttgaagtgcaggaaacctccagaattttagacgaaagcgaggatactgatctcccttacccaccaccccaaagggaggccaatatatacatggtaccccagaatatcaaacctgctttgcaaagaactgccattgaaatcctggcttggggactgcggaacatgaagtcataccagctggcaaatatttcttctcccagtctggtggtcgagtgcggcgggcagaccgttcagagctgcgtcatcagaaacctcaggaagaaccctaacttcgacatatgcaccctcttcatggaagtaatgctgcctcgggaggagctgtactgcccacccatcactgtcaaggttattgataatagacagttcggcagacggcccgtagtaggacaatgtaccatcaggagcctcgagagcttcctgtgtgacccttactctgcagagagtccaagcccacaggggggacctgacgacgtcagcctgctcagcccgggcgaagatgttttgatagatatcgacgacaaggagcccctgattcccattcaggaggaagagttcatagactggtggagcaaattcttcgcatcaatcggggagcgagagaagtgcgggtcatacctcgaaaaagatttcgacactcttaaagtatatgatacacagctagaaaacgtggaagctttcgagggacttagcgacttttgtaacacattcaagctgtataggggaaaaacgcaggaagagaccgaggatccatctgtgatcggggaatttaaaggtctgttcaaaatatatcccttgccagaagatcccgctatccctatgccaccccgccaatttcaccagctcgccgctcaaggaccccaggaatgccttgttcgcatctatattgtcagggcctttgggcttcagcctaaggacccaaacggaaaatgtgacccctatattaagatctccataggtaagaaaagcgttagcgatcaggacaattacatcccgtgtaccctggagccagtctttggtaagatgtttgaactaacctgcaccctgcccctggagaaagacctgaagattaccctctacgattatgatctcttgtctaaggacgaaaaaataggcgaaactgtggtcgacctcgaaaacagactcctgtctaagtttggtgccagatgtgggttgcctcagacatattgcgtgagcgggccaaatcaatggcgtgaccagctcaggcctagtcagttgctgcacttattttgtcagcagcaccgggttaaagcccccgtgtatcgcaccgatcgggtcatgttccaagacaaggaatactcgattgaagagattgaggctggacggatccccaacccccatctcggtccggtcgaagagagactggcattgcatgttcttcagcagcaaggcctggtgcctgaacacgtcgagtctcgcccattgtacagcccacttcagcccgatatagagcaggggaagctccagatgtgggtcgacttgtttcccaaggccctggggaggcccgggcccccatttaatattacgccaaggcgtgcccgcagatttttcttaaggtgtattatatggaacacaagagacgttattctggatgacctcagtctcacaggcgagaagatgtctgacatctacgtaaagggatggatgattgggttcgaagagcacaagcagaagactgacgtgcactataggtctctcggcggcgaggggaactttaattggcggtttatctttccatttgactacttacccgctgagcaagtgtgcactatcgcgaagaaagacgccttttggcggctagataagacggaatcaaaaattcctgctcgcgtggtatttcagatatgggataacgataaattcagctttgatgatttcctgggcagcctgcagttggacctgaataggatgccgaagccagcgaagacagccaagaagtgttcactcgaccaactcgacgatgctttccacccagagtggttcgtgtcattgtttgagcaaaaaacggtgaaaggttggtggccttgtgtggccgaagagggcgagaagaagatactggcagggaaattggaaatgacactcgaaattgtggctgagagcgaacatgaggagcggccagccggccaaggtcgcgacgagcctaacatgaatccaaaattggaagacccacgcaggccggacacttcctttctgtggttcacttctccctacaaaacgatgaaattcatcctctggcgtaggtttaggtgggccataatcttgttcatcattttatttatcctgctgttattccttgccatctttatctacgcctttcccaattacgctgcaatgaagcttgtaaagcctttctcttag

SEQ ID NO: 3722 - DNA, 6336 bp, Artificial Sequence
  Description of Artificial Sequence: Synthetic coding sequence
atgctgcgggtgttcatcctgtacgccgagaacgtgcacacccccgatacagacatctccgatgcctattgttcggcagtgtttgccggcgtaaaaaagcgaaccaaggtcattaagaattcagttaatcccgtctggaacgagggcttcgagtgggacttaaaaggaatcccactcgaccagggcagcgagctgcatgtcgtggtcaaagatcacgaaacaatgggccgaaatcgattcttgggggaggccaaggtcccattgagggaggtcctcgccacaccctcactgagcgcttcatttaacgccccgttgctggacactaaaaagcagcccactggggcatccttggtgcttcaggtatcctataccccgttaccaggcgcagtgccactgttccctcctccaacccctttagagccgagccctactttacctgatctggatgtagttgcaggtggcggtcaatccagagccgagacttggagcctcttaagtgactctacaatggatacacgttactccgggaagaaatggcccgcccctactgacacgggtggtgaagaggatacagaagaccaaggcctgacaggcgacgaagccgagccttttctggaccagagcggggggcctggggcgccaactaccccgaggaagttgcctagccggcccccaccccactatccaggtattaagcggaagaggagtgcacctactagcagaaagctcctttcagataaaccccaggattttcagataagggttcaagtcattgaaggtcggcagcttcccggcgtgaatataaaaccagtggtgaaagtgacggcagcaggacagaccaagcgtactcgtatacacaaagggaattccccactgttcaacgaaacactattttttaatctttttgatagtcctggcgaactgtttgatgagccgatctttattacagtggtggatagtagaagtctcagaactgatgcactgttgggcgaatttcgcatggatgtgggcactatttaccgagagcctcgccacgcttatctgcggaagtggctcttactgtcagatccggatgatttctctgccggagctcggggctatctcaaaacgagtctctgtgtcttaggccccggggacgaagcgcctttagagagaaaagacccatccgaggataaggaggacatagagtctaacctgttgcggccaaccggagtggcactccgtggagcccacttttgtctaaaagtgtttcgcgctgaggacctcccacagatggacgacgcagtgatggacaatgtcaagcagatcttcggtttcgagtcaaataaaaaaaacctcgtggacccattcgtggaggtctcattcgctggtaaaatgctgtgttctaaaatcttggagaaaacggccaatccacaatggaaccagaatatcacactccccgctatgttccccagtatgtgcgagaaaatgaggatccggatcatagactgggaccgtctgacccacaacgacatcgtggcaacaacttatctctccatgtcaaagatttcggcgccaggaggcgagatcgaggaggagccggccggagcagtgaaaccttctaaggcaagcgaccttgacgattacctgggatttttgcctacgttcggtccttgctacattaatctatatgggagtccccgggagtttacaggattccccgacccgtatacagagttgaatacagggaagggagagggcgtggcttacagaggacggttgctgctctctttggagactaaactggtggaacactccgagcagaaagtagaagacttgccagccgatgacatcctaagggtcgagaaatacctacgccggcgtaaatatagcctcttcgccgccttctactctgcgacaatgttgcaggacgtggatgacgccattcaattcgaagtcagcattggcaattacggtaataaattcgacatgacttgcctgcccttggcctctactacccagtacagcagagcagtgtttgatggctgtcactattactacttgccctggggcaacgtgaagcccgtcgtggtgctcagttcctattgggaagacatctctcatagaatcgaaacccagaatcaactcctgggaatcgccgaccggcttgaggcaggcctcgaacaggtccatcttgccttgaaagcccaatgttcaacagaggatgtcgacagcctcgtagcacaactgactgacgagctaatcgccggatgttctcagcctctcggagatatccacgagacgcccagtgccacccatcttgaccagtacctgtatcagctgaggacacatcacctttcccaaatcaccgaagccgcactcgcacttaaactaggacacagcgagcttccagctgcactggagcaggcagaggattggctgctccggctacgggctcttgctgaggaaccccagaactccctgccagacattgtgatctggatgctgcagggggacaagagggtcgcttaccaacgagtgcccgcacatcaggtcctcttttcccgaaggggtgcaaactactgcggcaagaactgcggtaaactacaaactatctttcttaagtacccaatggaaaaggtccctggagccagaatgcctgtgcagatccgggttaaactctggttcggactgagcgttgacgagaaggagttcaaccagtttgctgaaggcaaactctcggtatttgctgaaacctatgagaatgaaactaagctggccctcgtgggcaactggggtacaactggactgacctaccctaaattctcggatgtaacgggcaagatcaaactaccaaaagactcgttcagacctagtgctggatggacctgggctggagactggtttgtgtgcccagaaaagaccttgttgcacgacatggacgcagggcacctgtcctttgtcgaagaagtgtttgagaaccagacacgattgccaggggggcaatggatctacatgagcgacaactacaccgatgttaatggcgagaaagtattgccaaaggacgatattgagtgccccttgggctggaaatgggaggatgaggaatggtccaccgacctgaaccgcgccgtagatgaacagggatgggaatactcaataactatcccccccgagcgcaagccgaaacactgggtgcccgccgaaaagatgtattacacacatcggagacggcggtgggtgcggcttcggcgtcgtgacctcagccagatggaagcactcaaacgccaccggcaggctgaggctgagggcgaggggtgggaatacgcttctctctttggatggaaattccatttggagtatagaaagactgacgctttcaggagacggaggtggcggaggcggatggagcccttagaaaaaacaggaccggccgctgttttcgctctagaaggtgctctgggcggcgttatggatgacaagtctgaggactctatgtcagtgagtaccctcagctttggggtgaatagaccgaccatcagttgtatcttcgattatggcaacaggtatcatttacgctgctacatgtatcaggcgcgtgacttggccgcaatggacaaggacagcttctcagacccttacgcaattgtatcttttttgcaccagtcacagaaaactgtggttgtcaagaacaccctcaatccaacctgggaccagacccttatattttacgaaattgaaatttttggtgaacccgctacagtggctgagcagccaccaagcatagtggtcgagctctatgatcacgacacttacggagctgacgaatttatggggagatgcatatgtcagccttcactcgaacgtatgccccggctggcttggttccccctcacccgcggctcccagccttctggtgagcttctggcaagctttgagctgatccagcgagaaaagcctgccatacaccatatcccaggcttcgaggtgcaagagacctctagaatattagatgagtcggaagataccgatttgccctaccccccacctcagagagaggccaacatttacatggtcccgcagaacattaagcctgctttgcaaagaaccgccatcgagattttagcgtggggattgagaaatatgaaaagttaccagctcgctaatattagttcaccaagtctggtagtggaatgcggggggcagaccgtgcagtcttgtgtgatacggaacctgcggaagaatcctaattttgatatatgtacgctcttcatggaggtcatgctgccacgggaggagctttactgtccgcctatcaccgtaaaggttatcgacaaccggcagtttggccggaggcccgtggtgggccagtgtacgataaggtccctggaatctttcttatgcgatccctattccgcagaatctccaagccctcagggggggccggacgatgtgtcactgctgtctcccggcgaagacgtcctcatcgacattgatgataaagaaccactgatccctatccaagaggaggagttcattgactggtggagcaagtttttcgcctctattggcgaaagggagaaatgcggctcttacctcgaaaaagattttgacacgctgaaagtatacgatacacagctggagaacgttgaggccttcgagggactgagcgacttctgtaacacatttaagctgtatcgcggaaagacacaggaagagactgaggacccaagtgtcattggcgagttcaagggcctcttcaagatttatccattgcccgaggatccagctatccccatgcctccacgccaattccaccagctggctgcacagggtcctcaagaatgtctagtcagaatatacatcgtgagggcctttggattacagcctaaagatccgaatggtaagtgtgatccctatataaagatcagcatcggaaagaaatcagttagcgaccaggacaactatattccctgcaccctggagccagtcttcggtaagatgttcgagctgacctgcactctgccacttgagaaggatctcaagattactctttacgattacgatctgctctccaaagacgaaaagataggggaaaccgtagtcgatctcgagaaccggttgctttccaagttcggcgctagatgtggcctgccacaaacttattgcgtctccggtcccaatcagtggagagaccagctgcggccttctcaactgctccatcttttttgccaacagcatcgcgtcaaagcaccagtatatcggaccgatagagtgatgtttcaagataaagagtattcaatcgaagagattgaagcaggtcggatccccaacccacatttgggcccagtcgaggagaggcttgccctccacgttcttcaacagcagggactggtgcctgaacacgtagaaagccgccctctctattcacccctgcagcctgacattgaacaaggaaagttgcagatgtgggtggacttatttcctaaagcgcttggccggcctggcccaccttttaacatcacgcctcggcgtgctcggaggttttttctgcgctgcattatctggaacacgcgggacgtgatcttggacgacctcagcctcaccggggagaaaatgtccgatatatatgtcaaaggatggatgatcggtttcgaggagcacaagcagaagaccgacgtgcactaccggtccttggggggggagggcaacttcaattggcgttttatttttccctttgactacctcccagctgagcaggtgtgcaccatagcgaaaaaggatgccttttggagactggataagacggagagcaaaattccggcccgagtggtgttccagatctgggacaatgataagttttccttcgacgatttcctggggagcctgcagctcgatctgaatagaatgccgaaacccgccaagacagctaagaaatgttcattggatcagctggatgatgcatttcatcctgagtggttcgttagtttattcgagcagaagacagtgaaagggtggtggccgtgcgtggcagaggaaggcgagaaaaagattttggccgggaagctcgagatgaccctagagatcgtggcagaatcagagcacgaagagcggcccgccggtcaggggcgggatgaacccaatatgaatcctaagctggaagatcccagaagacccgatacttcctttctttggttcaccagtccttacaagactatgaagttcatcctctggcggaggttccgttgggctataattctgttcattatcctgtttattctgcttctctttttggctattttcatttatgcctttccgaactacgcggccatgaagttggtaaagcccttctcttag

SEQ ID NO: 3723 - DNA, 6306 bp, Artificial Sequence
  Description of Artificial Sequence: Synthetic coding sequence
atgctgcgggtgttcatcctgtacgccgagaacgtgcacacccccgataccgatatctccgatgcttattgcagtgcggtctttgccggggtgaagaagagaactaaagtcatcaagaatagtgtgaatcccgtgtggaatgaaggctttgagtgggacctgaaggggatccccctggatcaaggatctgagctgcacgtcgtggtgaaggatcatgaaaccatgggccgcaataggtttctaggggaggcaaaggtgccactgcgcgaagtcctggcaactcctagcctgagtgccagttttaatgcccctctgctagacacaaaaaagcagcctactggtgcgtctctcgtgctgcaggtaagttacacacctctgccaggggccgtgccactctttccaccaccaacgcccctggagcccagtcctactctgccagatcttgacgtcgtcgctgataccggtggcgaggaagatacagaagatcaggggctcaccggcgatgaggcagagcccttcttggaccagtccggtgggcccggggcgcctaccacccctagaaaactgccatcccgcccgcccccacactacccaggtataaaacgcaagcgctcagcacccacatccagaaaacttctgtccgataagccccaggacttccagatccgcgtgcaggtgatcgaaggtagacagcttcccggcgtgaacattaagccggttgtgaaagtgactgccgctggtcagaccaagcggactcgcatccacaagggtaactccccactgtttaatgaaaccctgttctttaacctgttcgattcaccgggcgaactttttgatgagcccatctttatcaccgtggtcgatagcagatcactacgcaccgatgccctgctcggcgagtttcgtatggacgtaggcactatttatagagagccccggcacgcctatctgaggaagtggctcctactctcagatcctgacgatttctccgccggtgcacgcgggtatctgaagacctcattatgcgtgctaggaccaggtgatgaggcaccgttggagcgaaaagatcctagcgaggacaaagaagatatcgagtctaatctgttacggcccacaggggtggccctgagaggggcccatttctgcttaaaggtgtttcgggccgaagacctgcctcagatggacgatgctgtcatggacaatgtgaaacagattttcggttttgaatcaaacaagaaaaacctggtggatccttttgtcgaagtatccttcgccggcaagatgctgtgctccaaaattctcgaaaagaccgcgaacccccagtggaaccagaacatcaccctgccggctatgttcccctctatgtgcgagaaaatgcgaatccggattatcgattgggaccgcctgacccacaatgatatagtcgcaaccacttacctcagtatgtccaagatttctgcacccggaggcgagattgaggaggagccagctggagctgtcaaaccatccaaggcatctgacctcgatgactatctaggtttcctcccaacatttgggccttgctatattaatctgtacggttctcccagagagttcacaggattcccagatccatataccgagttaaataccggcaagggcgaaggcgtggcatacaggggcagacttctactttctcttgaaaccaagcttgtcgaacattcggaacagaaggtggaggatttaccagccgatgatatcctgagggtggagaagtatctgcggcgccgcaagtacagcctgttcgccgccttttattcagctaccatgttgcaggacgtggatgacgccatccagttcgaggttagcatcgggaactacggcaacaagttcgatatgacatgtctgcctctcgcttcaacaactcagtacagccgggccgtgtttgacggatgtcactactactacctcccctgggggaatgtaaagcccgtagtcgtcctttcctcttattgggaagatatcagtcaccgaatcgagacccagaatcagctgctggggatcgccgaccgcctcgaagccgggctggagcaggtgcatctggcactgaaggcacagtgctcaaccgaggatgtcgactctctggtggcccagctcaccgatgagctgattgccggatgttctcagcctctcggagacattcatgagactcctagcgccacgcacctggatcaatacttgtaccagcttagaacacaccacttgtcccaaattacagaggccgccttagctttgaagcttggccacagcgagttgccagcagccctggagcaggcggaggactggttgctcaggctcagagccctcgctgaggagcctcagaactccctccctgacattgtcatctggatgctgcagggtgacaagcgggtcgcttaccaaagggtccctgcacatcaggtgttgttctcgcgacgaggcgctaattactgcgggaaaaattgcggaaaactacagactattttccttaagtaccccatggaaaaggtgcctggggcacgcatgcccgtccagattcgcgtcaaattgtggtttggcctgtctgtcgacgaaaaggaattcaatcaattcgctgaaggaaagctcagtgtgtttgcagaaacctacgaaaacgaaaccaaactggcactggtagggaactggggaactacaggcctgacctatcccaagttcagtgatgttacgggtaagatcaaactccctaaagactcttttaggccaagcgctggatggacctgggctggcgattggtttgtttgcccggagaaaactcttctgcatgacatggatgcgggccacctgtcttttgttgaagaagtgttcgagaaccaaacccgtctacccggcggccagtggatatatatgagtgataactacactgatgtgaacggtgaaaaagtactgcccaaggatgatatcgaatgtcccctgggatggaagtgggaggatgaagagtggtcgacagacttgaatagggccgtcgacgaacaaggctgggaatactcaataaccattcccccagagcgcaagcctaagcactgggtccccgccgaaaagatgtattacacacaccggcgccgtaggtgggtccgtttaagacgtagagatctgagtcagatggaagccctcaagaggcaccgtcaggccgaagctgagggtgaaggatgggagtatgcttcattgtttggttggaagtttcatctcgaataccgtaaaaccgatgccttcaggagacggagatggaggcgacggatggagcctctcgagaagactggaccagctgctgtgtttgcgctggagggggcgcttggtggggttatggacgataagtccgaggattctatgagcgtatcaacgctctctttcggtgtgaatcggcctaccatcagttgcatctttgactatgggaaccggtaccacctccggtgttatatgtaccaagcccgcgatctcgcagctatggataaagactctttttccgatccctatgcaatcgtgtctttcctgcatcagagtcagaagaccgtcgtagtgaaaaacaccctgaacccaacctgggaccaaactctcatcttttacgagatagaaatcttcggcgaacccgctacagtagccgaacagcctccaagcatagtggtcgaactgtacgatcacgatacatacggcgcagacgagtttatgggtcggtgtatctgccagccatcactcgaaagaatgccgcgattagcttggtttcccttgacccgcggcagccagccctccggagaactgctcgcaagtttcgaacttattcagcgggagaaaccagccattcatcacatacccggattcgaggtacaagagacgtcgagaatacttgacgaaagtgaagacactgacctcccctatcccccaccccagcgggaagctaatatctacatggtccctcagaacattaagccagcgcttcagagaacagcaatcgaaatcctggcgtggggacttaggaatatgaagagctaccagctagctaatattagttcgccctctctcgtcgtagagtgtggaggtcagaccgtgcaaagttgcgtgatcaggaacctccgtaagaatcctaactttgacatctgcaccctgttcatggaggtcatgctgcccagggaagagctgtactgtcctcctataacagtgaaagtgattgacaaccgccagttcggcaggcggcctgtagtggggcagtgcactatccggtctctggagtcctttctgtgtgacccttactcagcagagtctccctcgcctcaggggggtcccgatgatgtgtcactcctgtctccaggagaagacgtgttgatagacattgatgacaaggagcccctgattcccattcagctggcagacggactgagctcactggcacctacaaacactgcgtctcctccaagtagccctcacgaggaggagttcatcgattggtggtctaaattttttgcctctatcggggaaagagaaaaatgcggaagctacctggaaaaggatttcgacactctgaaggtgtatgacacccagctcgaaaatgtagaagcttttgagggattgtcggacttttgcaatacatttaagctctacagaggaaaaacacaggaggaaactgaagacccctctgtcataggcgaattcaaaggtctcttcaagatttaccccctccccgaggacccagcgatacctatgccgccacggcagttccatcaactggctgcgcagggccctcaggagtgcctggtgcgtatatacattgtcagggccttcggtttgcagccaaaggatcccaatggtaagtgtgatccatacatcaagatctcaattggaaagaaatccgttagcgatcaggataactacatcccttgtaccttggaacccgtattcggaaagatgtttgagcttacttgcactcttcccttggaaaaagacctaaaaatcaccttgtatgactacgacttgctgtccaaggatgagaagatcggggaaacagtggtggatctggagaacagactgctcagcaagtttggagcacgctgtggtctacctcaaacctattgcgtgagcggccctaatcaatggcgagatcagttaagaccttctcagctgctgcatctcttttgtcagcaacatagggtgaaagcgcctgtgtacagaaccgaccgggtcatgttccaggacaaggaatattccattgaggagattgaagcaggtagaattccaaatccacacctgggacctgtagaagagcgattggccttacatgttctgcaacagcaagggcttgtcccggagcacgtagaatcaagacccctctactctcctctgcagccggacattgagcaaggcaagcttcagatgtgggtcgacctcttccccaaagcactgggtaggcctgggcccccctttaacattactccgaggcgcgccagaaggtttttccttagatgcattatctggaacacccgtgacgtaattctcgacgatctctctctaacaggcgagaaaatgagcgacatctatgtcaagggatggatgataggattcgaggagcacaagcaaaaaacagacgtccactatcggtcactgggaggcgaaggcaacttcaattggcgatttatattccccttcgattatttaccagcagagcaggtgtgtaccatcgctaaaaaggatgccttttggcgactggataagacagaaagcaagattcctgcgcgagtggtctttcagatttgggacaacgacaaattcagctttgacgatttcctcggttcccttcagctggatcttaacaggatgcctaagcctgcgaagacagctaaaaagtgttccctggaccagctggacgacgcctttcatccagagtggttcgtatcactgttcgagcagaagacagtcaagggttggtggccttgcgtggccgaagaaggagagaagaagatcctggcgggcaagttagagatgaccctagaaatcgttgccgaatcagagcatgaagaacgaccagcagggcaaggacgtgatgagccaaatatgaatcccaagctggaagaccccagacgacctgacacctcgttcctgtggtttacatccccatacaaaaccatgaagttcatcctgtggcggcgattcaggtgggccattatcctgtttattattctgtttatccttctgctattccttgcaatatttatttatgcgttcccaaactacgcagcaatgaaattggttaagcctttctcatag

SEQ ID NO: 3724 - DNA, 447 bp, Artificial Sequence
  Description of Artificial Sequence: Synthetic coding sequence
atgggctaccccgaggtggagcggcgggagctgctgcccgccgccgctcccagggagagggggtcccaggggtgcggttgcggcggggcccccgcgagagccggggaaggtaattcgtgcctcctcttcttgggattttttggcctttcccttgcactgcacctgttgactctgtgctgctaccttgaactgcgttctgagttgcgccgcgagagaggcgccgaatctcgacttggcggctctgggacccccggtactagtggcaccctctcaagcctgggcgggctcgaccccgatagtccaattacatctcacctggggcagcccagccctaaacagcaacccttagagcccggtgaagccgcgctgcattctgactcccaggatggccatcaagactttgactacatcatttcctttagctacggtctgcaggggttttgctag

SEQ ID NO: 3725 - DNA, 1176 bp, Artificial Sequence
  Description of Artificial Sequence: Synthetic coding sequence
atgggctaccccgaggtggagcggcgggagctgctgcccgccgccgctccccgggagcgggggtcccagggctgcggctgtggcggggcacccgctagagctggtgaaggaaattcctgcttgctgttccttggattctttgggctatccctggcattgcaccttttgaccctatgctgttatcttgagctccgaagcgagttgcggagagaacgaggcgcagaaagcagactaggtggcagcggtacaccaggaacatcaggaaccctttcctccctcggaggtttggatcctgattcgccgatcacatcccacctggggcaaccttcacccaaacaacaaccgttagagcctggggaggcagctctgcactccgattcccaggacggccatcagatggcacttctgaactttttcttccccgacgaaaagccatacagcgaggaagagtcccggcgcgtgcgtcggaataagcgctctaagtccaacgagggagccgatggccccgtgaagaacaagaaaaaaggcaaaaaggcagggccgcccggccccaacggcccgcctgggccacctggtcccccagggccgcagggaccaccaggcattcccggcattcccggaattcccggaacgacagtcatgggcccacccggacccccagggccacccgggccccagggcccgccaggactccaggggcccagtggggcggcagataaagcgggcacgcgggaaaatcaacccgcagtggtccatctccaagggcaagggtcagcaatccaggtaaagaacgacctatcagggggggtcctgaatgattggtcaagaataacaatgaatccgaaggtgttcaagctgcatcctcgcagcggggaactggaagtgctcgtggacggcacttatttcatctattcccaggtggaagtatactacatcaattttactgacttcgcaagctatgaggtcgttgtcgacgagaaaccatttctccagtgtactagaagcatagagactgggaaaaccaattacaacacctgttatacagccggagtctgtctgctgaaggcacgacagaaaattgctgtcaagatggtgcacgctgatatcagtattaatatgagcaagcacaccacattcttcggagctatcaggctgggagaggcccccgccagctag

SEQ ID NO: 3726 - DNA, 1170 bp, Artificial Sequence
  Description of Artificial Sequence: Synthetic coding sequence
atgggctaccccgaggtggagcggcgggagctgctgcccgccgccgcgccacgcgaaagaggtagccagggatgtgggtgtggcggcgctcctgcccgggctggggaggggaacagttgcctgctttttctcgggttctttgggctctctttggctctgcacttgctgaccctttgctgctatctggagctgcgtagcgaattgcgacgtgaacgaggtgccgagtcccgtcttggcggaagcggaactcccgggacaagcgggacactgtctagcctgggtgggcttgacccagactctccaatcacaagtcacctagggcaaccatctcccaaacaacagccactggagcccggtgaagcagcactccatagtgacagccaggacggccaccaaatggcgcttctaaacttcttcttccccgacgaaaaaccctattccgaagaagaatcaaggagggtgagacgtaacaaaaggtctaaatcaaatgaaggggctgacggccccgtaaagaataaaaagaagggtaagaaagccggccctcctggtccaaatggcccgccgggcccgccaggcccccctggcccccaaggacccccaggtatccccgggatcccaggaatccctgggaccaccgtgatgggaccccctgggcctcctggacctcccggtccacaaggtcctcctgggctgcaggggcctagcggtgcagcggacaaagctggcaccagggaaaaccaacccgcggtcgtacacctgcagggacaagggagtgcaattcaggtgaagaacgatctctcaggaggcgtgctgaacgactggagccgcattacaatgaatccaaaggtcttcaaactccaccctcggtctggagaattggaggtgctcgtggatgggacctacttcatctactcacaggtctactacataaacttcaccgatttcgcctcctatgaggtcgtcgtggatgagaaaccatttcttcaatgtacccgaagcatcgagacaggcaagactaactataacacatgttacactgccggggtatgtttgcttaaagcccgtcagaaaatcgcagtgaaaatggtgcacgcagacatttccatcaacatgagtaagcatacaacgttcttcggcgccatccggctcggagaggcaccagcgtcatag

SEQ ID NO: 3727 - DNA, 408 bp, Artificial Sequence
  Description of Artificial Sequence: Synthetic coding sequence
atgggctaccccgaggtggagcggcgggagctgctgcccgccgccgccccacgagaaaggggctcacaaggctgcggttgcggtggtgcccctgccagagccggtgaaggcaattcatgcttgttattcctgggcttcttcggattaagtctggcgctgcacttgctgaccttgtgttgctatttggaactgagatcggaattacggcgcgagcgaggagcagagtcccggcttggagggtctggtacacccgggacctctggaaccctttcttccctaggggggctggatccagatagccccattacttctcacttggggcagccaagccctaagcagcagcccctggagccaggcgaagcggctctgcacagcgactctcaagacgggcatcagggtcaccaatag

SEQ ID NO: 3728 - DNA, 1161 bp, Artificial Sequence
  Description of Artificial Sequence: Synthetic coding sequence
atgggctaccccgaggtggagcggcgggagctgctgcccgccgccgcaccacgtgaacggggaagtcaggggtgcgggtgtggaggtgctcctgcccgggcgggcgagggcaatagctgtttacttttccttggcttctttgggctgtctttggccctccatctgctgactctctgctgctatctggaactaagatccgagttgcgcagggagcggggagctgagtccagactcggcggatccggaactcccggcacctccgggactctcagctccctgggcggcttggatccggatagcccaatcacgtctcatctggggcagcctagcccaaaacagcagcctctcgaacctggggaggcagcattgcattccgatagccaagatgggcatcagatggcgttacttaatttttttttccccgacgagaagccatattccgaggaagagtctcggcgagtgcgtcgaaacaaacgctcaaagagcaacgagggtgctgatgggcctgttaaaaacaaaaaaaaagggaaaaaagctggacccccaggccccaatggccctcccgggccccccgggccgcccggtccacagggaccacccggaattcccggtattcctgggatacccggaacaacagtgatgggtcctcccgggccacccggcccgccagggccacagggccccccaggactccaggggccttccggagccgctgataaggccggaacccgggaaaatcaaccagcggtggtgcacctgcagggccaggggagtgcaatacaggttaaaaatggtggggtgttaaatgactggtcgaggatcaccatgaaccctaaggtgtttaagcttcacccacgcagcggagagctagaggtgctggttgatggcacttactttatttattcacaggtgtactacatcaacttcacagacttcgcgagctatgaagtggtggtagacgaaaagccattcttgcagtgtactcggagtatcgagactggtaagacaaactataacacatgttacaccgcgggagtgtgcctgctaaaggcccggcagaagatcgctgtcaagatggtacatgctgatatcagcatcaatatgtctaaacataccaccttctttggagccatcaggttgggggaggcgccggcaagctag

SEQ ID NO: 3729 - DNA, 447 bp, Artificial Sequence
  Description of Artificial Sequence: Synthetic coding sequence
atgggctaccccgaggtggagcggcgggagctgctgcccgccgccgctccaagggagagaggatcacagggatgcggttgcgggggtgctcccgccagggccggcgaggggaatagctgtcttttgttcctggggtttttcggcctctcgctggcgctccatctgttaaccctgtgctgctacctggagttaagaagcgaattgaggcgggagcgcggtgcggagagtagactcgggggatccggcacccctggtacatcaggcacactgtcaagtcttgggggccttgaccccgacagtccaataacatcccacctcgggcagccttcacccaaacaacaaccgctggaacccggcgaagccgcactgcactctgatagccaggatgggcaccaagattttgactatataatttctttttcatacggccttcagggtttctgctag

SEQ ID NO: 3730 - DNA, 3429 bp, Artificial Sequence
  Description of Artificial Sequence: Synthetic coding sequence
atgctggtgctgcggtgccggctgggcaccagcttccccaagctggataaccttgtgccaaaggggaagatgaagattctgctggtctttttgggactgttggggaacagcgttgccatgccgatgcacatgcctaggatgcccggtttctcctccaaaagtgaggagatgatgcggtataatcaatttaactttatgaatggaccccacatggcccacctcggccctttctttggaaatggcctcccccagcagttcccacaataccaaatgcctatgtggcctcagcctcccccaaatacgtggcatccccggaaatcttctgccccgaagcgccacaataaaactgatcagacgcaggagactcaaaaaccgaatcagacacagtctaagaaacccccccagaaacgtcccctcaagcaaccctcccacaaccaaccccaacccgaggaggaagctcagccacctcaggctttcccaccctttgggaacggcctctttccctatcagcagcccccatggcaaatcccgcagcgactcccgccgcccggatatggaagaccgcctatctctaatgaggaaggcgggaacccttacttcgggtatttcggttatcacggctttggcgggaggcccccctattacagtgaggagatgtttgaacaggatttcgagaaacctaaagaggaagaccccccaaaggccgagagtccaggtaccgaacctaccgccaactccactgtaaccgaaacgaattctacgcagccaaaccctaagggatcacagggcggtaatgatacttcaccaacgggcaactctaccccgggactgaatactggcaacaacccacctgcgcaaaatggaataggacctcttcccgctgttaacgcttccgggcagggggggcccggctcccagatcccatggcgaccaagccaacccaacattagggagaatcatccctacccaaacattagaaacttcccttcaggtagacagtggtactttacggggactgtgatgggacatcgccagaatcggccattctatagaaatcagcaagtccaacggggtcccaggtggaatttcttcgcttgggagcggaaacaagtggcccggcccgggaaccctgtgtatcacaaagcatatccacctacatcccggggaaattaccctaactacgccggtaacccagctaacctgcggcgaaagcctcaggggccaaacaaacacccagtaggcacaactgtggctcctcttggacccaaacccggcccggtggtacgcaatgaaaaaattcagaatcccaaggagaaaccactggggccgaaagaacagattatcgtccccactaagaatccaacttccccgtggcgaaacagccagcagtatgaagttaacaaaagcaattacaagcttcctcactcagaaggctacatgccagtacccaacttcaattcggtggaccagcacgaaaactcgtactacccaaggggcgattcaagaaaagtgccgaattcagacggccagacccagagtcagaaccttccaaagggtattgtcctggggtctaggcgtatgccatatgagagtgagactaatcagtccgaactcaagcacagtagttatcagcccgccgtgtatcccgaggaaatcccgtcccccgccaaggagcacttcccagcgggcagaaacacttgggatcaccaggaaatcagtccccctttcaaagaagatccagggcgtcaggaagaacacttgccccaccctagtcatggctcccgaggctcagtcttttaccctgaatacaatccatacgatccccgcgagaatagtccctacctcagaggcaacacatgggatgaaagagatgactcccccaacactatgggacagaaggagagtccgctgtatccaattaacactccagaccaaaaggagatcgtcccctacaatgaagaagatcctgtggatccaaccggtgacgaggtttttccaggccagaatagatggggtgaggaattaagttttaaaggaggccccaccgtgcgtcattatgagggagagcagtatacatctaatcagccaaaagagtatctgccttattctttagacaacccttcaaagcctcgggaggacttctattattccgagttttatccctggagcccggacgaaaattttccatcatataacactgcatcaacaatgcccccacccatcgaatccagaggctattatgtcaacaacgccgctggaccagaggagagtaccctgttcccgagccgcaatagttgggatcacaggatccaggcacaaggacaaagagaacgcagaccctactttaatcggaatatctgggatcaagccacccatctccagaaggcccccgccaggcctcctgatcagaagggcaatcagccctactacagtaatacaccagcaggtctccaaaagaatccgatttggcacgagggagagaatttaaactacggaatgcaaatcaccaggatgaactcgcccgagagggagcacagcagcttcccaaattttattcccccgtcctaccctagcggccaaaaggaagctcacctgtttcatctcagccagcgcgggtcatgctgcgctggctcctcgacaggccccaaggataaccccctggctctgcaggattacactccatcctacggcctggcccccggcgagaatcaagatacctcccctttgtataccgacggctcacacaccaaacaaactcgagatatcatttcgccaactagtatcttgcctggccagaggaattcctcagaaaagcgcgagagccagaacccgtttcgggacgatgtttccactctcagacgcaacactccgtgttcaattaagaaccaactggggcaaaaagagattatgccattccccgaagcatcctccttacaaagcaaaaacaccccctgtttgaaaaacgatctgggtggagacggaaataacatccttgagcaagtcttcgaggacaaccagctgaacgagaggacggtagatctcacccccgaacaactggtcataggcacaccagacgaagggagtaatcctgagggtatccagtctcaggtgcaggagaatgagtcagaacgccagcagcagaggccctccaatatattgcatttgccatgttttggatccaagctggctaagcaccattcctcgacaactgggacaccttcgagcgacgggaggcagagccccttcgacggtgatagcattacaccaacagaaaaccccaacaccctagtggagcttgccaccgaggagcagttcaagtcaatcaacgtggatccacttgacgcggacgagcactctcccttcgaattccttcagcgcggcactaatgtgcaggatcaggtccaagactgtctgctgttacaggcatag

SEQ ID NO: 3731 - DNA, 582 bp, Artificial Sequence
  Description of Artificial Sequence: Synthetic coding sequence
atgggcgtgcacgagtgccccgcctggctgtggctgctgctgagcctgctgtcactccctctgggtctcccggtgctgggggcacctcctcggcttatttgcgacagtagggtgctagagcgatacctgctggaggcgaaagaggcggagaacatcactactgggtgtgctgaacattgtagtctgaacgaaaatatcaccgtgcccgataccaaggtgaatttctacgcctggaaacggatggaggttggtcagcaggccgtagaagtatggcagggcctggccctcttgtcagaggccgtacttagggggcaggcgcttctggtgaattctagccagccttgggaaccattacaactccacgtggataaggccgtgagcgggctgcgctcactcactacactgttaagagcccttggcgcccaaaaggaggccataagcccacccgacgctgctagcgcagcccccctaagaactattactgccgacactttccgaaagttattcagggtctattcaaatttcttgcggggaaagctgaagctgtataccggggaagcctgccgcaccggggatcggtag

SEQ ID NO: 3732 - DNA, 192 bp, Artificial Sequence
  Description of Artificial Sequence: Synthetic coding sequence
atgcccagcagcgtgagctggggcatcctgctgctggccggcctgtgttgtctggtgccagtgtccctagctcatggggaaggaacttttacgagcgacttatccaagcagatggaagaggaagcagttcgattattcatcgagtggctgaaaaacggagggcctagttccggcgctccccctcccagctag

SEQ ID NO: 3733 - DNA, 1050 bp, Artificial Sequence
  Description of Artificial Sequence: Synthetic coding sequence
atggaggccgtgaaggccgaggcctgggagggcgccgccgtggcccaggaccttttggctctgggttacgggggcgtgccaggtgcagcttcccgaggagcaagttgccccgatttcaggggtctgtgtgtacgcttggccgccgaactcgcaaccctcggggccctggagcagcagagagaagccggcgccgaagtccttagcgccggcgatggaccaggcgcagaggaggacttcttgagacaattgggctcgttgcttagagagttacactgtccggaccgtgctctctgtggtggcgatggcgccgccgctctgcgggagccgggcgcaggactgaggttgctaagattcctctgttctgaactgcaagcgacaaggttgctgtgtctgcggtcgctgctcgatcctagccctcgccctcccttgggggaaggcgttgtggagggagccggcatggtccaagagctggacctaactcttcaggccctgggcttgccacggcccgctcctggaaccccagcatctcaattgttacaggaactgcatgcgaagatttccgagctgcagccctcattgcctcccggcagtctgcagcctttacttagctgctcccttgacgccccaaggtgggaggccctggagtcattgagtcaatcactgagagaccagtaccgctgtcggagatgcctgctcctcaagaggctagacctgaccacctcagctttccattggtctgatagagctgaggcacagggagaagccatgagggcggtgctgatccccattagggaagtgctgacacctgagagtgatatctctatcgcacacgttctggcagcccgggctgatttaagctgcctggtgccggccacttccgtcgcagttcgacgaggcacctgctgcgctatcaacaaggtactgatgggcaacgttcctgaccgcggcggccgaccaaacgagcttgagccccccatgccgacctggcgcagcaggcgagaggacggaggccctcagtgttggggccggaagaaaaagaagaaaaaatag

SEQ ID NO: 3734 - DNA, 804 bp, Artificial Sequence
  Description of Artificial Sequence: Synthetic coding sequence
atggaggccgtgaaggccgaggcctgggagggcgccgccgtggcccaggatctgttagcacttggctacggaggcgtgcccggggccgcatcacgcggagcctcgtgtcctgactttagagggctctgtgtgaggcttgccgctgagttggccacattgggggccctcgagcagcagcgggaggccggggccgaggtgctgagcgcaggagatggcccaggtgcagaagaagactttttgagacagctcggttcccttttgcgcgaactccactgtcccgaccgggccctctgtggcggcgatggagccgctgccctgcgcgagcctggcgctggcttgaggctcctgcggtttctgtgttccgaattgcaggcaacacgcctgctatgtttgcggtcactgctggatccgagccctcgtccccctttgggagaaggcgtggtggagggagcagggatggtacaagaactagaccttactcttcaggcacttggtctgcctcggcccgcacccgggacccctgcatcccagctgctacaagagctgcatgcgaaggaggcccttgagtccctgtcccagtctctcagggaccagtaccgctgtagaagatgcctcttattgaagcgactggacctgaccacatccgccttccactggtctgacagagcagaagtgctgatgggaaacgtgcctgatcgtggaggcagacctaatgagcttgaacctcctatgccaacttggcggtcgcgccgagaggatggtggcccgcagtgctggggccgtaaaaagaagaaaaagaagtag

SEQ ID NO: 3735 - DNA, 2601 bp, Artificial Sequence
  Description of Artificial Sequence: Synthetic coding sequence
atgttcagcatgcggatcgtgtgcctggtgctgagcgtggtgggcactgcgtggactgccgactcaggcgaaggagactttctggcagagggaggcggagtgcgaggccctcgcgtcgtggaaagacaccagtctgcctgtaaagactctgattggccattctgctctgatgaagattggaactacaaatgtccaagtgggtgcaggatgaaaggactgatcgacgaagtgaaccaggacttcacgaacagaataaacaaactgaaaaactctcttttcgagtaccagaagaataacaaggactcacattcattaactacaaacatcatggagattctgaggggcgacttctccagcgccaacaatcgggacaatacttacaaccgggtgtccgaggatttaaggagcagaatagaggtgctgaagcggaaggttatcgagaaggtgcagcacatacaattgctccaaaaaaacgtcagggcgcagctggttgacatgaaacggcttgaggttgacatcgatataaaaattcgtagctgtcgcggatcttgctcacgggccctggctagggaggtagatctgaaagattacgaagaccagcaaaaacagttggagcaggtgatcgcaaaggacttgcttcctagcagagataggcagcacctgccattaattaaaatgaagcctgtaccagatttggtgcccggcaacttcaaaagccagctgcaaaaggtaccacccgagtggaaggcactgaccgatatgcctcagatgagaatggaattggagcgccctggtggcaatgagatcaccaggggcggctcaaccagctacggaaccgggtctgagaccgaaagcccccggaatcctagctctgccgggtcctggaactctggctcctccggcccggggtccaccgggaatcgcaaccccgggtccagcgggactggggggactgctacctggaagccaggttcttcgggccctgggtccaccggcagctggaacagtggctcctctggcacgggcagtacgggaaatcagaatcccggctctccgcgacccgggtcaaccgggacatggaaccccggctcaagtgaacgcggatcggccggtcactggacatccgagagcagcgtctcaggaagcacaggacagtggcactccgagtcgggatcctttaggccagacagccccggttcaggcaacgcccggcccaataatccggattggggaaccttcgaagaagtatcaggcaacgtctcccctggtacccggcgcgagtaccatactgagaagttggtgacgagcaagggagataaagaactgcggactggcaaggaaaaagtgaccagcggaagcacaaccactactcggagaagctgtagcaagaccgtgaccaagactgtcattggccccgacggccacaaagaagtaactaaggaggttgtgacttcagaagacggatccgactgccccgaggccatggatctcggtactctgtctggaatcggcactctagatggctttcgccatcggcacccagatgaggctgcattcttcgacaccgcatctaccggcaagacgtttccaggcttttttagtcctatgctcggtgagttcgtttccgagaccgaatcacggggatcagaaagtggtattttcaccaatactaaagagtccagcagccaccaccctggcatcgcagagtttcccagccgtgggaagtcctcatcttattcaaaacagtttactagctccacaagctataaccggggcgactcaacattcgaatctaagtcttacaaaatggctgatgaagccggttccgaggccgatcacgaaggcactcactcgacaaagagagggcacgcaaagtcgaggcccgtcagggattgtgatgacgtgttgcagactcatccatcgggcacccagagcggcattttcaatatcaaactcccagggagctctaagatatttagcgtctactgcgatcaagaaactagtctcggtggatggcttctcatccagcagaggatggatgggagcctgaatttcaatcggacatggcaggactataagaggggttttggcagcctcaatgatgaaggcgagggcgaattttggctgggaaatgattacctccatcttctcacccaacgaggctctgtgctgagagtggagctagaggactgggctggtaatgaagcttacgctgagtatcactttcgggtgggaagcgaagcggaggggtacgcactccaggtgtctagctatgaaggcacggccggggacgctctgatcgaggggagtgtcgaagaaggcgccgagtacactagtcacaacaacatgcaattttctacattcgacagggatgcagatcagtgggaggaaaattgcgctgaggtgtatggaggtggatggtggtacaacaactgccaggcagccaacctgaatggtatttattacccagggggttcctatgatccacgcaataactcaccctatgaaattgaaaacggagtggtgtgggtgagcttccgtggagccgactattcacttcgggccgtgaggatgaagatcagacctttagttactcagtag

SEQ ID NO: 3736 - DNA, 1935 bp, Artificial Sequence
  Description of Artificial Sequence: Synthetic coding sequence
atgttcagcatgcggatcgtgtgcctggtgctgagcgtggtgggcaccgcatggactgccgactctggtgagggcgatttcctggccgaaggtgggggagtgcgcggaccgagggtcgttgagcggcatcaatctgcctgcaaggactcagattggccattttgttcggacgaggattggaattataagtgtccatctggctgcagaatgaaaggcctgattgacgaagtgaaccaggatttcacaaacagaatcaacaagctcaagaatagtctgtttgaatatcaaaaaaataacaaagactcacacagcctgaccaccaacatcatggagatactacgcggcgattttagctctgctaacaaccgcgataatacctacaacagggtctccgaagacttgagatcacggatagaagtgctcaagcgcaaggtgatcgagaaggtccaacatattcagctcctgcagaaaaacgtgagagctcagttggtcgacatgaagcggcttgaagtggatatcgatatcaagatcaggtcctgtcgcgggtcttgcagccgggcacttgctagagaagtcgacctgaaggactacgaggatcagcagaaacagctggagcaggtgatagcgaaagacttgctgccctctagggacagacagcatctgcctctcatcaaaatgaaacctgtgcctgacctcgtcccaggtaacttcaagtcccagctccagaaggtccccccggagtggaaggccctaaccgacatgccacaaatgcgcatggaacttgaacggcctgggggaaatgagatcacacgtggtggctccacttcatacggtacaggctctgagaccgaaagtcctaggaaccctagctccgcgggcagctggaatagcggctcctctggccctggaagcaccgggaatcggaaccccgggtcatccggaactggcggaactgctacttggaaacccggatcaagtggcccgggcagcacaggctcatggaactcaggctctagcggaacaggctctacgggcaaccagaatcccggctccccccggccaggaagcaccggaacctggaacccgggatctagtgagagaggcagcgctggccattggacaagtgaatcatctgtttccggaagtaccggtcaatggcactctgaatcaggtagctttagacctgactctccagggagcggaaacgcacggccgaacaaccccgactgggggaccttcgaggaagtgtcagggaacgtttctccagggactaggagggaatatcacaccgagaagctggtcaccagcaaaggagataaggagttaaggactggaaaggagaaagttaccagtggctccaccactaccacaaggcgatcttgctccaagacggtgacgaaaacagtgattggcccagacggacacaaggaggtaacaaaagaagtggtgacctcagaggacggctcggattgccccgaggctatggacctcggaacactcagtgggattggcaccttggatggatttaggcaccggcaccccgatgaggcagcgtttttcgacactgcttctacgggcaaaacattccctgggttcttttctcccatgttgggtgaatttgtgtccgagacggaaagcaggggcagtgaaagcgggattttcactaatacaaaggaatctagttcacaccacccaggtattgctgagtttccgtcacgcgggaagtcctcatcttacagtaagcagttcacctctagcacatcttacaaccgtggagattcaactttcgaaagcaagtcatacaaaatggctgatgaggcagggagcgaagccgaccatgaagggacacacagcacaaaaagaggacatgccaagagtagacccgtccgggggattcacacttcaccattgggcaaaccgtcactgagcccatag

SEQ ID NO: 3737 - DNA, 870 bp, Artificial Sequence
  Description of Artificial Sequence: Synthetic coding sequence
atgttcagcatgcggatcgtgtgcctggtgctgagcgtggtgggcaccgcatggaccgcagactccggggagggtgacttccttgctgaaggcggaggtgttcgaggcccacgggtggtcgagagacatcagtctgcctgcaaagatagcgattggcctttttgttccgatgaggattggaattacaagtgtccgtctggctgcagaatgaagggcctaatcgatgaagtcaaccaggactttacaaatagaattaacaagctgaagaactccctgttcgaatatcagaagaataataaagattcacattcccttactacaaacataatggaaatcctgcgcggcgacttcagttctgcgaacaacagagacaatacctataatagagtaagtgaggatctgcgcagcagaatcgaggtcctgaaaagaaaggtgatcgagaaggtccaacacattcagcttctccagaagaatgtgcgcgcccagctggtggatatgaagcgactagaagtggatatcgacatcaagataaggtcttgtagggggtcatgcagtagagccctagctcgcgaggtggatttgaaggattacgaggaccagcagaaacagctggaacaagtcattgccaaagacctgttacccgtcgtcaatctccaggtgacagctaataatctcttggtggcccgggtaacgaccgaagagactccacaccttaaagctagagccatcaaatggcagatgagacccgaggttaaacccatcatgaaggagcacattgcacctagagaagccatgctgaacctggccctgtcagaagttagcaccctcctcttatggggctctctgccgtgtcctcctaggcttagctag

SEQ ID NO: 3738 - DNA, 1476 bp, Artificial Sequence
  Description of Artificial Sequence: Synthetic coding sequence
atgaagcggatggtgagctggagcttccacaagctgaagaccatgaagcaccttctgctgctccttctctgtgtcttcctggtgaagtctcagggggtcaacgacaatgaggaaggcttcttcagcgcccgcgggcacaggcctctggataagaaaagggaagaagccccttctttgcgaccagcccccccacccatctcaggtggaggttatcgcgctagacctgctaaagccgccgccacacagaaaaaagtcgagcgtaaggctcccgacgctggaggttgcctgcatgctgaccccgatctgggggtcctgtgtccaacaggctgtcaacttcaggaggccctcttgcagcaggagcgcccgatccgcaattctgttgacgaactgaacaacaacgtggaagctgtatcgcagacatcttcatcatcttttcagtatatgtacctattgaaggatctctggcagaagcgacaaaagcaggtcaaggacaacgaaaatgtagtgaatgagtacagtagtgagctagagaagcaccagctatacattgatgagactgtcaacagtaatatacccacaaacctgcgcgtgctaagatctattcttgaaaacctgcgctcaaagatccaaaagctcgagtcggatgtctcagcacaaatggagtattgtagaactccgtgtactgtttcatgtaatattccagtcgtctctggaaaagagtgcgaagaaataatccgaaagggaggcgaaacaagtgaaatgtaccttatacagcctgactcatccgtgaagccctatcgcgtgtactgtgacatgaataccgagaatgggggttggacagtgattcagaataggcaggatggcagcgtcgatttcggacggaaatgggacccgtataagcagggatttgggaacgttgccactaatacagatgggaaaaattattgtggcctgcctggagagtactggctcggtaatgataaaatctcccaattaactcgaatgggccccactgaactccttatagagatggaagattggaagggcgacaaggtcaaggcccattacggcggatttacagtacagaacgaggcaaacaagtatcagatcagtgtcaataagtacaggggtacggccgggaatgctttaatggacggcgcctcacagttgatgggagagaatcggacaatgacaatacacaacggaatgttcttctcaacatacgacagggataacgatggctggctgaccagcgacccacggaagcagtgtagcaaggaggatgggggcgggtggtggtacaaccggtgccacgcggctaacccgaacggacgctattattggggggggcagtatacctgggatatggcaaaacacggcaccgatgacggagtggtttggatgaactggaaaggcagttggtatagcatgagaaagatgtcgatgaagattcgcccattttttccccagcagtag

SEQ ID NO: 3739 - DNA, 1425 bp, Artificial Sequence
  Description of Artificial Sequence: Synthetic coding sequence
atgaagcggatggtgagctggagcttccacaagctgaagaccatgaagcacctgctactactgctgctgtgcgtgttcttggtgaaaagccagggcgtgaacgataatgaagaagggtttttctctgcccgtggtcaccggccattggataagaaacgtgaggaagcccgccctgcaaaggctgccgcgacgcagaaaaaagtggagcggaaggcccctgatgcgggcgggtgcctacacgccgatcccgatctgggggtgctctgccccacgggatgccagctccaagaggctttgctacagcaggagagacccatccggaattctgtggatgaactcaacaacaacgtggaagcagtgtcccagactagttcctcttctttccagtatatgtacctcctaaaggatctctggcaaaagcggcagaagcaggttaaagataacgagaacgtcgttaacgaatacagtagtgagctggaaaaacaccagttatatatcgacgagactgtgaatagtaatatccccaccaatctcagagtgctaagatccattctcgagaacctgcgatccaaaattcagaagctggagagcgacgtgtccgctcaaatggagtactgccgcaccccctgtacagtctcctgtaatatccccgtcgtttcggggaaagaatgcgaagaaattatccggaaaggcggtgagacgtctgagatgtatctgattcagcccgattcctcagtgaagccttaccgagtgtactgcgatatgaacacagagaacggcggatggacagtgatccagaataggcaggatgggagcgtggattttggacggaaatgggacccctacaagcagggatttggcaatgtggccaccaatacagatggaaagaactattgcgggctacccggagaatactggctggggaacgataaaatttctcagctaactcgcatgggccctacggagctgctgatcgagatggaggattggaaaggcgataaagtgaaggctcattacgggggtttcaccgtgcagaacgaggcaaacaaataccagatcagtgtcaacaaatatcgggggacggccggaaatgcccttatggacggagcctcccagcttatgggcgaaaacaggaccatgaccatccacaacggcatgttctttagcacgtacgatagggataacgatggttggctgaccagtgacccaaggaaacaatgtagtaaagaggatgggggcggatggtggtacaaccggtgccacgccgcaaatcctaacgggcgatattactgggggggtcaatatacctgggacatggccaagcatggtaccgatgatggagtggtgtggatgaattggaaaggaagctggtattccatgaggaagatgagcatgaagataaggcctttcttcccacagcagtag

SEQ ID NO: 3740 - DNA, 1362 bp, Artificial Sequence
  Description of Artificial Sequence: Synthetic coding sequence
atgagctggagcctgcacccccggaacctgatcctgtacttctacgcgctcttattccttagtagtacctgtgtagcgtacgtcgccactcgcgacaattgttgtatcctagacgagcggttcggctcctactgtcctactacctgtgggattgccgattttctgtccacttaccagactaaggtagacaaggatctgcagagcctggaagatatcctccatcaggtggagaataagacttcggaggtcaagcagctgatcaaagcaattcagctaacgtacaatcccgatgagtcctctaaacccaatatgatcgacgccgctacgcttaaatctagaaagatgctcgaagaaatcatgaaatacgaggcatccatcctcacacacgactcaagcatccgttacttgcaggagatttacaatagcaataatcagaaaatagttaatctgaaagaaaaagtggctcagttggaggctcaatgccaagagccctgtaaagacacagttcagattcacgacataaccggaaaagattgtcaagatatcgccaacaagggagctaagcagagcgggctgtatttcatcaaacccttaaaggcaaaccagcagttcctcgtgtattgcgagattgatggctcagggaacggatggacagtgtttcagaaaaggttggatggctcagtggactttaagaaaaactggatccaatataaagagggtttcggacacctgagccccaccggtaccacagaattttggttgggaaatgagaaaattcacctaatctcgacccaatctgctatcccgtacgctttgcgcgtggaacttgaagactggaatggacggacctctacagctgactacgccatgtttaaagttgggcctgaggccgacaagtaccgccttacgtacgcctatttcgccggcggggatgccggggacgccttcgatggatttgatttcggcgacgatccctcagacaagttcttcacatcacataatggcatgcaattttccacttgggacaatgacaatgataagtttgagggaaactgcgccgagcaagatggaagtggttggtggatgaataagtgccatgccggtcaccttaatggcgtttactatcaaggcggcacgtatagcaaggctagcacaccaaacggctacgataacggcataatctgggccacttggaagacccggtggtatagcatgaagaagactactatgaagattattcccttcaaccgactgaccatcggagagggacagcagcaccatctcggcggggctaagcaggtgagaccagagcatcccgccgagaccgaatatgactccttataccctgaagacgacttgtag

SEQ ID NO: 3741 - DNA, 1314 bp, Artificial Sequence
  Description of Artificial Sequence: Synthetic coding sequence
atgagctggagcctgcacccccggaacctgatcctgtacttctacgccctgctcttcctgagctcaacttgcgtggcgtacgtggccactcgtgataactgctgcatcttagatgagagattcggcagttattgtccaaccacctgtgggatcgccgattttctttctacataccagactaaagtggacaaggacctccagtcactcgaggacatcctgcaccaggttgaaaacaaaacttctgaggtgaaacagctgattaaggcgatccagttgacttacaatccagacgaatcttctaagcccaacatgatcgacgccgcaactcttaagtcccggaaaatgctggaggagatcatgaaatatgaggccagcattctgactcatgattctagcataaggtatctgcaagaaatctacaacagcaataatcagaaaatcgtgaacctcaaggagaaagttgcccagcttgaggcccaatgccaagaaccttgtaaagacaccgttcaaattcacgacattaccgggaaagactgtcaggatatcgcaaacaagggggctaaacaatccgggctgtactttatcaagcctttgaaggccaatcaacagttcctagtttattgtgaaatcgacggctccggcaatgggtggaccgtcttccagaagcggctagatgggtctgtggacttcaagaagaactggattcaatataaggaagggttcggccatctaagtcccacggggacaaccgaattctggctcggaaacgagaagattcacttgatttcaacccagtctgctataccctacgctctgcgtgtcgagttggaggactggaatggaagaaccagtaccgccgactacgctatgttcaaggtgggtcccgaagcggataaataccggttaacctacgcttacttcgccggcggcgacgccggtgacgccttcgacggcttcgattttggagatgaccccagcgacaaattcttcacaagtcataacggcatgcagtttagcacttgggataacgataacgataaattcgagggcaattgtgctgaacaagacggctctggctggtggatgaacaaatgccacgctggccacctgaatggtgtgtactaccagggaggaacatattctaaagcctctacacctaatggctacgacaatgggatcatttgggctacttggaagactaggtggtacagtatgaagaagaccaccatgaagataatccctttcaacagactcacaatcggtgagggccaacaacaccacctaggtggcgcgaagcaggcaggcgatgtttag

SEQ ID NO: 3742 - DNA, 2892 bp, Artificial Sequence
  Description of Artificial Sequence: Synthetic coding sequence
atgctgagcggcgagcggaaggagggcggcagcccccggttcggcaaacttcatctgccggtggggctatggatcaattctccgaggaagcagttagccaaactgggaagacgttggcccagcgccgcatctgtgaagagttcgagctccgacaccggctcccgcagcagcgagcccctgcctccgccgcccccacatgtagagctccggcgggtgggtgcagtaaaggcagctggaggagccagcggcagccgcgcgaaacgcatatctcagctgttccgaggatctggtactgggaccactggaagctccggcgctggcggcccgggaacacccggaggcgcccagaggtgggcctcggaaaaaaaactccctgagcttgcagcaggagtggccccggagcctcccctcgcaacccgggcgacagcaccaccgggcgtgctgaaaatattcggggccggcctggcctctggcgccaactacaagtcagtcctggctactgctcgctcaacagcgcgggaactggtggctgaggcattagaaaggtatggactggccggcagcccaggcggggggcccggcgagtccagctgtgtggatgcattcgctttatgcgatgctctgggacgacccgcggctgctggagtgggatccggtgagtggagagccgagcacctcagagtgttaggtgatagcgaaaggccactgctagtgcaagaattatggcgggcacgacctggctgggctagaagattcgaactgcgcgggagggaagaagcacggaggttggaacaggaagccttcggcgctgccgactcggagggaaccggtgcgccaagctggagacctcagaaaaatcggagtagggccgcttctggaggggcggccctggcttctcctggccctgggacaggctcgggggcgccagcaggatccggcggaaaggagcgatctgaaaacttgagtctgcggcggtccgtctcagagcttagtctgcaagggaggcgcaggcgccagcaggaaaggcggcaacaggctctttcgatggccccaggtgcagccgatgctcagataggtaccgcagaccctggagactttgatcagcttacccagtgtctgattcaagcaccgtcaaacaggccatactttttactgttgcaggggtatcaggatgctcaggacttcgttgtgtacgtcatgacgcgcgaacagcacgtgtttggacgcggcgggaactccagcgggcgaggcggttcccccgccccgtatgtagatacctttttgaacgctcccgacatactgccacgacattgcacagtgagagctggcccagagcatcccgcgatggtgaggccaagccgaggagcccctgtgacccacaacgggtgcctgttgctgagggaggcggagctgcatccaggagacctgttgggtctgggcgaacacttcctctttatgtacaaagacccgcgcactggcggctctgggcccgcacgacctccctggttgcctgcacgccctggcgcaaccccacccggtcctggatgggcattcagttgcagactttgcgggcggggtctccaggaacgtggggaagcactggccgcatatctcgatggaagggaacccgtcctccgttttagaccgcgagaggaagaagcactcctaggggaaatagttcgtgccgctgctgctggtagcggcgatctgcctcctctgggccccgccacccttctggctttgtgcgttcagcactcagctcgcgaattagagctggggcacctccccaggttactgggcaggctggcccgactgataaaagaagccgtctgggagaagatcaaagagatcggggaccgccagcctgagaaccatcctgaaggggttcctgaagtgcctctaactccagaggcggtcagcgttgagctaagacctctgatgctgtggatggctaatactactgagctcctgagtttcgttcaagagaaagttttggaaatggaaaaggaggccgatcaggaggacccccagctttgtaatgacctggagctgtgcgatgaggcaatggctctgctcgacgaggtaatcatgtgcacatttcagcagtcagtgtactatttaacaaagaccttgtacagcaccttgcctgcactgttggactcaaacccatttacggcaggagcggagctcccaggaccaggggccgagctgggcgctatgccccctggactcagacccaccctgggcgtgtttcaggcagctctggaactcacatcccagtgtgagttacatcccgatctggtgagccagacgttcggttatttattcttcttcagcaatgcctccttgcttaactcactcatggagaggggccagggtcggccattttatcagtggtctagggctgtacagatccgaacaaacctggatctcgtacttgactggttgcaaggagctggccttggggacattgcaacggagttttttcgcaagctatccatggcggtaaacttactgtgtgtgccaaggacttcgctcttgaaggcctcttggtcaagcctgcggactgatcaccccactttgactcccgctcagttgcaccacttgctcagccattatcagttggggccagggagaggtcctccagcagcctgggaccctccccccgctgagcgcgaggctgttgacacaggagatattttcgagtcattctcttctcatccgccactcatcttacctctcggcagttcaagacttaggcttaccgggcccgtgaccgacgatgctctacatcgagaactccgccggctgagacgtctgctatgggatctggaacagcaggaactgcctgccaattacaggcatgggccgccagttgcgactagcccttag

SEQ ID NO: 3743 - DNA, 630 bp, Artificial Sequence
  Description of Artificial Sequence: Synthetic coding sequence
atggacagcgacgagaccggcttcgagcacagcggcctgtgggtgtccgtactagccgggctgcttctgggagcatgtcaggcccaccccattcctgattcgtccccactcctgcaattcggtggacaagtccgacagcgttatctgtatacagacgatgcacaacagactgaggcccatctggagatccgcgaagatggtacggtgggaggggcagccgaccagagcccagaatcactgctgcagctgaaggccctgaaacctggcgttatccagattctgggcgtgaagacctctagatttctgtgtcaacgaccagatggtgctttgtacggttccctgcatttcgatcccgaggcttgtagcttccgggaacttctgctagaggacggatataatgtgtatcagagcgaagctcacggcctgccacttcacctcccaggcaacaaatcaccccaccgggatccagctccccgaggaccagccagattcctcccactacctgggctcccgccagcactgcccgaacctcccggaatcctggcccctcaacctcccgatgtgggatctagcgacccactgtcaatggtcggcccatcccagggtcgcagcccgtcctatgctagctag

SEQ ID NO: 3744 - DNA, 321 bp, Artificial Sequence
  Description of Artificial Sequence: Synthetic coding sequence
atgctgcggttcatccaggaggtgaacaccaccacccggagctgcgctctctgggacctcgaggaggatactgaatacattgtgcacgtccaggcgatctccatccaaggacagtctcccgcttctgagcccgtgctgtttaagactccccgagaggcagagaagatggcatctaagaataaggatgaggtgactatgaaggaaatgggtaggaatcagcaactaagaaccggggaagtgctgataatcgttgtcgtactgttcatgtgggctggtgtgattgcactattctgccggcaatacgatattattgaggcctag

SEQ ID NO: 3745 - DNA, 414 bp, Artificial Sequence
  Description of Artificial Sequence: Synthetic coding sequence
atgctgcggttcatccaggaggtgaacaccaccacccggagctgcgcgctgtgggacctcgaagaggacaccgagtacattgtccatgtccaagccatctctattcaagggcaatctcccgctagcgagccggtcttatttaaaactcctcgtgaagcggagaaaatggcctctaagaataaagatgaagttacgatgaaagagatgggcaggaaccagcagctacgtactggcgaggtgctgattatcgttgttgtcttgtttatgtgggctggtgtgattgctttattctgtcgccagtatgatattattaaggacaacgaacctaacaacaataaggagaaaacgaagtccgccagtgagacctccactcccgaacaccaggggggtgggctgctccggtccaaaatctag

SEQ ID NO: 3746 - DNA, 390 bp, Artificial Sequence
  Description of Artificial Sequence: Synthetic coding sequence
atgaagaccctgcagttcttcttcctgttctgctgctggaaggccatttgctgtaactcgtgcgagctgacgaacatcacgatagctattgaaaaggaagagtgtcggttctgcatcagtatcaatacgacctggtgcgccggctattgttacacaagggatcttgtgtataaggacccagctcgccctaaaattcagaaaacctgtacctttaaggagttggtgtacgagacggtgcgcgttcctggctgtgcacaccatgcggacagcctgtatacataccccgtcgcaacccagtgccattgcgggaagtgcgattcagatagcacagattgtactgtgaggggactgggaccctcatactgttcctttggtgaaatgaaagaatag

SEQ ID NO: 3747 - DNA, 390 bp, Artificial Sequence
  Description of Artificial Sequence: Synthetic coding sequence
atgaagaccctgcagttcttcttcctgttctgctgctggaaggccatctgctgtaacagctgcgagttgaccaatatcactatcgcaattgagaaagaggaatgtaggttttgtatctcaatcaacactacttggtgcgccggatattgttatacaagggatctggtgtataaggatcccgcaaggccaaagattcagaaaacctgtaccttcaaagagctggtgtacgaaaccgtacgcgttcctggttgcgcccaccacgccgactccctgtatacatatcccgtggcgactcagtgccattgtggaaagtgcgactcagactctacggattgcaccgtgcggggactcgggccaagctactgcagcttcggcgagatgaaagaatag

SEQ ID NO: 3748 - DNA, 390 bp, Artificial Sequence
  Description of Artificial Sequence: Synthetic coding sequence
atgaagaccctgcagttcttcttcctgttctgctgctggaaggccatatgctgcaattcttgcgagctgactaacattacaattgccatcgaaaaagaagagtgccgcttctgcatctcgataaacactacatggtgcgctgggtattgttacacccgggatctggtgtataaggaccctgcccggcctaagatccagaaaacctgcactttcaaggagctggtgtatgagacagtcagagtaccagggtgtgctcaccatgcggattccctatatacctacccagttgcgacccaatgccactgcgggaaatgtgacagcgacagcactgattgtaccgtgcgtgggctgggaccgagctattgcagtttcggagagatgaaggaatag

SEQ ID NO: 3749 - DNA, 1260 bp, Artificial Sequence
  Description of Artificial Sequence: Synthetic coding sequence
atgagcttcatccccgtggccgaggacagcgacttccccatccacaacctgccctacggcgtgttctcaacacgcggggatccacgacccagaattggagtggctattggtgaccaaatactagatttgtctatcattaaacatctgtttacagggcccgtgctgagcaaacatcaggatgtctttaaccaaccaactctcaatagcttcatggggctgggacaagctgcatggaaggaagccagagtatttttgcaaaacttactgtctgtgtcacaagctcgactcagagacgacaccgagctgcggaaatgcgcttttatttcacaagcctctgccaccatgcatttgcccgccacgatcggcgactacactgatttctactcctcgcggcagcatgccactaatgtcggaattatgttcagagacaaggaaaacgcgctcatgccaaattggttgcaccttccagttggatatcatggccgcgccagctccgtcgtggtctcaggcacaccgatcagaagacccatgggccagatgaaacccgacgacagtaaacccccggtctatggcgcctgtaaacttctggatatggagctggaaatggccttttttgtggggcctggcaaccggcttggggaaccgatcccaatctcaaaggcccacgaacacatttttggcatggtactcatgaatgactggagtgcaagagacatccagaagtgggagtatgtccccctgggtcctttcctaggtaagtcatttggaactactgtgagcccctgggtagtgcctatggatgcccttatgccattcgccgtgcctaatcccaaacaggatcctcggccacttccctatctgtgccacgatgaaccttatacttttgatatcaatctctctgtcaacctcaaaggagaggggatgtcccaggcagcaaccatttgtaaaagcaattttaaatacatgtactggactatgctgcagcaactaacacatcactcagttaatggctgcaacctgcggccgggcgatctgcttgcatcagggacgatctccgggcctgagccagagaacttcggcagtatgcttgagctgagctggaagggcactaaaccaatcgaccttgggaacggtcagacgcgtaagttcctgctggacggcgacgaagttataatcaccggctactgccagggcgacggatacaggatcggttttggccagtgcgctgggaaagtgttacccgccctcctgccaagttag

SEQ ID NO: 3750 - DNA, 1260 bp, Artificial Sequence
  Description of Artificial Sequence: Synthetic coding sequence
atgagcttcatccccgtggccgaggacagcgacttccccatccacaatctgccatacggcgtcttcagcacccggggggatccaaggccaaggatcggcgttgccatcggcgatcagatcttggatctgtctattatcaagcatctgttcactgggcctgttctatccaagcaccaggacgtatttaatcaacctactctgaacagctttatgggactgggccaggccgcctggaaggaggccagggtgtttctgcagaacctcttgagtgttagtcaggcgcgcctccgggatgatacagaattacggaagtgtgctttcatcagccaggcctctgctaccatgcatttaccagctactatcggagattatactgatttctactcttcccgccaacatgccacaaacgtgggcataatgtttagggacaaagagaacgccctcatgccaaattggctccacttgccggtgggatatcacggcagagcatcttctgtggtggtgagtggtaccccaatacggaggcccatgggccagatgaagcctgacgacagtaaacccccagtgtacggcgcctgcaagctgctggacatggaactagagatggcttttttcgtgggacctggcaatcgcctaggggagcctatacctatttctaaggcccacgagcacatttttggcatggtgttaatgaacgactggtcggcaagagatattcaaaaatgggaatacgtgccactcggaccctttctgggaaagtcctttggaacaactgtgtctccttgggttgtgccaatggacgcccttatgccctttgccgtaccaaatcccaagcaggatccacgccctctcccttacctgtgccacgatgagccctatacttttgatatcaacctttccgtcaatctaaagggggagggcatgtcacaggccgcgaccatctgcaagagcaactttaagtatatgtactggaccatgttgcagcagttgactcatcatagcgttaatgggtgcaatctgcgcccaggggacctactggcctccggcacaatcagtggtccagaacccgagaattttggatccatgttggagttgtcttggaaaggcacaaagccaatcgacttgggaaacggacaaactcggaagttcctcctggacggggatgaggttatcattactggctattgccaaggggatggataccgtattggcttcggtcagtgtgcaggcaaagttctgccagcattgttacccagctag

SEQ ID NO: 3751 - DNA, 1260 bp, Artificial Sequence
  Description of Artificial Sequence: Synthetic coding sequence
atgagcttcatccccgtggccgaggacagcgacttccccatccacaatctcccctatggggttttttccacaagaggcgaccctagaccacggataggcgtcgctatcggagatcagatcctcgatctttcaattatcaagcacctcttcacgggtcccgtgttgtctaagcaccaggatgtgttcaaccagccgacactgaattcgtttatgggcctaggccaggccgcctggaaagaagctcgagtgttcctccaaaacctgctctccgtgagccaggcccgcctgagggacgacactgaacttcgaaagtgcgcctttatctctcaggccagcgctaccatgcatctgcccgcaaccattggtgattatacagacttttattcctctcgtcagcacgctacaaatgtgggcattatgtttcgcgataaggaaaacgccctcatgcctaactggctgcatctgccagtggggtaccacgggcgtgcttcgtccgtcgtggtgagtggcactcctatcaggcggcctatgggacagatgaagcctgacgactcgaaaccgcctgtgtacggggcctgtaagttattagatatggagttggaaatggccttcttcgtaggccccggcaataggttaggggagccgatacccatttccaaagcccatgagcacatctttggcatggttcttatgaatgattggagtgctcgggacatacagaaatgggaatatgtgcccttggggcctttcttgggaaaatcattcggtacaaccgtgtcaccatgggtggtgcctatggacgcccttatgccattcgcagttccgaatccaaagcaggatcctcgacctctgccgtacctttgtcacgacgagccttatacgttcgacatcaatcttagtgttaatctaaaaggagaaggcatgtcacaggccgcaaccatctgcaaatccaatttcaaatacatgtactggaccatgctgcagcagctcacccaccattccgtgaacggatgtaatttgcggcccggagacctgctggcgtccggtaccatcagcggcccagaaccggagaactttggaagcatgttagagctctcttggaagggcactaagcccatcgatctaggaaatggccaaacccgaaaatttttgctagacggcgacgaggtgatcattacagggtattgtcagggggacggctacaggatcggcttcggacagtgcgccggcaaggtgctcccggcgcttctacccagctag

SEQ ID NO: 3752 - DNA, 759 bp, Artificial Sequence
  Description of Artificial Sequence: Synthetic coding sequence
atggaggccatgtggctgctgtgcgtggccctggccgtgctggcctggggctttctctgggtgtgggactctagtgagagaatgaagagccgagagcagggtggccgattgggcgcagagagcaggacacttctggtcatcgctcaccccgatgatgaagccatgttttttgcccctacagtcctgggattggcacggcttcgccactgggtgtacctgctatgtttttccgccggaaactactacaaccagggtgagacaaggaagaaagagttgctacagtcttgcgacgttcttggtattcctctgagctcagtgatgatcatagacaatagagactttcctgatgaccccggtatgcagtgggacactgaacacgtggcgcgtgtgctcctccaacacatagaggtgaatggcatcaacctagtggtgaccttcgacgctgggggcgttagcggacacagtaaccacatcgctttatatgcagcagtgcgcgctcttcattcggagggcaagctcccgaaggggtgttctgttttgaccttgcagagcgtgaacgtgctgcgcaaatatataagccttctcgatctacctctctcgctgctgcatacccaggatgtgcttttcgtccttaatagcaaagaggtcgctcaggctaagaaggccatgagttgtcaccggagccagttgctttggttcagacgcttgtacatcatcttttcaagatatatgagaattaattccctttcctttctctag

SEQ ID NO: 3753 - DNA, 1203 bp, Artificial Sequence
  Description of Artificial Sequence: Synthetic coding sequence
atggccgccctgcggcagccccaggtggccgagctgctggccgaggccagaagggctttccgcgaagaatttggggcagagcctgaactggccgttagtgctcccggccgggtgaatttaataggggagcataccgactacaatcaaggtctggtcctgccgatgcgggatcgactgttccctacacttgagggaagaaagcgaggctccggccgggaaagggtgcggggacgacttctggcacaagcgcggcctctgggagctggagctccgcgactgcaacctggaagcatgtttcctctcaattgtgaggccctctgcgctacccagaagggaacactgagggcctctggccataggggcgcgccgaccgctgacctcggtgagcgttcattgttggcccagccagtgcagtttacagaggaagagacggggggcgcctttcggcccatctgctcactgggatccgcccaggcaagcagcccaccctgcccgaccgcccagggacgtgtgcaggatggcctagtaagcctgctcactacatctgaaggggcagatgaaccccagcgcctccagttcccgttgccaaccgctcagagatcattggagccaggcacccctcgctgggctaactatgtgaagggcgtaattcaatattaccccgccgctcctcttcccgggttttctgcagttgtggtgtcatcagtccccctgggtggcgggctgagttcctcagccagccttgaagtcgccacatacacattcctgcagcagctttgtccagattccggcactattgctgccagagcccaggtttgtcagcaggccgagcatagcttcgccggtatgccttgtggcataatggatcagttcatcagtctcatgggccagaagggacatgccctgttaattgactgccggtctttggaaacatcactggtgccgctcagcgatccaaagctggcagtactgattacaaactctaatgttcgccattccctggcatcaagcgaatatcccgtgaggcgccgtcaatgtgaggaggtcgccagggcacttggaaaggagagcttaagagaggtgcaattagaggaattggaagccgcaagggatctggtgtccaaggaaggtttccgcagggctcggcatgtggtcggggagatccgccggaccgccgatggggctaaggtgctgtgcttatag

SEQ ID NO: 3754 - DNA, 1269 bp, Artificial Sequence
  Description of Artificial Sequence: Synthetic coding sequence
atgtgcgcccccccccggggcgccccccccgagcaccccgcccccacgggcctatgtagaagctcgtgtgccgagttacaggctcgggtcatggctgcactgaggcagccgcaggtggcggagcttctcgctgaggcacggagggcatttcgagaagagttcggagccgagcctgaactggccgtttctgcgccaggaagagtaaaccttatcggcgagcacactgactataaccagggactcgttctgcctatggccctagaattgatgacggtccttgttggatccccgaggaaggatggcctggtctctctcctgacaacaagtgaaggagctgatgagccgcagcgcctacaattccctctccctaccgcacagcgtagcctggagccaggaacgccccggtgggccaactacgtgaagggagtgatccaatattacccggccgcacctctgcccggcttcagcgctgttgtggtgtcatcagttcctctggggggtggcctcagctcaagcgccagcctcgaggttgccacttacactttccttcagcagctctgccctgactcagggacgatcgccgctcgtgcgcaggtctgccagcaggcagaacactcatttgcgggcatgccctgcgggataatggaccagttcatttctttaatgggtcagaaaggccacgctcttctgattgattgtaggagcctcgaaacatccctggttcctctgtcggacccaaaactggcagttctaatcactaattcgaatgtacgacactccctggccagctcggaataccctgttagaagaaggcagtgcgaagaggtcgctcgtgcacttggcaaagaatcgttaagggaagtgcagttggaagagttggaggcagcccgggatctggtgtccaaagagggattccgcagggccaggcatgtcgtcggagagatccggaggactgcccaggcagcagccgcccttcgccgtggtgattaccgggcctttgggagactgatggtcgaaagccaccgctcactccgggatgattacgaggttagttgtccggagctagaccaactggttgaggctgctctcgcagtaccaggagtctacggaagcaggatgacaggaggcggttttggcgggtgcacggtgaccttgcttgaggcatcggctgccccacacgccatgaggcacatccaagagcattatggcggcacagcaacattctacctaagccaagcagcagatggggccaaagtgctatgcctgtag

SEQ ID NO: 3755 - DNA, 1179 bp, Artificial Sequence
  Description of Artificial Sequence: Synthetic coding sequence
atggccgccctgcggcagccccaggtggccgagctgctggccgaggctcggagggcttttagggaagaatttggagctgaacccgagttagcagtgtcagcaccaggcagggttaatttgatcggggagcataccgattacaatcagggcctcgtactgcctatggccttggagttaatgacggttttggttggctctccgaggaaagatgggctggtgagcttgctgaccacatctgaaggggctgacgaaccgcagcggttacagttcccactgccgaccgctcagcgcagtcttgaaccgggtacgcctaggtgggccaactatgttaagggggtgattcagtattatccagccgccccattgcccggtttttctgccgtcgtggtgtcatctgtccccctgggcggaggactgtcctcatccgcgtccctagaggtggcaacctatacctttcttcagcagttgtgccctgattctggcacaatcgctgctcgagctcaggtgtgccagcaggctgagcactcatttgctggaatgccttgcggcataatggatcagtttatttctctcatggggcagaaagggcacgcactgctcatcgattgccgttccctggaaacaagccttgtgcccttaagcgatccgaagctcgccgtccttattaccaatagtaacgttcgccattcccttgcgtcctccgagtatccagttaggaggcggcagtgcgaggaggtcgctcgcgctttgggcaaagaatccctgcgggaggtccagctggaggagcttgaagccgccagagacttagtctcaaaggagggctttcgacgcgcccggcatgtcgtcggcgaaatacggcgcaccgctcaggcagctgctgcactgcgaaggggcgattaccgggcgtttggacggctgatggtggaatcacaccggagcctgcgtgacgactatgaggtgtcctgtccagaattggatcagctggtcgaggccgccttggcggtcccgggagtgtacgggagcaggatgaccggcggaggctttggaggctgtacggttaccttattggaggccagcgcagcgccccacgcgatgagacacattcaagagcattacggaggcacagctactttctacctctcccaggccgcggacggagccaaagtcctctgtttatag

SEQ ID NO: 3756 - DNA, 1569 bp, Artificial Sequence
  Description of Artificial Sequence: Synthetic coding sequence
atggccgccgtggtggccgccacccggtggtggcagctgctgctggtgctctctgcagccggaatgggtgccagtggggctcctcagccacctaatatactcctgctgctgatggatgacatgggctggggcgacttgggggtgtatggagagccctctcgggaaacccctaatctggaccggatggctgcggagggcctcctatttcccaacttctacagcgctaaccctctttgcagccctagccgagctgccttactgaccggcaggctgccgataaggaatggcttctacaccaccaatgcccacgcccgaaacgcctacacgccccaggagattgtaggcggaattcccgattccgagcagctgcttccggagctattgaagaaggctggctatgtttctaagatcgtaggcaagtggcacttgggacaccggcctcagttccatccattgaagcacggattcgatgagtggttcggctcgccaaattgtcatttcggaccctacgataataaggcccgcccaaatattcccgtgtaccgcgactgggaaatggtgggcagatattacgaggaattccctataaatctgaagacaggtgaagcaaaccttactcagatctacctgcaagaagcattggattttatcaagaggcaagcgcgccaccaccccttttttctgtactgggccgtggatgccacccatgcccccgtgtatgcttccaagcctttcttgggaacttcccagcggggcaggtacggagatgcagtgagagaaatagacgattcgatcgggaagatcctggagctactacaggatctccacgtggccgataatactttcgtattcttcacttccgataatggcgcagcactgatctccgcgccggagcaggggggcagcaatggcccctttctgtgtggtaaacaaactactttcgagggcggaatgagagaaccagccctggcttggtggcctgggcatgtgaccgccggccaagtgagccaccagctcggctcaattatggacctgttcacaaccagcctagccctagcgggcctgacccctccttccgatagagctattgacggtctgaatctcctcccaaccctgttgcagggcaggttgatggaccggccaatattctactataggggtgacacattgatggcagccacgttgggacagcataaggcccacttctggacctggaccaactcctgggaaaatttccgccaggggatagacttctgtcccggacagaacgtgagcggcgtcacgacacacaatctggaagaccacaccaagctcccactcatctttcatcttgggcgtgatcccggtgagcgtttcccactcagtttcgccagcgccgaataccaagaagccttgtctcgcatcaccagtgtcgttcagcaacatcaggaggcactggtgcccgcgcagcctcagctgaatgtgtgcaactgggctgtcatgaactgggccccgccaggctgcgaaaaattaggcaaatgcctgactccccctgagtcaataccaaagaaatgcctctggagccattag

SEQ ID NO: 3757 - DNA, 261 bp, Artificial Sequence
  Description of Artificial Sequence: Synthetic coding sequence
atggccgccgtggtggccgccacccggtggtggcagctgctgctggtgctctctgctgccggcatgggcgcatccggggccccccagccccctaatatccttttgctcctaatggacgaccgcggaaggcactgctcccaggatggatatccctcagccatggcttctacccctccaactccgatgcctgagacgcccacacatagacgtaggctgtgggcggcaagtcagacaagatctagttcgtgtcggagcttctag

SEQ ID NO: 3758 - DNA, 1344 bp, Artificial Sequence
  Description of Artificial Sequence: Synthetic coding sequence
atggccgccgtggtggccgccacccggtggtggcagctgctgctggttcttagcgccgctggaatgggagcaagcggggcccctggccaacgcgcttacactccacaggagatagtcggagggatcccagacagcgaacagttgctgcctgaactgctgaagaaggcaggttatgtgagcaaaattgtcggaaaatggcacctaggccaccgcccccagttccacccgctgaaacatggcttcgacgagtggttcgggagccccaattgtcacttcggtccctatgacaacaaggccagacctaatatccccgtctatagggactgggagatggttggcagatattacgaggaattccctatcaacctcaaaaccggagaagccaatttaacacagatttacctccaagaggcacttgactttattaaacggcaggcccggcaccacccgtttttcttgtactgggcagtcgatgctacacacgcccctgtgtacgcttccaagccttttctgggaaccagtcagcgtggccgttacggcgatgctgtaagggagatcgacgattccatcggtaaaattttagaactgctccaggacctccacgtcgctgataatactttcgttttttttacttctgacaatggcgcggctctcatctctgctccagagcagggaggctccaacggtccattcctgtgcggcaaacagacaacattcgagggtgggatgcgggaacccgcactggcttggtggcccgggcatgtgacagctgggcaggtgagccaccagcttgggtcaattatggatctgtttacgacatccctggcgctagcaggactgaccccacccagcgatagggcgatagacggccttaacttactccctacccttttgcagggcagactcatggatagacccatcttttattatagaggcgatacattgatggcagccaccctgggacagcacaaagcccatttctggacttggaccaactcgtgggaaaatttcagacagggcattgacttttgcccaggacagaacgtgtcaggagtcaccacccataacttggaggatcataccaagctgccactgattttccacctgggtagagacccaggcgaacgcttcccactcagcttcgcatccgctgaatatcaggaagccctgagccggattacatctgtggtccaacaacatcaggaggctctggtgccggcacagcctcagctcaatgtttgtaattgggctgttatgaactgggctcctcccggctgcgaaaaactgggcaagtgcctgacccccccagagtccattccaaaaaagtgtctgtggtcccattag

SEQ ID NO: 3759 - DNA, 1140 bp, Artificial Sequence
  Description of Artificial Sequence: Synthetic coding sequence
atgagccggagcggcaccgacccccagcagcggcagcaggccagcgaagccgatgcagccgccgctacattcagagccaatgaccaccagcacattcgctacaaccctttgcaagacgagtgggtcctcgtgagcgctcacaggatgaaaaggccttggcaaggccaagtagagccccaactgctgaagacggtgcccaggcacgatccactgaaccccttgtgcccgggcgcaatcagggcgaatggcgaggtcaatccacagtacgactctacattcctattcgataacgattttcccgcgctgcagcccgacgccccgtccccagggccctcagatcatccactgtttcaggccaaatccgcccggggcgtctgcaaggttatgtgtttccatccttggtccgatgttactctccccctcatgagcgtcccagagattagagcggtggtggacgcttgggcgagtgtgaccgaagagttaggcgcccagtacccttgggtccaaattttcgagaacaaaggagccatgatggggtgcagcaatccccacccacattgccaggtttgggcttcctcatttctccctgatatcgctcagagggaggaaagatcccagcaggcttacaaatctcagcacggcgagcccctgctgatggaatacagcaggcaggaactgctgcggaaggagcgcctggttctcacttctgagcactggctggtactcgttcctttctgggcaacttggccctaccagactcttcttctgcctcgcaggcacgtacgacggttgcccgaattaacccccgccgagagagacgatttggcttccataatgaaaaaactactcacgaagtacgacaacctctttgagacaagcttcccctatagtatgggttggcacggggcccctacaggctctgaagctggagcgaactggaaccactggcaactccacgctcattattatccgcccctgctgcgaagtgctacggtgcggaaattcatggttggctacgaaatgctggctcaggcccagcgtgatctcactcccgaacaggcagccgagagattacgtgccctgccagaggttcattaccacctcgggcagaaggaccgggagacagcaactatcgcttag

SEQ ID NO: 3760 - DNA, 813 bp, Artificial Sequence
  Description of Artificial Sequence: Synthetic coding sequence
atgaccctgagcaccctgtgcgtgctgggccccagcgagcccaccgaaagcaaagttatgtgcttccacccttggagtgacgtcaccctgccgctaatgtccgtgcctgaaatcagggctgttgtagatgcatgggcctctgtcacggaagaattgggggcgcagtatccttgggttcagatatttgagaataaaggggccatgatgggctgctctaacccacaccctcactgccaggtgtgggctagctccttcttgcccgacatcgcccaacgtgaagaaaggagtcaacaggcttacaagtcacaacacggggaacccctcttaatggaatactccaggcaggagctgctgcggaaggagcgtctcgtcctgaccagcgaacactggctggtgctggtgccattttgggctacctggccctaccagactctgctactaccgcggagacacgtcaggagactcccagaacttacccccgccgaaagagacgatttggctagcataatgaagaagctgttgacgaagtacgataacctttttgagaccagttttccttatagtatgggctggcacggtgcaccaacagggtcggaggctggggccaactggaatcactggcagctgcacgctcattactatcctcccttactgcggagcgccacggtgcgtaagtttatggttggatacgagatgctggcccaggcccagcgcgacttgactcctgaacaggccgccgaaaggttgagggctttacccgaggtgcactaccacttgggccagaaagatcgcgaaaccgccaccatcgcgtag

SEQ ID NO: 3761 - DNA, 255 bp, Artificial Sequence
  Description of Artificial Sequence: Synthetic coding sequence
atgagccggagcggcaccgacccccagcagcggcagcaggccagcgaggctgatgccgccgccgccaccttccgcgccaacgatcatcagcacataaggtataatcctctgcaggatgaatgggttctggtaagcgcccacaggatgaagcgtccctggcaggggcaggtggagccgcagctacttaaaactgttcccaggcacgatcctctgaaccccctgtgtcctggggctattagagctaatggcgagtag

SEQ ID NO: 3762 - DNA, 2229 bp, Artificial Sequence
  Description of Artificial Sequence: Synthetic coding sequence
atgagcccccagaagcgggtgaagaacgtgcaggcccagaaccggacatctcagggttcgagctcattccagactaccctgagcgcctggaaggtcaaacaggatccgtcaaattcaaaaaacatttctaagcacggacagaataacccagtgggagattacgagcacgctgacgatcaggccgaagaagatgctctgcagatggccgtgggctattttgagaaggggcccattaaagcatctcagaataaggacaagacacttgagaagcaccttaagacagtcgaaaatgtagcatggaaaaacggactggcaagtgaagagatcgatatcctcttgaatatcgcactgagcgggaagtttgggaacgccgtaaacacaagaattttgaagtgtatgattccagccactgtgattagcgaggatagcgtagtaaaagccgtgtcttggctgtgcgtcggtaagtgttcaggatctacaaaagtcttgttctataggtggctcgtagcgatgttcgactttatcgatcgtaaagagcaaattaatctgctgtatggtttttttttcgccagcctgcaagatgatgcactttgcccatatgtttgccacctattgtaccttttaaccaaaaaagaaaacgtgaaacctttccgggtgagaaaactccttgacctgcaggccaaaatggggatgcagccacaccttcaagcactcctgtcactctacaagttcttcgctccggccctcatcagcgtgtctttaccggtgcgaaagaagatttactttaagaatagcgagaacctctggaagaccgctctgctggctgtaaaacaacgtaaccgcggtcctagccccgaaccgctgaaactgatgctgggccctgccaatgtgcgccctctgaagcgcaagtggaacagtctgagcgtcattcctgtgcttaactcatcttcgtataccaaggaatgtgggaagaaagagatgtccctgtccgactgtctgaatcgttccggaagcttccctttggaacagctgcagtcctttccccagctgctgcagaatatccattgcctggagcttccgagccagatggggtcagttctgaacaactctctgctactacattacataaactgtgtccgggacgaaccggttctgctgagattttattactggctgtctcagacgctgcaggaggagtgcatctggtacaaagtcaacaattacgagcacggaaaggagtttaccaactttctggatacaatcatcagagccgaatgtttcctgcaggagggattttactcttgtgaagccttcctgtacaagtcactcccattgtgggatggcctgtgctgtcgcagccagttcctgcagctcgtgagctggatcccattttcgtcgttcagcgaggtcaaacccctgctgtttgaccacctggcccagctgttcttcacctctacaatctactttaaatgttcagtgttgcagtcccttaaagagttactacagaactggctcctgtggctctctatggacatccatatgaagcctgtgaccaattctccgctggaaactacgctaggcggttcaatgaactccgtcagcaaactaattcactacgttgggtggctgagcaccaccgccatgaggctggagtcaaacaacactttccttctgcactttatcttggatttttatgaaaaagtctgtgacatatacattaactacaaccttccactggttgtgctatttcctccaggaatcttttatagcgcgcttctgagcctggatacaagcatcctaaaccaactgtgctttatcatgcaccgataccgaaaaaatctgaccgcagcaaaaaaaaacgagttagtgcagaagacaaaatccgaatttaacttttctagcaaaacataccaagagtttaatcactacctcacatcaatggtgggttgtctgtggacctctaagcctttcggcaaggggatatacatcgacccagagattctggagaaaacaggggtagctgagtataagaattccctgaatgtggtgcatcacccttcttttttatcttatgctgtttcatttctccttcagggaaagaagtggtcatggtacctggactacctgtttagtcagggcttgcagggactgaagctgttcattaggagcagcgtccaccacagttctattcctcgtgctgagggtatcaactgcaacaaccagtactag

SEQ ID NO: 3763 - DNA, 636 bp, Artificial Sequence
  Description of Artificial Sequence: Synthetic coding sequence
atgaagctgtgggacgtggtggccgtgtgcctggtgctgctgcacaccgccagtgccttccctctcccagcaggtaaacgacccccagaggcaccggcagaagatcgcagcctgggtagacgtcgagcccctttcgctctttcctccgactcaaatatgcctgaggattatcccgaccagtttgatgatgtcatggatttcattcaagctaccatcaaacgtctgaaacgctctccagacaagcaaatggccgtgctccctcgccgggagcgaaatcggcaggctgcagcagcaaacccagagaacagcagaggcaagggtaggagaggacagcggggcaagaaccggggctgcgtgctgacagccatacacctcaacgtgacagacttgggcctgggctacgagactaaagaagagctcatattccgctactgttccggttcctgcgacgcagctgagaccacttacgataaaatcctaaaaaatttgtcccgcaaccgccgactggtatccgataaggtcgggcaagcttgctgtcggcccatcgcatttgatgatgacctctcttttcttgacgataacttggtgtaccacatcctgagaaagcacagcgccaaacgctgcggctgcatttag

SEQ ID NO: 3764 - DNA, 558 bp, Artificial Sequence
  Description of Artificial Sequence: Synthetic coding sequence
atgaagctgtgggacgtggtggccgtgtgcctggtgctgctgcacaccgcctcggcattccctctgcctgccgctaatatgccagaagactaccccgaccagtttgacgacgttatggacttcatccaggccacgatcaagcggctgaagcgctcccctgataaacaaatggctgtccttcctagacgagaaaggaatagacaggccgccgctgccaatccggaaaactcacgaggtaaaggcaggaggggtcagcgtggaaagaatagaggatgcgtgttgacagctattcatctgaatgtgactgacctgggtctgggctatgaaacgaaagaggaactgatatttcgctactgttccggttcctgcgacgctgcagagaccacttacgataagatcctgaaaaacttatccagaaaccggaggttagtgtccgataaagtcggtcaggcctgttgtcgcccaattgctttcgacgacgacctctccttcctagacgataacctggtgtaccatatcctcaggaaacacagtgctaaacgttgtggttgtatctag

SEQ ID NO: 3765 - DNA, 687 bp, Artificial Sequence
  Description of Artificial Sequence: Synthetic coding sequence
atgcagagcctgcccaacagcaacggcgccgccgccggccgggacttcaaaatgaagctgtgggacgttgtggcggtatgtttagtcctgctgcacacagcctccgcttttcctcttcctgctggaaaacgaccacctgaggcgcccgcagaggatcggagcctggggcgccgacgggcaccctttgcactttctagtgattctaacatgccggaggactaccctgaccagtttgacgatgtgatggatttcatccaagcgacaataaagaggttgaagagatcaccagacaagcagatggcagtgctacccaggagggagcgcaatcggcaggccgctgctgcgaatccagagaacagtcgcggaaaaggaagacgggggcagaggggaaagaacagagggtgtgttctgacagctattcatttgaacgtaacagatctggggcttggttacgagaccaaagaagagcttatattcaggtattgctcgggctcttgtgacgctgctgaaactacctacgataaaattctgaaaaatttatctagaaataggcggttagtgtccgacaaagtgggacaggcgtgttgccgaccaattgcattcgatgatgacctgagtttcctggacgacaacctagtgtaccatattctcaggaagcattcagcaaagcggtgcggttgtatatag

SEQ ID NO: 3766 - DNA, 186 bp, Artificial Sequence
  Description of Artificial Sequence: Synthetic coding sequence
atgaagctgtgggacgtggtggccgtgtgcctggtgctgctgcacaccgcttcagcatttccacttcccgctgcaaatatgccagaggactatcctgaccaatttgacgacgttatggatttcatccaggcaacaattaagcgactgaagcgaagccctgataagcagatggctgtgctcccctag

SEQ ID NO: 3767 - DNA, 186 bp, Artificial Sequence
  Description of Artificial Sequence: Synthetic coding sequence
atgaagctgtgggacgtggtggccgtgtgcctggtgctgctgcacaccgcatctgctttcccactgccggcggctaacatgcccgaggattaccccgatcaattcgacgatgttatggacttcatccaggccacaattaagagattgaagagatctcctgataagcaaatggccgtgctgccctag

SEQ ID NO: 3768 - DNA, 558 bp, Artificial Sequence
  Description of Artificial Sequence: Synthetic coding sequence
atgaagctgtgggacgtggtggccgtgtgcctggtgctgctgcacacagcttccgcatttcctctgcccgcggctaatatgcctgaggattatcccgatcagttcgatgacgttatggacttcatccaggccacaataaaacgtttgaaacggtcaccagacaagcaaatggccgtcctgcctcgtagggagagaaatagacaagcagccgccgctaatcctgagaattcccgcggaaaggggcgcaggggacagcgcggaaagaaccgtggctgcgttctcacagcaatacaccttaatgtcactgacctcggactcgggtacgagacaaaagaagagctcatttttcgatattgcagtggaagctgtgacgcagcagagacaacctacgacaagattctaaagaacttgtccaggaaccggagattagtctctgataaagtcggacaggcttgctgtcgccccattgcctttgatgacgacctgagtttcctcgatgacaacttagtttatcatattctgaggaagcactccgcaaaacgatgtggttgtatttag

SEQ ID NO: 3769 - DNA, 609 bp, Artificial Sequence
  Description of Artificial Sequence: Synthetic coding sequence
atgcagagcctgcccaacagcaacggcgccgccgccggccgggactttaagatgaagttgtgggacgtggtagccgtgtgtctggtgttactgcatacagcaagcgcattcccacttccagctgccaacatgcccgaggactatcccgatcagtttgacgacgtgatggatttcatccaagcaacgatcaagcggctgaagcgctcccccgataaacagatggcagtgctgccaaggcgggaaagaaaccgccaggccgccgctgcaaacccagaaaactccaggggaaaaggtaggagagggcagagggggaagaatcgagggtgtgtgctgaccgctattcacctgaatgtgactgatttgggcctcggttacgaaacaaaagaagaactaatttttcgttactgctcaggctcctgtgacgctgccgaaacaacttacgataaaatccttaaaaatctctcaaggaatcgtcggctggtctccgataaagtcggccaggcctgctgccgcccgattgcatttgatgacgatctatcttttctcgacgataacctagtgtaccatatcttgcgtaaacactcagccaagagatgtggatgtatctag

SEQ ID NO: 3770 - DNA, 543 bp, Artificial Sequence
  Description of Artificial Sequence: Synthetic coding sequence
atgaagagcatctacttcgtggccggcctgttcgtgatgctggtgcagggtagctggcagcgcagtctgcaagacactgaagaaaagagtcggagtttctcagcctctcaggccgaccccctatctgatccagaccagatgaacgaggataagcgccacagccagggcacattcacttctgattactccaagtacctagactctcgaagggcccaagattttgtccaatggctcatgaacacaaagagaaatcggaataatatagcaaaacgacacgacgaatttgagcgacacgcagaggggacgtttactagcgacgtgagctcctacctggagggccaggccgcaaaagagttcatcgcctggctggtgaagggaagaggtcgcagggatttccccgaggaggtcgcaatagtcgaggaacttggccgacgtcatgccgatgggtcgttctctgatgagatgaacacaatcctggataatcttgcggctcgggattttataaactggctgatccaaacaaaaatcaccgatcgaaagtag

SEQ ID NO: 3771 - DNA, 543 bp, Artificial Sequence
  Description of Artificial Sequence: Synthetic coding sequence
atgaagagcatctacttcgtggccggcctgttcgtgatgctggtgcaagggtcatggcaaaggtccctgcaggataccgaggagaagtccagaagcttcagcgctagtcaggcggatcccctcagcgatccagatcagatgaacgaagacaagcgacattctcagggaacctttacatcagactactccaagtatttggactcaaggagggctcaagactttgttcagtggctgatgaacaccaagcgcaaccgaaataatatcgccaaacggcacgatgagttcgagagacacgctgaaggcacgttcacctcagatgtgagttcatatctcgaaggtcaggccgcaaaggagtttattgcttggctcgtgaagggacgcggccgccgggactttccagaggaggtagcaatcgtggaggaactcggccgtcgccatgccgacggctccttttctgatgaaatgaacacaatactggacaacttagccgcccgggacttcattaattggctcattcagacgaagattactgatcggaagtag

SEQ ID NO: 3772 - DNA, 2262 bp, Artificial Sequence
  Description of Artificial Sequence: Synthetic coding sequence
cgggcccccgaccggcggggcagcccccggctggccagcacccggctgggcgccctgagactcagacccagccgccgggtgcctgcccgagctccagctcctgcgcaggcccccctcccattgggcccccgcttgttagggctgcgaaggaatatggctgcccctatgacgcccgctgctaggcctgaagattatgaagcggcattgaatgccgcgttagccgatgtgccagagctcgcccggttactggagatcgatccttacttgaagccatatgccgtggactttcagcgaaggtataagcaatttagccaaatccttaaaaatatcggcgagaatgagggaggtattgataaattttccaggggatacgaaagttttggcgtgcaccgttgtgccgacgggggcctctactgtaaggaatgggctcctggcgcagagggggtttttctgactggggatttcaacggatggaaccctttttcgtacccctataaaaagttagactatgggaagtgggagctgtatataccgccaaaacagaacaaaagcgtacttgtgccacatggcagcaaactcaaagttgtgatcacaagcaagtccggggagatcttgtaccggatctcgccatgggccaagtatgttgtgcgggaaggggataacgttaattatgactggattcattgggaccccgaacacagttatgagtttaagcactcacgtcctaagaagccgagatccctccgaatttacgagagccacgtcggcatctcctctcatgagggcaaagtcgcctcctacaagcactttacctgcaacgtcctcccccgtattaaagggctgggttataactgcatccaacttatggccattatggagcatgcatactatgctagtttcggataccagattacgagcttcttcgccgcctcttcccggtacggcacacctgaggagcttcaggaattggtggacaccgcgcacagcatggggattattgtacttctggatgtggtgcactctcatgcttcaaagaacagcgctgacgggctgaatatgttcgatggaacagattcatgctactttcattcaggtcctcgaggcactcacgatctgtgggacagcagactttttgcatattcatcttgggagattttaaggttcctgttatctaatattcggtggtggcttgaagaatacagatttgatggatttcgtttcgatggcgtgacgtctatgctttatcatcaccatggcgtgggtcaaggcttcagtggcgattacagcgagtatttcggcctgcaggtcgacgaggacgcccttacttacttgatgcttgccaatcacttggtgcacactttatgtccagactcgattactattgcggaggacgtgagtggcatgcccgcactgtgtagcccgatctcacaaggcggaggagggttcgactatcggctagccatggctatccctgataaatggattcagctgctgaaagagttcaaagatgaggattggaatatgggagacattgtgtatacactgaccaatcggcggtacctggaaaagtgtattgcctatgcggagtctcatgatcaagctctcgttggagacaaaagcctggcgttctggcttatggatgccgaaatgtatactaacatgagtgttctcacaccctttacaccagttatcgaccgcggaattcaacttcacaagatgatcagactgattactcacggactaggaggggagggatatcttaacttcatgggcaatgaattcggacatccagagtggctggacttccctcggaaaggaaacaatgagtcctatcattacgccagacgacaattccacttaactgatgacgatctgcttcgatacaagtttttaaacaatttcgatcgcgacatgaatcggctggaagagaggtatggttggctagcagcccctcaggcctacgtctctgaaaaacacgagggaaataaaattatagcatttgaaagggccggattattgtttatcttcaacttccatccttctaagagttataccgattatcgggtgggtactgcactgccgggcaaattcaaaatcgtccttgactccgatgcggccgagtacggcgggcaccaacggctggaccattctaccgacttttttagcgaggcattcgagcataacggccggccatactcgcttctggtctacatccctagcagggttgcacttatcttgcagaacgtcgatctcccgaactag

SEQ ID NO: 3773 - DNA, 2109 bp, Artificial Sequence
  Description of Artificial Sequence: Synthetic coding sequence
atggccgcccccatgacccccgccgcccggcccgaggactacgaggccgcattgaatgctgctttggcagacgtgcctgagcttgctagattgctcgagatcgatccctacctgaaaccttacgctgtggatttccagcgtcggtacaagcagttcagtcagattctcaagaatataggcgagaacgagggcggcattgataagttcagtcgtgggtacgagtcattcggagttcatcggtgcgccgacggcgggctctattgcaaagaatgggcccctggagcagagggagtcttcctaactggggatttcaacggatggaacccttttagctatccatataaaaaactggactacgggaagtgggaactgtatatcccgcccaaacagaataagagtgtgctcgtgcctcacggatcaaaattgaaagtggtgattacaagcaagtccggtgagattctttaccgcatttctccatgggcaaagtatgttgtccgcgagggagataacgtgaattatgattggatccactgggatccggagcactcatatgagttcaagcattctaggccgaaaaagcctcgatccctgagaatatatgagtctcacgttggcatatcatctcacgaggggaaggtggccagctacaaacatttcacttgcaacgtgttgccccgcattaaggggctgggctataactgtatccaattgatggctatcatggaacacgcttactacgcatcatttggctatcaaattacttctttctttgcagcttcgtctaggtacggaactcccgaggaactccaagagctggtcgacacagcccactcaatgggaattattgtcctgctcgacgtggtacactctcacgcctctaagaactccgctgacgggcttaatatgttcgacggtacagactcttgttactttcattctggtccaagaggcacacacgatctctgggacagcaggctgtttgcttattcttcatgggaaatcctgcgatttttactatcgaacattagatggtggctggaggagtatagatttgacgggttccgcttcgatggcgttacatccatgctgtatcaccatcacggggtgggacaggggttctcaggggactacagtgagtattttggcctgcaggttgatgaggacgcactaacatacctgatgctggcaaatcatttggtgcacacactgtgtcccgatagcattacaattgccgaggacgtatcaggaatgcctgcactctgttcaccaatttcacagggtggggggggctttgattacaggctcgcgatggcgattcccgataagtggatccaactcctcaaagagttcaaggacgaggactggaacatgggagatatagtatacacattaactaaccgcagatacctggagaaatgtatcgcctatgcagagtctcatgaccaggctctggtaggggataaaagcctggcattttggttaatggatgccgagatgtatacaaatatgagtgtcttgacccctttcaccccagtgattgatcgcggcatccagctacacaagatgattagactgataacccacggactcgggggagaaggctacctgaattttatgggcaatgaattcggccaccccgaatggcttgattttccgcggaagggcaacaatgaaagctaccactatgctaggcgtcagtttcaccttacggatgacgatcttttgcgctacaaatttttgaataactttgatcgagatatgaacagactggaggaaaggtacggctggttggctgctccacaagcttatgtgtcagagaaacacgaagggaacaagataatcgcatttgaacgtgccggactgctgtttatcttcaatttccatcctagtaaaagctacacagactacagagttggaactgccctccccgggaaatttaagattgtcctagatagtgatgccgccgagtacggtggacatcagcggctggatcatagcactgatttcttttccgaagcatttgaacataatggaaggccttattctttgctcgtttatatcccttcaagggtggccctcattctccagaatgtggacctacccaattag

SEQ ID NO: 3774 - DNA, 1398 bp, Artificial Sequence
  Description of Artificial Sequence: Synthetic coding sequence
atggccatcatggagcacgcctactacgccagcttcggctaccagattacctcattttttgcagcatccagcagatacggtacacccgaggaactccaggaactagtggacacggcccatagcatgggaataattgtgttattggatgtggttcattcacacgccagtaagaactccgccgatggacttaacatgttcgacggcacagactcctgttacttccatagcggtccaagagggacccacgatctgtgggattcaaggttattcgcttacagctcctgggaaatcctgagattcttgctcagtaacatcaggtggtggctggaggaatacaggttcgacggatttcgttttgacggcgtgactagtatgctgtaccaccaccatggagtggggcaagggttctcaggcgactacagtgagtacttcggactgcaagttgatgaggatgcgctcacctaccttatgttagcaaatcaccttgtgcataccctgtgcccagacagtatcactatcgccgaggatgtgtccgggatgccagcgctatgctcccctatctcacaaggaggtggcggatttgactacagacttgcaatggccatccctgacaaatggattcagttattgaaggaattcaaggatgaggactggaacatgggcgacattgtctacaccttgaccaataggcggtaccttgagaaatgtatcgcgtatgcagaaagccacgaccaggcactggtcggcgacaaaagcttagcgttctggctgatggacgcggagatgtacaccaatatgtctgtgctgacgcccttcacacccgtcatcgataggggcattcaactgcataagatgataaggttgattacacacgggctgggcggagaggggtatctgaactttatggggaatgaattcggtcaccccgaatggctggattttccccgcaaaggcaacaatgaatcttatcactacgccagacgccagttccacctgaccgacgacgatcttctgagatacaagttcctgaataacttcgacagagacatgaacagattggaggagagatatggatggctggccgcccctcaggcgtacgttagcgaaaagcatgaaggcaataaaataatcgccttcgaacgagctggcctgctgttcattttcaatttccacccttccaaaagctatactgactacagggtcgggaccgcgttgcccgggaagttcaaaattgtcctcgactctgatgcagctgaatatgggggacatcagcgactcgaccatagcaccgacttctttagcgaagcctttgaacacaacggccgtccctactcattgctggtttatattccaagcagggtggccctgattctccagaacgtggatctgccaaattag

SEQ ID NO: 3775 - DNA, 1074 bp, Artificial Sequence
  Description of Artificial Sequence: Synthetic coding sequence
atggaggagggcatgaacgtgctgcacgacttcggcatccagagcacgcattatctgcaggtgaattaccaggactcacaggattggtttatcttggtttcagtaatcgccgatctgaggaacgccttctatgtgctgttccccatatggttccatctccaagaggcggttgggatcaagctgctctgggtggccgtaatcggagattggcttaatctcgtcttcaaatggatcctgttcggccagcgcccttactggtgggtcctcgatacagactactacagtaatactagtgtccctttaatcaagcaattccccgtaacttgtgagaccggaccaggcagccccagcggacatgctatgggcacagccggcgtatactatgtgatggtaacaagcacactttccattttccaagggaaaattaagcccacctacaggtttcgctgtttaaacgttatcctctggcttggtttttgggcagtgcaactaaacgtttgcctctccaggatctaccttgccgcccattttccccatcaggtcgtagctggtgtactgtccgggattgcagtcgccgaaacctttagtcatatacactcaatatacaatgcctccctgaaaaagtatttcctgatcacctttttcttattcagtttcgccattggattttatcttctcctcaaaggtctcggggtggacctcctctggacactcgagaaggcccagcgctggtgtgaacagccagaatgggtgcatatagacacaacacccttcgccagtttactgaagaatttaggaacgctgtttggcttgggcctggccctcaatagctcgatgtaccgggaatcatgtaaggggaagctgtccaagtggttacctttccgcctgagtagtattgtggcaagcctggtgttactgcacgtgttcgatagtctcaaaccccccagccaggtggaactggtgttctacgtgctttcgttctgtaagtctgccgtggtgccgctggcctctgtatcggtgataccctattgccttgcgcaggtactcggacagcctcacaagaagagtctgtag

SEQ ID NO: 3776 - DNA, 2859 bp, Artificial Sequence
  Description of Artificial Sequence: Synthetic coding sequence
atgggcgtgcggcaccccccctgcagccaccggctgctggccgtgtgcgccctggttagcttagccactgccgcgctcctcggtcatattctgctgcacgatttcctgcttgtgccccgcgaactttctggctcaagtccagtactagaggaaactcatccagcccatcagcagggggcctcacggcctggccctagagatgcacaagctcaccccgggagaccccgcgcagtccctacacagtgtgacgtgccaccgaactctcgattcgactgcgcaccagataaggcaatcacccaggagcagtgcgaggcgagggggtgctgttacattccagcgaagcagggtcttcagggcgcacaaatggggcagccctggtgtttctttccccctagctacccctcctacaagcttgagaacctgtccagctccgagatggggtatacagccaccttaacccggactacccctaccttctttccaaaagacattctgactttgcgcctggacgtgatgatggagaccgagaaccggctgcacttcaccatcaaggacccagcaaaccggcgctacgaagttcctttggaaaccccccatgtgcacagcagggctccctcaccactgtactccgtcgagtttagtgaggagccctttggtgtcatcgtacgacgccagctggatggtcgtgtgctgctcaacaccacagtggcaccgctgttttttgctgatcagttcctgcaactgagtacctcgttgcctagccagtacattactgggctcgccgaacatcttagtccactgatgctgtcaacctcctggactaggatcaccttgtggaatagggacctggctcctactcctggcgcaaacttgtacggtagccatccgttctacttggcactagaggacggaggttcagctcatggtgtctttttactcaacagtaacgccatggatgtggtcttgcagccctcacccgccctgtcctggcgtagtactggcggcattctggatgtctatatctttctggggcccgaacccaagtccgtagtgcagcagtacttggatgtcgtgggctatcccttcatgcctccttactggggtctcgggtttcacctttgccggtgggggtattctagcactgcgattacccgacaggtcgtcgagaacatgaccagggctcactttcccctggacgtccagtggaatgacctggactacatggattcgaggagggatttcacctttaataaggatggctttagggactttccggctatggtgcaggaactgcaccaggggggcagacggtacatgatgatcgtggatcctgccatatcctctagtggtccagcgggctcctaccgaccctacgacgaaggattgcgccggggcgtctttattacaaatgagacaggacaacctctcataggcaaagtctggcccggttcgacagcatttcccgacttcaccaatcctaccgccctcgcatggtgggaagacatggtcgctgagtttcacgatcaggtgcctttcgatggtatgtggattgatatgaacgagcctagtaattttatccgcgggagtgaagacggttgcccgaataacgagctggagaatcctccatacgtgccaggagtcgttggggggaccctccaggccgccacaatttgcgctagctcccaccagtttctgtcaacacattacaacctgcacaacctgtatggcctcacagaggcgattgcatcccaccgcgccctggtcaaggctcgggggactcgcccttttgtgattagccgcagcacatttgccgggcacggtcggtatgccgggcactggacaggtgacgtatggagctcgtgggaacagctggcctcttcagttccggaaatactgcagttcaatctgctgggggtgcctttggtgggcgctgacgtctgcggatttctaggcaatacctccgaggagctttgtgtaagatggacacaactgggagccttctatccattcatgcgtaaccataatagtctcctgtcgttgcctcaagaaccctactccttcagtgagccagcacagcaggccatgcgaaaggccctgacactgagatacgctctcctcccccatctctacaccctttttcaccaagctcatgtcgctggtgaaaccgtcgcacgacccctctttcttgagttcccaaaagacagcagcacctggacggtggatcatcagctgctgtggggcgaagccctgctgatcactcctgtgcttcaggccgggaaagccgaggtgacagggtattttcccttaggcacctggtatgacttgcagaccgtgcctgtggaggcactgggaagtctgcctccgccacctgcagctcctcgggagccggccatccactctgagggacaatgggtcactctgcccgcccctttggatacgattaatgtacatctgcgcgcaggctatattattcccctgcaggggcctgggctgactacaacagagtcacgccagcagccaatggcattggctgtcgccttgacaaagggaggtgaagcgaggggggaactgttttgggacgacggcgagtctttagaagtcctggaaaggggtgcctacacacaggttatctttctcgcacggaacaatacaattgtgaatgagttggttcgcgttacatcagaaggggccggtcttcaattacagaaggttaccgtactgggagttgccaccgccccacagcaggtgctcagcaatggcgtcccagtatctaacttcacctattcgccagacaccaaggttctggatatttgcgtttctctcctaatgggagaacagttcctggtgtcatggtgctag

SEQ ID NO: 3777 - DNA, 2859 bp, Artificial Sequence
  Description of Artificial Sequence: Synthetic coding sequence
atgggcgtgcggcaccccccctgcagccaccggctgctggccgtgtgtgccttggttagcctggccacagctgctctgttaggccacatactcctgcatgactttcttctcgtacctcgcgaactgtccggctctagcccagtgctcgaggagacacatcctgctcaccagcagggcgcgtcgcgtccaggccctcgagatgcccaggcccaccctgggaggcctagagcggttcccacccagtgtgacgtccccccaaattctcgatttgactgcgctcccgacaaggccattacacaggagcagtgcgaagctcgcgggtgttgttacatccctgccaaacagggactacaaggtgcccaaatggggcaaccctggtgcttttttcctccaagctacccgtcttataaattggaaaacctatcatcatcggagatggggtacacagctaccctgactaggaccacccccacattcttccccaaggatatcctgacactccgtctagacgtaatgatggagactgagaatcggctgcacttcaccatcaaggacccagcaaataggagatacgaagtgcccctcgaaactccccacgtgcacagtagggcacctagccccctgtactccgtcgagttctcagaagagccctttggtgtcatcgtccgccggcaactcgatggacgcgttctcctgaacaccactgtggctcctctcttcttcgcagaccagttcctgcagctgtccacttctctgccttcacaatatattactggcctcgccgaacacctgagcccactcatgcttagcacatcatggaccagaataaccctctggaaccgcgatctggctcctaccccgggggccaacctttacggatcccaccccttctatttggcacttgaggacggtggatccgcgcatggagtgttcttgctcaacagcaatgcaatggatgtggtcctgcaacctagtcctgccctctcttggaggtctacagggggcattcttgacgtgtatatttttttggggcccgaaccaaagtcagtcgtccagcaatacctggatgttgtaggctacccattcatgcctccgtactggggactcggtttccatctctgccgatggggttattcaagcacagccatcacccggcaggtggtggagaacatgactcgagctcacttcccgctggatgttcagtggaatgacttagattacatggacagtcgcagagatttcaccttcaacaaagacggtttccgtgactttccagctatggtccaagagctccaccaaggaggacgcaggtatatgatgatcgtggatccagccatctcctcctccggaccagcggggagctatcggccgtatgatgaaggactacgaaggggcgtattcataaccaacgagaccggccagccgttaattgggaaagtatggccaggctccaccgcttttccagatttcactaaccctaccgccctggcctggtgggaggacatggttgcggaatttcacgaccaggtgccattcgatggaatgtggattgatatgaacgagccaagcaattttatcagagggtctgaagacgggtgccctaacaacgagttggagaatcctccgtacgtcccaggtgttgtcgggggaacattacaagccgccactatctgtgccagtagccaccagttcctttccactcactacaacttgcacaacctctacgggctcaccgaggcaatcgcgagccatcgggcccttgtcaaggcaaggggcacaagacctttcgtgattagcagaagtacattcgccggccatggccgttacgctggccattggaccggggacgtttggagtagttgggagcagttagcatcatctgtccctgaaattctgcaatttaacttacttggggtgcctctagttggcgcagacgtttgcggctttctaggcaacacctctgaggagctatgcgtaagatggacgcagttgggtgccttctaccccttcatgagaaatcacaacagtctgctgtctttgccccaagagccatactctttctcggagccagcccaacaagccatgaggaaggctctcacgctccgctatgcactcctgccccacctgtatactctatttcatcaggcccacgtggccggggaaacagtggctcggcctctctttcttgagttccctaaagactcttccacatggactgtcgaccaccaactgctgtggggtgaagcactgttaatcacgccagtgctacaggccgggaaagctgaagtgaccggctacttccccctcgggacctggtatgatctgcaaacggtcccagttgaagctttgggatccctcccacccccgcctgcggcaccacgagagccagccatacattccgaaggtcagtgggtcacactaccggcacctcttgacactatcaatgtgcaccttagggccggctatatcattcccctacaaggccctggcctgaccaccacagaatctcggcagcagcccatggccttggccgtggcgctaacaaagggaggcgaagccagaggcgagttattttgggacgacggggagagcctggaggtgcttgagcggggtgcttatacacaggtgatttttctcgctcgcaacaacactattgttaatgaactcgtgcgagttacttcagagggtgcaggattacagctgcagaaggttactgtgttgggagtggcgaccgcgccccagcaggtgctttctaatggcgtgcccgtcagcaacttcacctactcccctgacaccaaggtccttgatatctgtgtgtcactgctcatgggcgagcagttcctggtgtcctggtgttag

SEQ ID NO: 3778 - DNA, 1611 bp, Artificial Sequence
  Description of Artificial Sequence: Synthetic coding sequence
atggagttcagcagccccagccgggaggagtgccccaagcccctgtctcgcgtgagcatcatggcaggcagtctcacgggactgctgctgctgcaagctgtcagctgggctagcggggctagaccatgtatccccaagagttttggctactctagcgtagtgtgtgtatgcaatgcaacttattgcgactcttttgatcctcctacatttcccgcattaggtaccttctcgagatatgaaagcaccagatcgggccggagaatggaactgtcgatggggcctattcaagcgaaccacaccgggactggactgttgcttactctacagcccgaacaaaaattccaaaaggttaagggattcggaggagccatgactgatgctgccgcccttaacattttagccctatctccccctgcgcagaatctgttactgaaatcttacttttccgaggaagggatcggctataacatcatccgcgtgcctatggccagttgtgatttctccattaggacatacacatatgccgatacgcccgatgacttccagctgcataacttttcacttcctgaggaagataccaagctgaagatccctctgattcatcgggccctccagttggcccaaaggcctgtatcactgctggcaagcccctggacctcccctacatggctcaaaacaaacggcgcggtgaatgggaaagggtccctcaagggtcagcctggcgatatctatcaccaaacgtgggcaagatacttcgttaagtttctggacgcttatgccgaacacaaactgcagttctgggctgtgaccgcagagaatgaacccagtgccggtctgctctccggttacccatttcagtgcctgggttttacgcccgagcaccagagagacttcattgccagggatctcggccccactttggcaaactcaactcaccacaacgttaggttactgatgcttgatgatcagcgcttgctcctgccacactgggctaaggtagtcctgacagatcctgaggcagccaaatacgtccacggaatagcggtacactggtatttagacttcctggctcctgctaaagctaccctaggcgagacccatcgcctgtttcccaacactatgctgttcgcctcagaggcctgtgtggggagcaaattctgggaacagtccgtgaggctggggagttgggacagaggcatgcagtactcacatagtatcataaccaacctgttataccacgtcgttggttggaccgattggaacctagcactcaacccggaaggcggtccaaattgggtgaggaacttcgtggattctcccataatcgtcgatattacaaaagatactttttacaaacagccaatgttctaccacttggggcacttctcaaagtttatccccgaaggcagtcaaagagtggggctggtcgctagccagaaaaatgacttggacgctgtagctctaatgcacccagacggatccgcagttgtggttgttctgaaccgctcatctaaggacgtcccactgaccattaaggatcccgcagtaggatttctggagacaatcagccctggatatagtatccacacttacctttggcggagacagtag

SEQ ID NO: 3779 - DNA, 1611 bp, Artificial Sequence
  Description of Artificial Sequence: Synthetic coding sequence
atggagttcagcagccccagccgggaggagtgccccaagcccctgtcgcgggtgagtatcatggctggcagtctgactggccttctgctgctgcaagcagtgtcctgggctagtggagcgaggccatgtatccccaagtctttcggctattcctccgtcgtctgcgtatgtaacgccacctattgcgactcatttgaccctccaacttttcccgcccttggtactttcagccgctacgagagtacacgctcgggtagacgcatggagctcagcatgggtccaatccaagctaaccacacaggaaccggcttgttactcactctacagcccgagcagaagttccagaaggtaaagggcttcggaggtgccatgacagacgcagcggcgttgaatatcctggccctgagtccacctgcacagaatttgttactcaaatcttacttttctgaagagggaattggatataatataatacgtgtgccaatggcgtcttgtgatttctccatcagaacctacacttatgccgatacaccagatgactttcagctgcataacttctccctacctgaggaagatacgaaactcaagattccgttgattcatagagcgttacagcttgcccagcgccctgtgtcgctcttggctagcccatggacaagtcctacctggctcaagaccaatggcgccgtgaatggaaagggtagcctaaagggccagcccggggatatttaccaccagacctgggcacgttatttcgtaaaatttcttgacgcctatgctgagcataaactgcagttctgggccgttaccgctgaaaatgagccatcagccgggctcctctccggctaccctttccagtgcttgggcttcacccccgaacaccagcgagacttcattgcaagggacctgggccctactctcgctaatagcacacatcacaacgtcagactattgatgttagatgatcagcgactgcttctgcctcactgggccaaggtagttttgaccgacccagaggctgcgaaatatgtccatggcattgctgtgcactggtacctggacttcctggcaccagctaaagctaccctgggagagacccaccggctgtttcctaacacgatgttgtttgcttccgaggcatgtgtgggttccaagttctgggagcagtccgttcggctggggtcgtgggaccgaggtatgcagtattcccattctatcatcacgaacttgctgtaccatgtggtcggctggaccgactggaatctggcgttgaacccggaaggtgggcctaactgggtccgtaacttcgtagactcaccgattatcgtcgacatcaccaaagatactttctacaaacagccgatgttttaccatctgggccacttctccaagttcattcccgaggggtcccaacgcgtaggcctggtggcctcacagaagaacgacctggatgccgtcgctctaatgcatcctgatggttcagcagttgttgtggtgttgaaccgcagttctaaagacgtgccactcaccatcaaggacccagccgtgggttttctcgagactatatcccccggttattccatccacacttatctatggcgccgtcagtag

SEQ ID NO: 3780 - DNA, 1566 bp, Artificial Sequence
  Description of Artificial Sequence: Synthetic coding sequence
atggagttcagcagccccagccgggaggagtgccccaagcccctgagccgggtgtccatcatggctggatcactcactggcctcctgttgctgcaggcagtgtcttgggcaagtggggcccgcccctgcattcccaagagctttggctattccagcgtcgtttgcgtctgcaacgctacatattgcgactcctttgatccgccaacattcccagcattagggaccttcagccggtacgagagcactaggagcggacgtagaatggagctgtccatgggtcctatccaggctaaccatactggcactggcctcctcctgactcttcagcccgacgccgctgctcttaatattctggcactttccccacccgctcagaacctcctccttaagtcttacttttctgaagagggcatcggctacaacataattcgggtgccgatggccagctgtgacttcagcatccgcacttacacatacgccgacaccccagatgatttccagctgcacaatttctcactacccgaagaagacactaagctaaaaatccccctgatccaccgcgcgctccaacttgcccaaagacccgtgagcctgctggctagtccctggactagccctacttggctgaaaacaaatggcgcagtgaatgggaagggtagtctgaaggggcagcctggggatatctaccatcagacttgggccagatactttgtcaaatttctcgacgcatatgcagagcacaaactacagttctgggctgtgacagctgagaatgaaccctccgccgggcttcttagcgggtaccctttccaatgtcttggattcacaccagagcatcaaagggatttcatcgctagagatcttggcccgacactggccaactccactcaccacaacgtgcggctactgatgctcgatgatcagcgactgctgcttccccattgggccaaagttgtgctcacagaccccgaagctgccaaatatgtgcatggaatagcggtgcactggtacttggactttcttgcccccgcaaaggccactctgggcgaaacccatagattgttcccgaatacaatgctgttcgcgagcgaagcttgcgtggggtccaaattttgggagcagtcagtacgactaggttcttgggataggggaatgcagtatagccatagtataataaccaatctgctatatcatgtggtgggatggacagattggaacctggccctgaacccagagggggggcctaattgggtacgaaacttcgtcgacagtcctatcatcgttgatattaccaaggacacattttacaagcagccaatgttttaccatctcgggcactttagcaaattcataccagagggctctcagagagtcggcctggttgccagtcaaaagaacgacttagacgccgtggctctgatgcatcccgacgggagcgcagtagtggtggttctgaacagatcgtcaaaggacgtccctttgactatcaaagatccagccgtgggattcctcgagaccatcagtccggggtattccattcacacctatctgtggaggcgccagtag

SEQ ID NO: 3781 - DNA, 1464 bp, Artificial Sequence
  Description of Artificial Sequence: Synthetic coding sequence
atggagttcagcagccccagccgggaggagtgccccaagcccctgtcgcgggtttctataatggccggatcactgaccgggctcctgctcttgcaggctgtgtcatgggccagcggcgctcgcccttgcattcccaaaagtttcgggtattccagcgtcgtctgcgtgtgcaatgcaacatattgtgactcgttcgaccctcccactttccctgccctggggacctttagcaggtacgaaagcacccgctctggtcggcgtatggagctgtccatgggccctatccaggccaatcacacaggcacaggcatagggtacaacattatccgggtgcccatggcttcctgcgatttttctatcaggacatacacatatgctgatactcctgacgactttcagcttcacaatttttcccttcccgaagaagatacaaagctcaagatcccattaattcatcgcgcgctgcagttggcgcagcgcccagtgtccctgctggctagcccctggacctcccctacgtggctgaaaacaaatggggcagtaaacggcaaaggtagcctgaaggggcagcccggcgatatttaccatcagacatgggcccgctattttgtcaaattcctggacgcttacgccgagcacaagctacagttttgggctgtcactgcagagaacgagccttccgcgggactgctctccggctacccttttcagtgcctgggtttcactccagaacatcagcgggacttcatcgcgcgagatttaggcccaactctggcaaacagcactcatcacaacgtccgtcttctcatgctagacgaccagcggttgctgctgcctcattgggccaaggtcgtacttacagacccggaagcagccaaatacgtgcacggtattgctgtccattggtatctagacttcctggcacccgctaaggccaccttgggagaaacccatcgccttttccctaataccatgttgtttgcctccgaggcttgtgtggggagcaaattttgggagcagtccgtgcggttgggttcttgggatcgaggaatgcagtattcacacagcataatcacgaacttactctatcacgttgtgggatggactgactggaatctggccctcaaccccgagggcggacctaattgggtacggaactttgtggattcacccattatcgttgatataacaaaggataccttttataaacagccaatgttctaccatctggggcactttagtaaattcattccggaaggctcgcagcgcgttggcttggtagcctctcagaaaaatgatctggatgcagtcgccctaatgcacccggacggctcagccgttgttgttgtgttaaatagaagctctaaggacgtgccgctcactatcaaggatcctgctgtcggattcctggaaactatttctcctggttattcaattcacacatacctgtggcgtaggcaatag

SEQ ID NO: 3782 - DNA, 1350 bp, Artificial Sequence
  Description of Artificial Sequence: Synthetic coding sequence
atggagctgagcatgggccccatccaggccaaccacaccggcaccggactactgctgacattacagcctgaacagaaattccaaaaggtgaaaggattcgggggcgccatgaccgacgccgcagcgctcaatattcttgcactgtcacctccggcacaaaatctgttactcaaatcctacttttcagaagagggaatcggatataatattattcgcgtgccaatggctagctgcgatttctccatccgcacttatacctacgcagatacgcccgatgacttccagctgcacaacttttctctgcccgaagaagacaccaaactaaaaatacctcttatacaccgtgcactgcagctcgcccaacgccctgttagcctgctggcttctccttggaccagtcccacctggctcaagacaaacggcgctgtgaatggaaaagggagccttaaaggccagcctggtgatatctaccaccaaacgtgggcgcgatactttgtgaagtttctcgatgcatatgcggaacataaactgcagttttgggccgtgaccgcagaaaacgagccaagcgcagggttgcttagcggctacccttttcagtgtctgggctttacccctgaacatcagcgggattttatcgcgcgcgacctgggtcccacattggccaactcaacgcaccataacgtgcgactgctgatgctggatgatcagaggctgctattgccgcattgggcgaaagttgttctgactgatccagaagcggccaagtatgtccatggaatcgcagtacattggtatctcgatttcttagctcctgccaaagctacactgggtgaaactcatagactgtttcctaataccatgctctttgcaagtgaagcctgcgtgggctccaaattctgggagcagtccgttaggttagggagctgggatcgtggtatgcagtacagccattcaattataaccaacctgctttaccatgtcgtgggctggactgactggaacctggcgttgaaccctgagggaggccccaattgggtccgcaactttgttgacagccccataatcgtcgacatcacaaaggataccttttacaagcaaccaatgttttaccacctggggcatttcagcaaattcataccagaaggaagtcaacgcgttgggctggtcgcttcgcagaagaacgatctggatgctgtggcccttatgcatcccgacggctcggccgtcgtcgtggtgctcaaccgtagtagcaaggacgttccattgacgattaaggaccctgctgtggggtttctcgagactatctcccccggatactctattcacacctacctttggagacggcagtag

SEQ ID NO: 3783 - DNA, 1482 bp, Artificial Sequence
  Description of Artificial Sequence: Synthetic coding sequence
atgaccctgcggggctggagcttccaggtgctgcccgagagcaacgctacctactgtgacagctttgacccacccacctttccagcactcggcactttttctcgatatgaatccacccggtctggacggcggatggaactttccatgggcccaattcaagctaatcatactggtactggcttgctgctcactcttcagccagagcagaaattccagaaggtgaagggattcggaggcgccatgaccgacgcggccgcacttaacatactggcgctcagtcccccagcccagaacttgctcctaaagtcttatttcagcgaggaaggcatcgggtataatattataagagtccctatggcgagctgcgacttctccatccgaacctatacatacgctgacacaccagacgatttccagcttcataacttctccctgccagaggaagacaccaaactcaaaatacccctgatccaccgggccttgcagctagcacaacgcccggtgagtctgctcgcatcaccatggacctcgccaacttggctcaaaacaaacggggcggtcaacggaaaggggtcattgaaaggccaacccggggatatctaccaccaaacctgggccagatactttgtgaaattccttgatgcttacgctgaacacaagctgcaattttgggctgtcactgcagagaacgagccttccgctggtctcttatctggttaccctttccagtgccttggatttacgcccgagcatcagagggacttcatcgcgagagatctcggcccaacccttgctaacagcacccaccacaatgtgcgtttgctaatgctggatgatcagaggctccttttgcctcattgggccaaagtagtgctgacagatccagaggccgcgaaatacgtccacggcatcgcagtgcactggtaccttgactttctcgccccagctaaggctactctgggggaaacacatagactctttcctaacacaatgctatttgcatccgaggcctgtgtcggaagcaagttctgggagcaatccgtcagacttggcagctgggaccgggggatgcagtatagccacagcatcatcacaaatctgctgtatcacgtggtgggttggaccgattggaacttggcgcttaatccggaaggaggcccgaattgggtgagaaattttgtggattcaccaatcatagtcgacattaccaaagataccttttataagcagccgatgttttatcacctcggtcacttctcaaagtttatacctgagggctcacagagagtgggtcttgtggcctcacagaaaaacgacctggacgcagtggctctgatgcaccctgatgggtctgcggttgtggtcgttttgaacaggagctccaaggacgtacccctgaccatcaaggaccctgccgtgggtttcctggaaacaatcagtccaggatactccatccacacatacctgtggagacgccagtag

SEQ ID NO: 3784 - DNA, 1272 bp, Artificial Sequence
  Description of Artificial Sequence: Synthetic coding sequence
atggagttcagcagccccagccgggaggagtgccccaagcccctgagcagagtgtccattatggcgggctccctgactggattactgcttctgcaggccgtcagctgggccagcgggatcggatataatatcattcgggtccccatggcgtcctgtgatttttccatccggacatacacgtacgctgatactcccgatgatttccagttgcacaatttctctctgcccgaagaggacacgaagctgaaaatccctctgatacatcgggcgctgcagctagcgcagagaccggtctcacttctcgctagtccctggacttcccctacatggttgaaaacaaatggggccgtgaatggcaaggggagtctcaagggccagcccggggatatttatcatcagacttgggcaaggtatttcgtgaaatttctggatgcctacgctgagcacaagctgcagttctgggccgtgaccgcagagaatgagccctctgccgggcttctctccgggtatcctttccaatgcctgggtttcacaccagagcaccaaagggacttcatcgccagggacctgggccctaccctggctaattctacccatcataacgtacgactactgatgctggacgaccagcgtctcctgctgccccattgggcaaaagttgtcctgaccgatcccgaagctgctaagtacgtgcatgggatcgcagtccactggtacttagattttctcgcccctgccaaagcgaccctcggggagacccatcgtctttttcccaatacaatgctgttcgccagcgaggcttgcgttggatcaaaattctgggagcagagtgttcgactgggatcatgggacagaggcatgcagtactctcactccattattactaatctgctgtatcacgtggtagggtggaccgactggaacctggcccttaatcctgaaggggggcccaactgggttaggaattttgtggacagccccatcatagtggatatcaccaaggataccttctataagcagcccatgttctatcacctgggccacttctcgaaatttattccggagggcagccaaagagttggactagtggccagccaaaagaatgacctcgacgccgtggcgcttatgcaccccgacggctctgcagttgtcgtagtgctcaacagatcttcaaaggacgtccctcttactataaaggatcctgcggttggatttctggagacaatttcacccggatattctatacacacatacctgtggcgacggcagtag

SEQ ID NO: 3785 - DNA, 2112 bp, Artificial Sequence
  Description of Artificial Sequence: Synthetic coding sequence
atgctgcggggccggagcctgagcgtgaccagcctgggcggcctgcctcagtgggaagttgaagagcttcctgttgaagaactgctcctatttgaggtggcttgggaggtcaccaacaaagtgggggggatatatacggtgatacagacaaaagctaagacaactgctgacgagtggggcgagaattattttcttatcggcccgtacttcgagcacaacatgaagactcaggtcgagcagtgcgaacccgtaaatgacgcagttaggcgcgctgtcgatgcaatgaataagcatggatgtcaggtgcacttcgggagatggctgatcgaaggcagcccttacgtggtcttatttgatattggctatagcgcctggaaccttgacagatggaagggcgacctgtgggaggcgtgctcagtggggattccgtaccatgatagggaagccaatgatatgctcatcttcggatccctcacagcttggttcctaaaggaggtaacggaccatgccgacggaaagtatgtcgtcgcccagtttcacgagtggcaggccggcattgggctcatcttatccagggccaggaaacttccgatcgccactatcttcaccacgcacgctacactgttaggccggtatctgtgcgcggcgaatattgacttttacaatcacttggacaaattcaacattgataaggaagcgggcgagagacagatttatcacagatactgcatggagagagcctccgtgcattgcgcgcatgtctttaccaccgtgagtgaaattacagccattgaggctgagcacatgctcaagagaaagccagatgtggtgacgccaaatggattgaatgttaagaagttcagcgcagtgcacgaatttcaaaacttgcacgccatgtataaagcacgcattcaagactttgtgaggggtcatttctatgggcatcttgactttgacctcgagaagaccctgttcctgtttattgcgggaaggtatgagttctcaaacaaaggcgcagatattttcctagagagcctgagtagattaaactttctgttgagaatgcacaagtccgatataaccgtgatggtgttctttattatgcccgccaagacgaataatttcaacgttgaaactctcaaaggccaagccgtccggaagcagctttgggatgtggcccacagtgtgaaggagaagtttgggaaaaagctctacgacgcgcttctacgcggcgagatcccagacctgaacgacatcttagatcgggatgatcttactatcatgaagcgggcaatcttcagtacacaacgccagagcctgccccccgtcaccacgcacaacatgattgatgactctacagaccccatcctcagcacaatccgccggattggcctgtttaataacagaacagaccgggttaaggttattctccacccagagttcttaagttccacaagccccctgttacccatggattatgaggagttcgtgaggggatgccatctcggcgtgttcccttcttactacgagccttgggggtacacgccagctgagtgcactgttatgggaattccctctgttaccaccaacctgtccggctttgggtgctttatgcaggagcacgttgcggatccgacggcttacggcatctatatcgtcgatcgcaggtttcggtcccctgatgatagctgcaaccagctcactaagttcctgtacggcttctgcaagcagtctaggcgtcagcgtattatccaacgcaacaggactgagcggctctcagatctgcttgattggaggtacttgggaaggtattaccagcacgcccggcatttaaccctcagccgagcctttcccgacaagtttcatgttgaactgacatccccccctaccaccgaaggcttcaaatatcccaggccctcaagtgtgcctccatccccctccggctctcaggcatcctcaccgcagtcaagtgatgtggaagacgaggtagaagacgaacgctatgacgaggaggaggaggccgagcgcgatagactgaatatcaagtcccctttttcactgtcacatgttccacatgggaaaaaaaaactgcatggtgagtacaagaactag

SEQ ID NO: 3786 - DNA, 351 bp, Artificial Sequence
  Description of Artificial Sequence: Synthetic coding sequence
atggactactaccggaagtacgccgccatcttcctggtgaccctgagcgtttttctacatgtgctccacagcgcccccgacgtacaggactgtccagaatgcactcttcaggagaacccattctttagccagccaggagccccaattctgcagtgtatgggctgttgtttttccagggcctatcccacccccttaagaagcaaaaagactatgcttgtccagaaaaacgtgactagtgagtccacctgctgcgtcgctaagtcctacaatcgggtgaccgtgatgggcgggtttaaggtggaaaaccacactgcttgccactgctcaacatgctactatcacaagagttag

SEQ ID NO: 3787 - DNA, 654 bp, Artificial Sequence
  Description of Artificial Sequence: Synthetic coding sequence
atggccaccggcagccggaccagcctgctgctggccttcggcctgctctgtctgccgtggctccaggaaggctctgcctttcctactattcccctgagtagactgttcgacaatgccatgctccgggcccaccggctgcaccagcttgcgtttgacacttaccaagagttcgaggaggcctacatccctaaggagcagaagtactcatttctacagaatcctcagacctccctgtgcttcagtgaatcgattcctactccatcaaacagagaggaaacccagcaaaagagtaacctagagttactgcgaattagtctgctcctgatccagagttggcttgaacccgtgcagtttttacgatctgtttttgcaaactcgctggtctatggcgcttcagattccaacgtctacgacctgctaaaagacctcgaagagggcattcagacactcatgggaaggcttgaggacgggagccccaggacggggcaaatcttcaagcagacatattctaaattcgacactaatagtcataatgatgacgcactgctcaaaaactatgggctgttgtattgcttcaggaaggacatggataaggtcgaaacttttctgaggattgtgcaatgccgttctgtggagggcagttgcgggttctag

SEQ ID NO: 3788 - DNA, 369 bp, Artificial Sequence
  Description of Artificial Sequence: Synthetic coding sequence
atggccaccggcagccggaccagcctgctgctggccttcggcctgctttgcctcccttggctgcaggaaggctccgccttccctactattcctctttcgcgcctttttgataacgcaatgctgcgggcacacagactgcaccagctggccttcgatacctaccaggaattccggctggaagacgggtccccccgaaccgggcaaatctttaaacaaacctacagtaagtttgacaccaattcccacaatgatgacgcccttctaaagaattacgggttattgtactgcttccgtaaagacatggacaaagtggagacattcctgaggattgtccagtgcaggtccgtagaggggtcctgcgggttttag

SEQ ID NO: 3789 - DNA, 534 bp, Artificial Sequence
  Description of Artificial Sequence: Synthetic coding sequence
atggccaccggcagccggaccagcctgctgctggccttcggcctgctgtgcctcccctggctccaggagggctccgcgtttcccacaattcctttaagcaggctttttgacaacgcgatgctacgggctcatcggttgcaccagctcgcattcgatacctaccaagagtttaacttggagctactgcgaatcagcctgcttctgatacaatcgtggctcgaaccagtacagttcttgcggtcagtgttcgccaactcactcgtgtacggtgccagcgactccaacgtatatgacctgctgaaagatctcgaggaagggatccagactcttatgggccggttggaggatgggtctcctagaaccgggcagattttcaaacaaacatactcgaagttcgacacaaattcacataatgatgacgctctcctcaaaaactatggactgctctactgcttccggaaagatatggacaaagtcgagacgttccttaggatcgtgcagtgtcggagtgtggaaggttcatgtgggttttag

SEQ ID NO: 3790 - DNA, 609 bp, Artificial Sequence
  Description of Artificial Sequence: Synthetic coding sequence
atggccaccggcagccggaccagcctgctgctggccttcggcctgctgtgcttgccatggctgcaggagggaagcgcattccccaccatcccgctcagtagactgtttgataatgccatgttgcgggcacatcggctacatcaactggctttcgatacctatcaggaattcaaccctcagacatctctatgtttctccgaaagcatcccaacaccatcaaatagggaggagacgcaacagaagagtaacctggaacttctccggatcagcctgctgctgattcagagctggctggaacccgtgcagttcctgcggtctgtttttgccaactcactcgtttatggcgctagtgatagtaacgtgtacgacctgctgaaggatttggaagaggggatccagactcttatggggagactggaagatggctcccccaggacaggccagatatttaagcagacttattctaagttcgacactaattcacacaatgacgacgccttattgaagaactacggcctcttgtactgctttagaaaagatatggacaaagtggaaacatttctacgtatagtacagtgcagatctgtggagggcagttgcggtttctag

SEQ ID NO: 3791 - DNA, 771 bp, Artificial Sequence
  Description of Artificial Sequence: Synthetic coding sequence
atggccgccggcagccggaccagcctgctgctggccttcggcctgctctgcctctcctggctgcaggagggaagtgcgttccccacgatcccactgagtcgccttttcgataatgctatgctcagagccaggagactctaccagctcgcatatgatacctatcaggaattcgaagaagcttatatcctgaaggagcaaaagtactctttcctgcaaaaccctcagaccagcctatgtttctctgagagcatcccaacaccaagtaaccgcgtaaagacacagcaaaagagtaacctagaactcctgaggataagcctgctgctaatccagtcctggctggagcccgtgcaactgctgaggtccgtctttgcgaattcactcgtgtatggggcatctgattcaaatgtgtacagacacctgaaggatctggaggagggaattcagacgttaatgtgggttcgggtggcgccagggattcccaatccaggagccccgctcgcttcccgtgactggggcgagaaacactgctgtcctctgtttagctcacaggctctgactcaggaaaactctccttattcctctttccctttggtcaatccacctggcctctccctgcagcccggaggtgaaggcggcaaatggatgaatgaacgaggtcgggagcaatgcccaagcgcctggcccctgttgctatttctccactttgcggaagctggaaggtggcaaccccccgactgggcggatctccagagcgtccttcagcaagtttag

SEQ ID NO: 3792 - DNA, 654 bp, Artificial Sequence
  Description of Artificial Sequence: Synthetic coding sequence
atggccgccggcagccggaccagcctgctgctggccttcggcctgctctgtctttcctggctccaggagggtagtgccttccccaccatccctctgagtaggttattcgacaacgctatgctgcgagcccgcaggctgtatcaactggcttacgatacctaccaggaattcgaagaagcctacattctgaaggagcagaagtactcttttctgcaaaacccccagacatctctctgctttagcgagagcattccgacaccatcaaacagggttaaaacgcaacagaagtctaatctggaactgctgcggatttcactattactgatccagtcatggcttgagccggtccagctgctccgcagcgtgtttgcgaatagtcttgtgtatggagcaagcgatagcaacgtgtaccgccaccttaaagatctcgaagaaggtatacaaacccttatgtggcgtctggaggacggcagtccccggactgggcagatctttaaccaatcgtactcaaagttcgacacgaagtcacacaatgacgacgcactgcttaagaattatggactgctctactgctttcggaaggatatggataaggtggaaactttcttgaggattgtgcaatgtagatccgtggaaggaagctgcgggttttag

SEQ ID NO: 3793 - DNA, 609 bp, Artificial Sequence
  Description of Artificial Sequence: Synthetic coding sequence
atggccgccggcagccggaccagcctgctgctggccttcggcctgctctgtctatcatggctgcaggaaggaagcgcctttccaacgattcccctctcaagactatttgacaacgcaatgctccgggctcgtagactctatcagctggcctatgacacataccaggaattcaacccgcaaacatcactctgcttctccgagtctatccccaccccgtcaaatagagtcaagactcagcagaaatccaatcttgaactcctacgcatctctctgctgctgattcagtcatggctggagccggttcagcttctgcggagcgtgtttgccaactccctggtttatggcgcaagcgactctaacgtgtatagacacttaaaagatctggaagagggtatacagactctgatgtggaggctagaggatggctcgccccggacaggtcagatattcaatcagtcctattctaagttcgatactaaatcacacaatgacgatgcgctgctgaaaaattacgggctgctttactgcttcaggaaagacatggacaaggtggaaacatttctgagaatcgtgcagtgtagaagcgtagagggcagctgtggattctag

SEQ ID NO: 3794 - DNA, 738 bp, Artificial Sequence
  Description of Artificial Sequence: Synthetic coding sequence
atggccgccggcagccggaccagcctgctgctggccttcggcctgttgtgcctgtcttggttgcaggagggatctgcctttccaaccatacctttgagccgattgttcgacaatgctatgcttcgcgcaaggcggttataccaactggcctacgatacctatcaggagtttgaagaggcgtacatcctgaaggagcagaagtactcctttttgcaaaaccctcagaccagtctttgtttttccgagagcattcccactcctagtaatagggttaaaacccagcagaagtctaaccttgaactcctacgaatatcactgcttttgatccagtcatggctggagccagtgcagcttttgagaagcgtcttcgccaatagtcttgtatatggggccagtgatagcaatgtgtaccggcacctgaaggacctcgaggagggaatccagacgttgattggatggaaaatggccgccccaggtctcggccggagctcgatatctccaactgcttctctgactcaaaacaggactacaatgacccattgtagccgcaccacagggtgttccactgcctcaggcagaacttggaccagaagcagacatagctgcgcctcgtgttctgcggccctttggcgcgcagctgtggccagcagttgtcccggcggcattcccgttacccctccgcagtgtctgtcctggagctggaaggtgttattacagtgccctcctgctctgtcctag

SEQ ID NO: 3795 - DNA, 753 bp, Artificial Sequence
  Description of Artificial Sequence: Synthetic coding sequence
atggagaagggccccgtgcgggcccccgccgagaagccccggggcgccaggtgcagtaacggcttccccgaacgggaccctccacgtccaggtccatcacgccctgcggagaagccccctagacctgaagcgaaatctgctcagccagctgacggatggaagggcgaacggccccggtccgaggaagacaatgagctgaatttgcctaacttagcagccgcatatagttccatcctgtccagcctaggggagaaccctcagcggcagggtctactgaaaacaccgtggcgtgccgcaagcgccatgcaattcttcaccaagggatatcaggagactatctctgatgtgctcaacgatgcaatctttgatgaggaccacgatgaaatggtgatagtgaaggatatcgacatgttcagcatgtgcgagcatcacctggtgccctttgttgggaaagtgcacattgggtacctgcccaataaacaagtcctcggactatccaagctggcccgcattgtcgagatttattcacggcgcctgcaggttcaagagcggctgacaaaacagatcgctgtcgcgattacggaggcactgcggcctgcaggcgtcggagtcgttgtggaggccacgcacatgtgtatggtgatgaggggtgtccagaagatgaatagcaagactgtgacatcgaccatgctaggagtgtttcgagaggatcccaaaacaagagaggagttcctgacactcattagatcttag

SEQ ID NO: 3796 - DNA, 693 bp, Artificial Sequence
  Description of Artificial Sequence: Synthetic coding sequence
atggagaagggccccgtgcgggcccccgccgagaagccccggggcgcccgatgttctaacggctttccggagagagatccccctcggccaggaccgagtaggcctgctgagaaaccaccccgacctgaagccaagtccgcgcaaccagcagatggctggaagggggaaaggccaagatctgaagaggataacgagctgaacttgcccaatctggcggcagcctactctagcatcctgagctcattgggagaaaacccccagagacagggtttgttgaagactccctggcgagctgccagcgctatgcagttcttcactaagggttatcaggagactatctcggacgtgctgaacgatgctatcttcgatgaggatcacgacgagatggtcatcgtaaaagatatcgacatgttctccatgtgtgagcatcatctggtgccattcgtcggcaaagtgcacatcggatatcttcccaataagcaagtgctcggcctctccaagcttgcccgcattgtggaaatctattccaggcggcttcaggttcaagaaagactgacaaagcagatcgcagttgctattactgaagccctccgtccagctggtgtgggagttgttgtggaagccactaaaagtaacaagtacaataaagggctaagttatttcctgctcgctacctttctgtggcagtattag

SEQ ID NO: 3797 - DNA, 753 bp, Artificial Sequence
  Description of Artificial Sequence: Synthetic coding sequence
atggagaagggccccgtgcgggcccccgccgagaagccccggggcgcaaggtgttctaatggatttcctgaacgcgatcctcctcgccctggacctagtcgccccgcagagaagccccctcgacccgaggccaagtccgcccagcccgccgacggttggaagggcgaaaggccgcgaagcgaggaagataacgaattaaatttgccgaacctagcggcggcctactctagtattctttcttccctgggagagaatccccagcgacagggattactgaaaactccttggagggccgcgtctgcgatgcagtttttcacaaagggatatcaggagacaatttctgatgtgctaaatgatgcaattttcgacgaagatcatgacgagatggtgattgtgaaagacatcgatatgttcagcatgtgcgagcaccacctggtcccttttgtggggaaggtgcatatcgggtatttacccaataagcaggttttaggactctcaaaattagcccgaatcgtggaaatatatagtagaagactgcaggtccaggaaagactaacaaagcaaatagcagtcgctatcactgaagctctgcgacccgccggagtaggagtcgtcgtcgaagctacccatatgtgtatggttatgcgaggtgtacaaaagatgaactcaaagactgttacctcgactatgctcggagtgttccgggaggatcccaaaacgcgagaagagttcctgacactgattaggtcgtag

SEQ ID NO: 3798 - DNA, 642 bp, Artificial Sequence
  Description of Artificial Sequence: Synthetic coding sequence
atggagaagggccccgtgcgggcccccgccgagaagccccggggcgcgcgctgttccaatgggttcccggagagagacccccctcgccccggtccctctcggccagccgagaaacctccccggccagaggccaaaagtgcgcagcctgctgatggttggaagggagagcggcccaggagcgaggaggataacgaactgaacttgcctaatctggcagctgcatacagcagcatcttgtcctccttaggggaaaatccccagaggcagggactgctgaaaacgccttggagagccgcctctgcgatgcagtttttcacaaagggatatcaagagactattagcgacgttcttaacgatgcgattttcgatgaggatcatgatgaaatggtaatagtgaaggacatcgacatgttctctatgtgcgagcaccacctggtcccgttcgtcggcaaggtgcacattggctatcttccaaataagcaagtgctcggcctcagcaagttggcacgtatcgtagaaatctacagccgccgtctccaagtgcaggaacggctgaccaaacaaattgccgttgcgatcactgaagcgctcaggcctgcaggggtcggtgtggtcgtggaagccacttcagcggaaccttag

SEQ ID NO: 3799 - DNA, 702 bp, Artificial Sequence
  Description of Artificial Sequence: Synthetic coding sequence
atggagaagggccccgtgcgggcccccgccgagaagccccggggcgccaggtgctccaatggattcccggagagagacccacctcggcctggcccatctaggcctgcagaaaaacccccccgcccagaggctaagtccgctcagccagcggatggatggaaaggagaacgacctcgatccgaagaggacaacgagctaaatctgccaaatctggctgccgcctatagctccattctctccagcctaggggaaaaccctcagcgccaggggttgcttaagactccctggcgagcagccagtgctatgcaattctttaccaagggctatcaagaaactatatccgacgttctgaatgatgccatcttcgacgaagaccatgacgaaatggtcattgtgaaggacatagacatgttttccatgtgcgagcaccatctcgttccctttgtgggcaaggtgcatatcggctacctccctaacaaacaagtgctcggtctctctaaactcgcccggatagttgagatttatagccggagattgcaggtccaggagcgcctaaccaagcagatcgcagtggcgatcaccgaagccctaagacctgccggcgtaggagtagtggtggaggcgaccaagtcaaataaatataacaagggcctttcgcctttgctgtcttcttgccatctgttcgtcgcaatactgaagtag

SEQ ID NO: 3800 - DNA, 1014 bp, Artificial Sequence
  Description of Artificial Sequence: Synthetic coding sequence
atgggcccccgggcccggcccgccctgctgctgctgatgctgctgcagacagcagtacttcagggcaggcttttgcgtagccactctcttcactatctgttcatgggtgcatccgaacaggaccttggcctaagcctcttcgaggcattagggtacgtggacgaccaactgtttgtattctacgatcacgagtctcggcgtgtggaaccacggactccatgggtgagttccagaatcagttcccaaatgtggctgcagctatcccagtcactgaaaggctgggatcacatgttcacggtagatttctggaccattatggagaaccataaccactcaaaggaatcacacactctccaggtcatcctgggttgtgagatgcaggaggataatagcaccgaaggctactggaagtatggctacgacggacaggatcatctcgagttttgcccagataccctcgactggcgggctgctgagccacgagcctggcctacaaagttagagtgggagcggcataagattcgagcccgtcagaacagggcatacctggagagggattgtcccgctcagttacagcagctcctcgagctagggcgaggcgttttggaccagcaggtgcctccccttgttaaagtgacgcaccatgtcacctcttcagtgacaacactgcgatgtagagccctcaactattaccctcagaatatcaccatgaaatggctaaaggataagcaacctatggatgctaaggagttcgagcctaaagacgtgctgcccaacggtgacggcacttaccaaggttggatcactctggctgtgccaccaggagaggaacaaagatacacttgtcaagtcgaacaccccggtctggatcagcccttaatcgtcatatgggaaccctctccgagcggtactctggtgattggagtgatctctggcattgccgtcttcgtggtcattctgtttatcggtattctgtttatcatcttacggaagcgccaaggatcctcattctag

SEQ ID NO: 3801 - DNA, 771 bp, Artificial Sequence
  Description of Artificial Sequence: Synthetic coding sequence
atgggcccccgggcccggcccgccctgctgctgctgatgctgctgcagactgccgtgctccagggcagattattacgcagccatagcctgcactatcttttcatgggcgctagcgagcaggatctcgggcttagtctctttgaagcattagggtacgtggacgaccagctcttcgtgttctatgaccacgaaagtaggagagtagagcctcgtactccatgggtcagctctaggatatcttcccagatgtggctacagctttcccaaagtctaaaaggttgggaccacatgttcacggtggacttctggaccattatggaaaaccacaaccactcgaaggtcccccccctggtgaaagttacccaccacgtcacctccagcgttaccaccctccgctgtcgggcactgaattattaccctcaaaatatcacgatgaaatggcttaaggataaacaacctatggacgcgaaggaatttgagcctaaggacgtcctgcccaatggggacggtacttatcaggggtggatcactctggccgtgccacccggagaagaacaaagatatacgtgccaagtggagcaccccggactggaccaaccgcttattgtaatctgggaaccctctcccagcggcactctcgttattggcgtgatttctgggatcgcagttttcgtggtaatcctgtttattgggattttatttattatactgaggaaacgacagggatcaagaggcgctatgggacactatgttttggccgaacgtgagtag

SEQ ID NO: 3802 - DNA, 729 bp, Artificial Sequence
  Description of Artificial Sequence: Synthetic coding sequence
atgggcccccgggcccggcccgccctgctgctgctgatgctgctgcaaaccgcagttctacaggggaggcttctacgctcacacagcctccactatttatttatgggagctagcgagcaagacctgggactgtccttgttcgaagccttgggatatgtggacgaccaactgttcgtgttttatgatcacgaatcgcgtcgcgtcgaaccaagaaccccatgggtgagttctaggattagttcccaaatgtggctgcagttatcacagagcttgaagggttgggatcacatgttcacagtggatttctggacaattatggagaatcataatcacagtaaagtgaccaccttgcggtgcagggcactgaattactaccctcagaacattaccatgaaatggttaaaggacaagcagcctatggacgcaaaggagttcgaacccaaagacgtgttacctaatggcgatggcacttatcagggatggattaccctggccgtgccacctggagaggagcaacgctatacatgccaggtggaacatccagggctcgaccagcctcttattgtgatttgggagcccagccccagtgggaccttggttattggcgttatttcaggcattgccgtgtttgtcgtgattttgttcattgggattctgtttatcatacttcggaagcgacaaggaagccgaggagcaatgggccactacgtgctcgccgaaagagagtag

SEQ ID NO: 3803 - DNA, 783 bp, Artificial Sequence
  Description of Artificial Sequence: Synthetic coding sequence
atgggcccccgggcccggcccgccctgctgctgctgatgctgctgcagactgccgttctccagggcagacttctccagtcacacactttacaggtaattctgggctgtgagatgcaagaggataactccaccgaagggtattggaaatacggctacgatggacaagaccacctcgagttctgccccgatacccttgattggcgtgcagctgagccccgagcctggcctacgaaattggagtgggaaagacacaagatccgtgcgcggcaaaacagagcatacctggaaagggactgccctgcgcagctgcagcagttactagagctaggacgaggagtgctggaccagcaagtgcctccattggtaaaggtgacacaccatgtaactagcagtgtgacaacgctgaggtgccgagccctgaactactatccacagaatattacaatgaaatggcttaaggacaaacagcctatggacgccaaagaatttgaacctaaggacgtgcttcccaatggagatggtacatatcaaggctggattaccctcgcggtgccacccggcgaggaacagcgatacacctgtcaggtagagcatcccgggctagaccagccgctaatcgtcatctgggagccgagcccctccggcactctggtaataggtgtgatctctggcatagctgtgtttgtcgtgattttatttataggaatcctattcatcatactccgtaagcggcaaggatctcggggcgctatgggccattatgttctcgctgagagggagtag

SEQ ID NO: 3804 - DNA, 231 bp, Artificial Sequence
  Description of Artificial Sequence: Synthetic coding sequence
atgggcccccgggcccggcccgccctgctgctgctgatgctgctgcagaccgcagttttgcagggtagactgttgcagccctccccttcgggcacattggtgatcggtgtcatcagtggcatcgccgtgttcgtagtgatattattcatcggaatcctgttcataatactgaggaagcgtcagggctcccgcggggcaatgggtcattacgtattagctgaacgcgaatag

SEQ ID NO: 3805 - DNA, 507 bp, Artificial Sequence
  Description of Artificial Sequence: Synthetic coding sequence
atgggcccccgggcccggcccgccctgctgctgctgatgctgctgcagacggctgtgctccagggccggctgcttctgccacctcttgtaaaagtgacccatcacgtcacctcctcggtcaccaccctccgctgccgagcattgaactattacccacagaacattaccatgaagtggctgaaggataagcagccaatggacgctaaagagttcgaacctaaagatgttctaccaaatggagacggcacctaccagggttggatcacattggccgtgccaccaggagaagaacaaaggtacacctgtcaggtagaacacccagggctggaccagcctctgattgtcatttgggaaccgtctcccagcggcacactcgtcatcggcgtgataagtggtatcgctgtgttcgtggtgattctgttcattggcatcttgtttattatcctgagaaaaaggcagggcagccgcggagccatgggacactacgtgctggctgagagggaatag

SEQ ID NO: 3806 - DNA, 1047 bp, Artificial Sequence
  Description of Artificial Sequence: Synthetic coding sequence
atgggcccccgggcccggcccgccctgctgctgctgatgctgctgcagaccgccgtactccaggggaggctgctgcggtcacattctctgcattatttattcatgggagccagtgaacaggaccttggtctgagtctgtttgaggccctggggtacgtggacgatcaactgtttgtattctacgaccacgagagccggcgggtggagccgcgaactccatgggtgtcctcccgcatctctagccagatgtggctgcagttgtcccagagtttaaagggatgggaccacatgtttactgtcgacttttggaccatcatggaaaaccataaccactccaaggaatcccacacgcttcaggttattcttggctgtgagatgcaagaggacaattctactgagggatactggaaatatgggtacgatggccaggaccacctagagttttgtccagacacacttgattggcgggctgcagagccaagggcttggcccacgaaactggagtgggaaaggcataagataagggcaagacaaaacagggcatacctggagagagattgcccagcacagttacaacaactgctggagctcgggagaggagttctcgaccagcaggtcccccctctggtgaaggtgacacaccatgtgactagcagcgtgacaactctcaggtgtagagccttaaattattatccccagaacattactatgaaatggctgaaggacaaacagcctatggatgctaaagagttcgagccaaaggacgtccttcccaatggcgacggaacttatcagggctggattactctcgccgtaccacccggcgaggagcagcgttacacgtgtcaagtggaacacccaggactggaccaacccttaatcgtaatctgggagccatctccaagcggcacactggtgataggcgtgattagtggaatcgctgtatttgttgtgatactctttatcggaattctgttcataatattaaggaaacggcaaggctcacgaggagccatgggacactacgtcttggccgagcgcgaatag

SEQ ID NO: 3807 - DNA, 978 bp, Artificial Sequence
  Description of Artificial Sequence: Synthetic coding sequence
atgggcccccgggcccggcccgccctgctgctgctgatgctgctgcagaccgctgtcctccagggtaggcttctgcccctcggatatgtggacgaccaactgttcgtgttctatgaccacgagtccagacgcgtagagccaaggacaccctgggtgagctctcgtattagcagtcagatgtggctgcaactgtcccaatccctgaagggatgggatcatatgtttacagtggatttttggactatcatggagaatcataaccacagtaaagagagccacaccttgcaggtcatattgggatgtgaaatgcaagaagacaattccacagaggggtactggaagtatggctatgatggccaggatcacctggagttctgtcccgacacactggattggcgggctgcagagcctagagcctggcctactaagctcgaatgggagcgtcataagatcagggcacgccagaaccgcgcctatctggaacgcgattgcccagcacaactccagcagctcctagaactgggacggggtgtcctggaccaacaagttcctccccttgtgaaagtgactcaccacgttacatcctccgtcaccacactccgttgcagggccttgaattactacccccagaacatcaccatgaagtggttgaaggacaagcagcccatggatgcaaaggaattcgagccaaaagatgtgctccctaacggggacggaacttaccaaggatggatcacactcgcagtgccccccggcgaagagcaacgctatacatgccaggttgaacatcccggattggaccagcccctcattgtgatttgggaaccttctccatcagggacactcgtcataggcgttattagtggaattgccgtgttcgtcgtgatcttgtttattgggattttgttcattattctgcggaagcgacaggggtctcggggcgccatggggcattacgtgctggccgaaagagaatag

SEQ ID NO: 3808 - DNA, 1005 bp, Artificial Sequence
  Description of Artificial Sequence: Synthetic coding sequence
atgggcccccgggcccggcccgccctgctgctgctgatgctgctgcagacagccgtcctgcaagggaggctgctgcgcagccacagcctgcactacctgttcatgggggctagcgaacaagatctgggtctaagtctcttcgaagcccttggttatgtagacgaccagctgttcgtcttttacgaccacgagagtaggcgcgttgagccacgcaccccgtgggtgtcgtcgcggatttcgagtcagatgtggctgcaactgtcccaatcactcaagggttgggatcatatgttcacggtcgacttctggaccattatggagaaccacaatcattctaaggaaagccatacacttcaggtgatcctggggtgtgaaatgcaggaggacaatagtacagagggctactggaaatacggatacgatggacaggatcatttagaattttgtcctgacactttggattggcgcgctgcggagccccgggcttggccaacaaagctggaatgggagagacataagattcgggctaggcagaatcgggcctatttagagcgggattgtcctgcccagctccagcagctcctcgagttgggccgaggcgtgctcgatcaacaggtaacaactcttcgttgtcgggctctgaactactatccccagaatattacaatgaagtggctgaaggacaagcagcctatggacgccaaggaatttgagccaaaggatgtcctccccaatggagatgggacctatcaaggctggatcactctagctgttccccccggcgaggagcagcggtatacctgtcaggtggaacatccagggttggaccagccacttattgttatctgggaacccagcccgtctgggaccctcgtgatcggcgtgataagtggcatcgcagtctttgttgtcattctgttcatagggatcttgttcatcattctgaggaagcgacaggggtcccgaggagctatggggcattacgtattggcggaacgcgaatag

SEQ ID NO: 3809 - DNA, 1038 bp, Artificial Sequence
  Description of Artificial Sequence: Synthetic coding sequence
atgggcccccgggcccggcccgccctgctgctgctgatgctgctgcagaccgcagtactgcaggggcgtctgttaagaagtcattccctccactacctcttcatgggggcatccgaacaggatctgggcttgtcccttttcgaagctctgggctacgtggacgatcaattatttgtcttttacgatcacgaatctaggagagtggagccgaggaccccatgggtttccagccgcattagctctcagatgtggctacaactgtcacaatcgttgaaggggtgggatcacatgttcaccgtggatttttggactattatggagaaccataaccattctaaggagagccataccctgcaggtgatcctgggctgtgagatgcaggaggacaatagtactgaaggctactggaagtatggctatgacggtcaggaccatcttgaattctgccctgacaccttagattggcgggctgcggagccgagagcctggcccacgaagctggagtgggagcgacataaaattagggcaaggcaaaatcgcgcttacttggaacgagattgtcctgctcagttgcagcagctgcttgaacttgggcggggagtccttgaccagcaagaaggaagcgagtccagtagtctgcctggcaaggtgacaaccctcagatgccgggccctgaactattacccccagaatatcacgatgaaatggctcaaggataagcagcctatggatgccaaagagtttgaaccaaaggacgtgctgccaaatggggatggcacgtatcaaggttggatcactctcgcagtgcctcctggggaagagcagcggtacacctgccaggtggagcacccaggtctcgaccagccactgatcgtcatttgggagcccagtcctagtggaacccttgtgattggggtgattagcggaattgctgtgttcgtagtgattctgttcattgggattttatttattattctgcgcaaaagacagggaagtcgaggagccatgggtcactacgtcctcgctgagcgggagtag

SEQ ID NO: 3810 - DNA, 741 bp, Artificial Sequence
  Description of Artificial Sequence: Synthetic coding sequence
atgggcccccgggcccggcccgccctgctgctgctgatgctgctgcagactgcagtacttcagggtaggcttctgcagtcgcacacactgcaggtgatcttgggctgcgagatgcaggaagacaactccacagaggggtactggaaatacgggtacgatggtcaggatcacctggaattctgccccgacaccctggattggcgcgcagccgaaccccgcgcttggcctacaaaactggaatgggagaggcacaagattcgggctcgccaaaacagggcttacctcgaacgggattgtcctgcacagttgcagcagctgctcgaactaggaagaggagtccttgaccagcaggttacaactcttcgctgtcgagcccttaattattacccacagaacatcactatgaagtggcttaaggacaagcagcccatggacgccaaagagtttgagccaaaagacgtgctgcccaacggagatggaacataccagggatggattactctggccgtgccccccggcgaggaacagcggtacacctgccaggtggaacaccccggcctggatcagcccctgatcgttatctgggagcccagtccctccggaacattggttataggtgtaatcagcggcattgccgtgttcgtcgttatccttttcattggcattctattcattattttaagaaagcggcagggatccagaggggctatgggacactacgttcttgctgagagggaatag

SEQ ID NO: 3811 - DNA, 486 bp, Artificial Sequence
  Description of Artificial Sequence: Synthetic coding sequence
atgggcccccgggcccggcccgccctgctgctgctgatgctgctgcagaccgctgtgcttcaggggaggctgctccggtcccatagcttgcactatctttttatgggggcctccgaacaagacttgggtttgtccttgttcgaggctcttggctacgttgatgaccagttattcgtcttttacgaccatgaatccaggcgagtggaacccaggacaccctgggtaagcagccggatatcatcccagatgtggctccaactgtcccagtccttaaaggggtgggatcacatgttcaccgttgacttctggaccattatggagaatcacaaccacagcaaagaatcccacactcttcaagtcattctgggatgtgaaatgcaggaggataattcgacggaggggtattggaagtatggatacgacggccaagtgctgcaagacaccatctactcatccgaggtttcgagtctggggatcaagttctag

SEQ ID NO: 3812 - DNA, 366 bp, Artificial Sequence
  Description of Artificial Sequence: Synthetic coding sequence
atggagaaccacaaccacagcaaggagagccacaccctgcaggtgatactgggttgcgagatgcaggaggacaacagtacagaggggtactggaagtacggatacgacgggcaagatcatttagaattctgccccgatactctggactggcgggccgcagaacctcgcgcttggccaaccaagctggagtgggagaggcacaaaatccgcgcccggcagaaccgtgcgtacctcgaacgagactgcccagctcagctgcagcagctcttggagctcggtaggggcgtgctcgaccagcaggtgcctcccttggttaaggttacgcatcacgtgagccatccagcccagccctcgaaggaaagctag

SEQ ID NO: 3813 - DNA, 1281 bp, Artificial Sequence
  Description of Artificial Sequence: Synthetic coding sequence
atgggcgagcccggccagagccccagcccccggagcagccacggctccccgcccactctctctaccctgaccctgcttctgcttctctgtggccatgctcatagccagtgtaaaattctgagatgtaatgccgaatatgtgtcaagcacacttagtctaagaggaggcgggtcctccggcgcactgcgcggcggcgggggcggcggacgggggggaggagtggggtcaggaggtctgtgtcgggcccttagaagctatgccctctgcacacggagaaccgcaaggacgtgcagaggcgacttggccttccacagcgccgtgcacggcattgaggatctgatgatccagcataactgctctcgacagggacccacagccccccctcccccacgcggaccagccctaccgggagccggatccggattgcccgctcccgatccatgcgattatgagggacggttcagccgcttgcatgggcggccacccggatttctccattgcgcctcattcggcgatccgcatgtacggagttttcaccatcatttccacacgtgtagggtgcaaggagcatggccattgctggacaacgactttttgttcgttcaggcaacgtcgagccccatggcgttgggtgccaacgccaccgcgacccggaaattaacgattatcttcaagaacatgcaggagtgcatcgatcagaaggtctaccaggccgaagttgacaatctgcccgtggccttcgaagatggttctatcaatgggggggatcgtcctgggggcagcagcctttccatccaaacagccaaccccggcaatcacgtagaaatccaggctgcatacatcggcacaacaataatcattaggcagacagcgggacaactgagcttttctataaaggtggcggaggatgtggctatggccttttcagcagagcaggatctccagttgtgtgtaggcggctgtccgccttcgcagaggctgtctagaagtgaacggaatcgcagaggcgccatcacgattgacactgcacgtagactgtgcaaagagggtttgccagtagaggatgcatactttcatagctgcgtttttgacgttctgatttcaggcgaccctaactttacggtggcagcgcaagccgccttagaggacgcccgggcctttctgccagatctggaaaagcttcacttgtttccttcagatgctggagttcctctgtcttccgctaccctgctcgcaccactgctgtccggcctcttcgtgctatggctgtgcattcagtag

SEQ ID NO: 3814 - DNA, 942 bp, Artificial Sequence
  Description of Artificial Sequence: Synthetic coding sequence
atgatccagcacaactgcagccggcagggccccaccgcccccccccctccacggggccctgctctccccggcgccggctcaggcctccctgcccccgacccctgcgactacgaggggaggttctcccgcctgcatggaaggccgcctgggtttctccattgtgcaagctttggagaccctcatgtgagaagttttcatcaccacttccacacctgcagggtgcagggagcctggccacttctggataacgatttcctgttcgtacaggccactagctcccctatggctttgggggcaaacgctacagccacacgcaaactcacaatcatcttcaagaatatgcaggagtgcatcgatcagaaagtgtatcaggccgaggtagataatctgccagtggctttcgaggatgggagcattaacggcggagataggcccggcgggtcaagcctttccattcaaacagcaaaccccggcaaccatgtcgagattcaggccgcttacatcggtacaacaataattatacggcagacggccggccagctttcattctccataaaagtggcggaagatgtcgcaatggcatttagcgcggaacaggatttgcaactgtgcgtgggcggatgcccaccaagccagaggctgagcaggagcgagcgcaatcgaagaggagccatcacaatagatacagcaagacgtctttgcaaagagggtctgcccgtggaggatgcttatttccattcctgcgtgtttgatgtcctcatctctggggaccctaattttaccgtggccgcacaggcagccctggaagatgccagggcattcctgccggatctggagaagctgcatctcttcccttctgatgcaggcgtacctttgtcttcggctactctgctggcgccgctgctgtccggcttgtttgtcctgtggctttgtattcagtag

SEQ ID NO: 3815 - DNA, 282 bp, Artificial Sequence
  Description of Artificial Sequence: Synthetic coding sequence
atgggcgagcccggccagagccccagcccccggagcagccacggctcgccaccaaccctgtccactcttaccctgttgcttctgttatgtggtcacgcccacagccagtgtaagattctgcggtgcaacgcggagtacgtatccagcacgctgtcgctgagggggggtggctcatccggggccctcaggggtggtggggggggtgggcggggaggcggcgtggggtctgggggcctgtgcagagctctccgctcctacgccctgtgcaccaggaggacatag

SEQ ID NO: 3816 - DNA, 603 bp, Artificial Sequence
  Description of Artificial Sequence: Synthetic coding sequence
atgcaggagtgcatcgaccagaaggtgtaccaggccgaggtggacaacttgccagtagcctttgaagacgggagcatcaacggcggagacaggccaggcggaagttcgctctccattcagacggcaaatcccggcaaccatgttgagattcaagccgcatacatcggcaccaccatcattattaggcagacggccgggcagctgagcttctctatcaaggtggctgaagacgtggctatggcgttctccgcagaacaagatttgcagctgtgtgtgggcgggtgtccgccgagtcagagactctcgcgctccgagaggaacaggcggggcgccattacaattgacacagctcgcaggttgtgtaaagagggattaccagtagaggatgcgtactttcactcttgtgtgttcgacgtgctcatcagcggggatccaaacttcactgtggccgcgcaggcagcactggaggacgcccgggccttccttccagatctggaaaaactgcatctcttccccagtgatgcgggagtcccattatcttctgcaacactgttggcaccccttctgtcagggctgtttgtgctttggctgtgtatacagtag

SEQ ID NO: 3817 - DNA, 603 bp, Artificial Sequence
  Description of Artificial Sequence: Synthetic coding sequence
atgcaggagtgcatcgaccagaaggtgtaccaggccgaggtggacaacctacctgtggccttcgaggatggatctattaatgggggggaccggcctggtggttcatccctgagtatccagacggctaaccccggtaaccatgtcgaaatacaggctgcttatataggcactacaatcatcatccggcagacagctggtcagctcagtttctctattaaagtcgccgaggatgtggcaatggcatttagcgcagaacaggacctccagctgtgtgttggcggatgtcctcccagtcagaggttatcaagatccgaaaggaatcgcagaggagccattacgattgataccgctagacggctgtgcaaagagggtcttccagtcgaagacgcctatttccatagctgtgtcttcgatgtcctaatcagcggagatcctaatttcaccgtggcggcccaggcagctttggaggatgctcgggccttcctgcctgacttggagaagctgcatttgtttcctagtgacgccggtgtgcccttgtcctcggcgaccctgctggccccccttctctcaggcttattcgtactctggctttgtatccaatag

SEQ ID NO: 3818 - DNA, 603 bp, Artificial Sequence
  Description of Artificial Sequence: Synthetic coding sequence
atgcaggagtgcatcgaccagaaggtgtaccaggccgaggtggacaatttacctgttgcgttcgaggacggttcaatcaacgggggggatcgtccaggcggcagcagtctgagcattcagactgccaaccccggcaatcatgttgagattcaggctgcctacatcggcaccacaatcatcatacgtcagactgccggacagttatccttctctatcaaggtggcagaagacgttgccatggccttttcggctgagcaggacctgcagctctgtgtgggaggctgccctccaagtcaacgcctctctaggtcagagagaaaccgaaggggcgccatcacaattgataccgccagacgtctatgtaaagagggtcttcccgtggaggacgcatacttccacagctgcgttttcgacgttcttatatcaggagacccaaacttcacagtggccgctcaggccgccttggaggacgctcgggcatttctccccgacctcgaaaagctgcacttgtttccttccgatgcaggcgttcctctgtcctcggctactttgctcgcaccattgctgagtggactgttcgtgctatggttatgtatccagtag

SEQ ID NO: 3819 - DNA, 603 bp, Artificial Sequence
  Description of Artificial Sequence: Synthetic coding sequence
atgcaggagtgcatcgaccagaaggtgtaccaggccgaggtggacaacctgccagtcgcgttcgaagatggctcgattaatggaggcgacaggcctggtggcagctcactcagcatccagaccgccaaccctggcaatcatgtggagatccaggccgcatatataggtactactattattatccgccagactgcgggacagttatcattcagtatcaaagtggccgaagacgtggcaatggctttcagtgcggaacaggatttgcagctgtgtgtcggtggatgccctccaagccaacgactgtctcggagcgaaaggaaccgccggggcgctatcacaattgacactgccaggcgcctgtgtaaagagggtctccccgtagaggacgcatatttccattcttgcgtcttcgacgtgctgatttctggcgatcctaacttcaccgtcgcagcccaggcggctctggaagatgcaagagcattcctccctgacctagaaaaactccacctcttccctagcgacgctggggtgcctttgagctccgcgacgctcctggcccctttacttagtgggctttttgtgttatggctgtgtatccaatag

SEQ ID NO: 3820 - DNA, 1905 bp, Artificial Sequence
  Description of Artificial Sequence: Synthetic coding sequence
atgcccagcgacctggccaagaagaaggccgccaagaagaaggaggccgctaaggcccgccagagaccgcggaaggggcatgaagaaaatggtgatgtcgttaccgaaccccaagtcgcagaaaagaacgaggccaatgggagagagactaccgaggtggacttgcttacgaaagagctggaggactttgagatgaaaaaagccgccgcaagggcagtgacgggtgttctggcttctcaccccaattcaacagatgtgcacatcatcaatttgtcgttgactttccacggccaggagctgttgtcggacacaaagctggaactgaacagcggaagacggtatggcctgatcgggttgaatgggatcggcaaatccatgcttctctccgcaatcggaaaacgagaagtgcctattcctgagcacattgacatttaccatctgacacgtgaaatgccccctagtgacaagactccattgcattgtgtcatggaagtggatactgaaagagccatgctggaaaaggaagccgaacgccttgcccacgaagacgctgaatgcgaaaagctaatggagctgtacgaaaggctggaggagctggatgccgacaaagctgaaatgagggctagccgaatcctacacggactcggtttcacacccgcaatgcagcggaaaaaacttaaggacttcagcggaggttggagaatgagggtcgccctagcgagagcattgttcatcagacctttcatgctcctgctggacgagcccaccaatcacttggatcttgacgcctgcgtctggcttgaggaggaattaaagacctttaaacgcatcctggtgttagtgtcccacagccaggacttcctgaatggcgtttgcaccaacattatacacatgcataacaaaaaactcaaatattatacaggtaactatgatcagtacgtaaagaccagactcgaactggaagagaaccaaatgaagcggtttcattgggaacaggaccagattgctcatatgaagaattacatcgctcgcttcggccatggctcagcgaagctggctcggcaggctcagtctaaagagaaaacccttcagaagatgatggcaagtggtctgacggagcgtgtggtgagtgataagaccctcagcttttattttcctccatgcggcaaaatacctccgcccgtgatcatggtgcaaaacgtctcatttaagtacaccaaggacggtccgtgcatctataataatttagaatttgggatagatctggacacccgagtagccttagtcggtcctaatggggcggggaaaagtacattactgaagttgctgactggggaactgttgcctacagatggcatgatcaggaaacattcccacgtgaaaatcggtcgctaccaccaacacctgcaagagcagctggatctcgacctgagcccactggaatatatgatgaaatgctacccagagatcaaagagaaggaagaaatgcgcaaaattatcgggcggtatggtctaacgggtaaacagcaggtgtcgcccattcggaacctatccgatggccaaaaatgtagggtctgcctcgcatggctggcatggcaaaacccccatatgttgtttcttgatgagcctactaatcatctcgatatagagaccattgacgccctggccgatgctattaacgagttcgagggaggcatgatgctggtgtcccacgattttaggctcatccaacaggtagctcaagaaatatgggtgtgcgagaaacagacaattacgaaatggcccggcgatattctcgcttacaaggaacacctgaaaagcaaactcgtcgatgaagaaccgcagttgaccaagcggactcataatgtgtgtacactgacattggctagtctacctagaccttag

SEQ ID NO: 3821 - DNA, 555 bp, Artificial Sequence
  Description of Artificial Sequence: Synthetic coding sequence
atgtgggtgaccaagctgctgcccgccctgctgctgcagcacgtgcttttgcacctgctgctcttacccatagccatcccatatgccgagggccagcgcaagagaagaaacacaatacatgagtttaagaagtctgctaagaccacgttgatcaagatagaccccgcgctgaaaattaagactaaaaaggtaaataccgcggaccagtgtgcaaaccggtgcacaagaaacaaggggctgcccttcacatgtaaggcctttgtgtttgacaaggcaagaaaacagtgcctctggttcccttttaactccatgtcttccggcgtcaagaaggaatttgggcatgaatttgatctctatgagaataaggactatatcaggaattgcattattggcaaaggccggtcgtataaaggaactgtgagcatcactaagtctggaattaagtgtcaaccctggtcctctatgatcccccatgagcatagcggaggcgatgattgtttggttgagagcaccttctactccatcccattctgggggcacaactcagcgcggtag

SEQ ID NO: 3822 - DNA, 891 bp, Artificial Sequence
  Description of Artificial Sequence: Synthetic coding sequence
atgtgggtgaccaagctgctgcccgccctgctgctgcagcacgtgcttctccatttgctgttgctgccaatcgcaattccttacgccgagggtcaacgaaagcgtagaaatacaatacatgaattcaagaagtcggctaagactactctgattaagattgatcccgccctgaagataaagaccaagaaggtcaatacagccgaccagtgtgccaacagatgtacccggaataagggcctgccattcacatgtaaggccttcgtgttcgacaaagcccgcaagcagtgtctctggttcccctttaatagtatgtcttcaggcgtaaagaaggaattcggccacgagttcgacctgtacgagaacaaagactatatccgcaactgtatcattggaaagggaagaagctataagggaaccgtatccattaccaagagcggcatcaagtgtcagccctggtcctccatgatacctcatgaacattcatttctgccatcatcctaccgcgggaaggacttacaagagaactattgtcgcaaccccagaggggaggagggcggtccctggtgttttacatccaacccagaagtgcgatatgaggtttgcgatatccctcagtgctcggaggtggaatgcatgacatgcaacggggagagctatcggggactgatggaccacactgagtcaggcaagatttgtcagagatgggaccaccagaccccccatcgccacaaattcctccctgagcgttatcctgacaagggctttgatgataattactgcaggaatcccgacggacaaccacgtccgtggtgttatacgctggatccgcatacccgctgggaatattgtgcaattaaaacctgcggggacattacctgggccctgaactag

SEQ ID NO: 3823 - DNA, 426 bp, Artificial Sequence
  Description of Artificial Sequence: Synthetic coding sequence
atgtgggtgaccaagctgctgcccgccctgctgctgcagcacgtgctcctgcatctcctcctgctgcccatcgccattccctacgcggagggtcaacggaaaaggcggaacacaatccacgagttcaaaaaatccgcgaagactactctaattaagatagacccagcactgaagatcaagaccaaaaaggttaatacggccgaccagtgtgccaacaggtgcacaagaaacaaaggcctgccctttacttgcaaggctttcgtctttgataaggccaggaagcaatgtctgtggttcccctttaactctatgtccagcggagtgaagaaagagttcggccacgagttcgatctgtacgagaacaaagattacattcggaattgtattattggcaagggaagaagctacaaaggcaccgtcagctag

SEQ ID NO: 3824 - DNA, 357 bp, Artificial Sequence
  Description of Artificial Sequence: Synthetic coding sequence
atgtgggtgaccaagctgctgcccgccctgctgctgcagcacgtgttgctacacctgctgctccttcctatcgccattccgtacgccgagggccagcggaagcgacgaaacacgatccacgaatttaaaaagtctgcaaagacaactttgattaaaatagaccctgccctgaagattaaaactaagaaagttaacacggcggatcagtgcgcaaaccgttgtactcggaataagggcctgccttttacttgtaaagcatttgtctttgacaaagctagaaagcagtgcttgtggtttccatttaatagcatgagctcaggggtcaagaaggaatttggtcatgagtttgacctctag

SEQ ID NO: 3825 - DNA, 633 bp, Artificial Sequence
  Description of Artificial Sequence: Synthetic coding sequence
atgtgggtgaccaagctgctgcccgccctgctgctgcagcacgtgctgctccacctccttctgctccccatcgcaattccatatgcggaagggcagcgtaaacgtaggaatactattcatgagtttaagaaatctgcaaaaactacgctgatcaagattgaccccgctctcaaaatcaagactaaaaaagttaataccgcggatcagtgcgctaacagatgtactaggaataaagggctcccattcacttgtaaggcattcgtattcgataaggcccggaagcaatgtctatggtttcccttcaacagtatgtctagtggcgtgaagaaagaatttgggcacgagtttgacctatatgagaataaagactatatcagaaactgtattattgggaagggaagatcctacaagggcactgtcagtataactaagagcgggattaaatgtcagccttggagtagcatgattccacacgaacatagctttctcccttccagctatcgtggaaaggacctccaggaaaactattgtaggaacccccggggcgaagaaggaggcccctggtgcttcactagtaaccccgaggtacggtatgaagtttgcgacatcccacaatgtagcgaaggcaagtag

SEQ ID NO: 3826 - DNA, 873 bp, Artificial Sequence
  Description of Artificial Sequence: Synthetic coding sequence
atgtgggtgaccaagctgctgcccgccctgctgctgcagcacgtgctgctgcacctgttgctccttccaattgcaattccttacgccgaggggcaacggaaacgtagaaataccattcacgagtttaaaaagtccgctaagaccaccttgataaagatcgatcctgcactgaaaataaagaccaagaaggtgaacacagccgaccagtgtgctaacaggtgcacaagaaacaaagggctaccgttcacctgcaaggcctttgtgttcgacaaagcaaggaaacaatgtctttggtttccattcaactcgatgtcttctggggtgaagaaggagttcggccatgaattcgacctgtatgagaataaagactacattaggaactgcattattgggaaagggcgtagttacaaagggaccgtgagtattactaagtctgggattaaatgccaaccatggtcgtccatgataccccacgagcacagcttcctgcctagtagttatcgcggaaaggacctgcaggagaactactgccgcaatcctaggggagaggagggcggcccctggtgcttcacgagcaatccagaagttcgctatgaggtgtgtgatattcctcagtgctcagaggtggaatgcatgacctgcaatggggaatcctatcgaggactgatggatcacaccgaatctggtaagatctgtcagcgctgggaccaccagacaccccacagacacaaattcctccctgaacgctatccggacaagggctttgacgataactactgtcggaatccggatggccagcctcgcccgtggtgttatacgctcgacccccacacaaggtgggaatactgtgccatcaaaacctgtgagacatag

SEQ ID NO: 3827 - DNA, 858 bp, Artificial Sequence
  Description of Artificial Sequence: Synthetic coding sequence
atgtgggtgaccaagctgctgcccgccctgctgctgcagcacgtgctgttgcacttgcttctgctccccatcgccatcccctacgctgagggccaaaggaaaagaaggaacaccattcatgagttcaagaaaagtgccaagactaccctcatcaagatcgaccccgccctgaaaattaaaaccaaaaaggtgaacacagctgaccaatgcgccaaccgctgtacaaggaacaagggtttgcctttcacatgcaaagcatttgtgttcgacaaggccaggaagcagtgtttgtggttccctttcaattctatgagcagtggggtcaagaaggaattcggtcacgagtttgatctctatgaaaataaggattacatccgcaattgtataattgggaagggcaggtcgtataaagggaccgttagcattacaaaatctggaattaagtgccagccttggtcttctatgatccctcacgagcatagctaccggggaaaggacctgcaggagaactactgcaggaatcctaggggggaggagggaggaccatggtgcttcacgtcaaatcctgaggttcgttatgaggtatgcgacatacctcagtgtagtgaagttgagtgtatgacatgcaatggagaaagttaccgtggcctcatggatcacactgagagtggcaagatctgtcaaagatgggatcatcaaactccgcaccggcacaaattccttcccgaacggtaccccgacaaaggttttgacgataattattgtcggaatcccgatggccaacctagaccatggtgttacacgttggacccccatactaggtgggagtactgtgcaattaaaacgtgcgagacttag

SEQ ID NO: 3828 - DNA, 2172 bp, Artificial Sequence
  Description of Artificial Sequence: Synthetic coding sequence
atgtgggtgaccaagctgctgcccgccctgctgctgcagcacgtgttattgcacttactgcttctgcctatagccatcccatacgccgaggggcagcggaagaggcggaacacaatacacgagtttaagaaatcagcaaagaccacactgattaagatcgatccggccctgaaaatcaaaacaaagaaagtgaacacagctgatcagtgcgccaatagatgcacccgtaataaggggctgccattcacgtgcaaagcgttcgtttttgataaggctcgtaaacagtgtttgtggttcccattcaattccatgtccagtggtgtgaagaaggagttcggacatgagtttgatctgtatgagaataaggattatatccggaactgtattatcggcaaaggcagaagctacaaagggaccgtgagcataaccaaatctggcataaagtgccagccatggtcttctatgattccccacgagcatagttacagagggaaagatctgcaggagaactactgccggaatccacggggtgaggagggtggcccttggtgcttcacctcaaaccctgaggttagatatgaagtttgcgatattccccagtgcagtgaggtggagtgcatgacttgtaatggggaaagttaccggggacttatggatcacactgagtccggtaaaatctgtcagcgatgggatcatcaaacacctcacaggcacaaattcctcccagagcgatatccggataagggattcgacgataattactgtcggaaccctgatggacagccgagaccttggtgctacacattggacccacacacacgttgggagtattgcgccattaaaacatgcgccgataatactatgaatgataccgacgtgcctctagaaacgacagaatgcattcagggacagggggagggatacagagggactgtcaacacaatatggaacgggatcccgtgtcaacggtgggactcacaatatccacacgagcatgacatgacccccgagaattttaagtgtaaagatttgcgcgaaaactactgccgcaaccctgacggtagcgaaagcccttggtgctttactacagacccgaatattagggtcgggtactgctcacagatccctaactgcgatatgtctcacgggcaggactgttaccgcggcaatggaaaaaattatatgggcaatttaagtcaaacgcggtccgggcttacctgcagtatgtgggataagaacatggaagatctccatcggcatattttctgggagcccgatgcctccaaactaaacgagaattattgtcgcaatcctgatgacgacgcgcacggcccatggtgttataccggtaacccactaataccctgggattattgtccgatctctagatgcgagggagatactacccccaccattgttaacctcgatcatcctgtaatttcttgcgccaaaacaaaacagctcagggttgtaaatggaatccccacccggaccaatattgggtggatggtaagtctccggtacagaaacaagcacatctgcggaggatccctgatcaaggagtcttgggtgctgacagcccgccagtgttttccatcacgtgacctgaaagattacgaagcgtggctggggatccacgatgtgcacggccgtggcgacgaaaagtgcaagcaagtgttgaacgtgagccagctggtttatggacctgagggatctgatctggtgttaatgaagttggcacgtccagctgtgctagacgacttcgtgtcaacaatagatcttcctaattacggatgcactatcccagaaaagacttcttgtagtgtttacgggtggggatacaccggactaatcaactacgacggactccttcgcgtagctcatctgtacataatggggaatgagaagtgctcacaacatcataggggtaaagttaccctcaacgagagcgagatttgcgccggggctgagaagatagggagcggcccatgtgagggagattacggcgggcccctcgtttgtgaacaacacaagatgagaatggttcttggcgtgatcgtgccgggcagaggatgcgcaatcccaaatcggcctggcattttcgttcgtgtcgcttactacgccaagtggatccacaaaatcatcctaacatataaggtccctcagtcctag

SEQ ID NO: 3829 - DNA, 363 bp, Artificial Sequence
  Description of Artificial Sequence: Synthetic coding sequence
atgaacggcgaggagaagagctgcagcggctacggcggccccgacgccatggacggtaagctggtgagttctgatgatgacgatttcatcgtcaagcgcgagcatacccgggcaagcggtatccgcaaggcagtgctctctgggccaggacaatcagctgaaaatgaaaccgaccaggtgaatttcagagaaattccaccacgctgttacccgaaacacgccaaagcatgtatttatttcacatataaagtacactactcaaacagctcaaccgagatccctgaatttttgacagccttagaggtactcatggcgagcgattttctggacatctacattttcctttttttcctgttcttctag

SEQ ID NO: 3830 - DNA, 255 bp, Artificial Sequence
  Description of Artificial Sequence: Synthetic coding sequence
atggccctgagcagccagatctgggccgcctgcctgctgctgctgctcttattggcatcgctaacaagcggctctgttttcccacagcagaccgggcagctggctgaacttcagcctcaggaccgcgccggcgcccgagcttcttggatgcccatgttccagcggagaagacgtcgagacactcactttcccatatgtattttttgttgtgggtgctgtcacagatcaaaatgtggaatgtgttgtaagacatag

SEQ ID NO: 3831 - DNA, 1422 bp, Artificial Sequence
  Description of Artificial Sequence: Synthetic coding sequence
atggccgtgatggccccccggaccctggtgctgctgctgagcggcgccctcgccctgacccagacctgggccgaggtacagctcgttgagagcggaggaggcctagtgcagcccggtggcagcctgcgcctgagttgtgcagcctcggggtttaatataaaagacacttacatccactgggtgcgtcaggcccccggaaagggtctggaatgggttgccagaatctatccaacaaacggttatacccggtacgccgattctgtcaagggtcggtttacgatatcagcggatacttctaagaacaccgcctatcttcaaatgaattctcttagagcagaggataccgcagtgtactattgcagccggtggggtggcgacggattctacgcaatggactactggggtcagggaactctcgtcacggtttctagcgcctccaccaagggacctagcgtgtttccccttgcacctagctccaaatccaccagcggtgggaccgccgcccttggctgtctggtgaaagattacttccccgagcccgttactgtttcatggaactcaggcgccttaacctccggggtccatacctttcctgcagtgctccaatcaagtgggctgtatagtctgagctccgtagtaaccgtgccgtcttccagcctgggtacccaaacatacatctgcaacgtgaaccataaaccttccaacactaaggtggataaaaaggtcgagcctaagtcctgtgataagacccatacatgtccaccgtgccctgctcccgagctactgggtggcccatctgtgttcttgtttccacccaagccaaaagatacactcatgattagccgcactcctgaggttacctgtgttgttgtggacgtcagccatgaagatccagaagttaaatttaactggtacgtggacggcgtagaggttcacaacgccaaaacgaaacctagggaggagcagtacaatagcacatatcgagtcgtgagcgtactcacggtgttgcaccaggattggttgaatggcaaggaatataagtgcaaagtgagcaataaagctctgcctgctccaatcgagaagacaatctcaaaagccaagggacagccgcgagaaccccaggtgtacaccttgccgccgtcccgggatgaattgacgaagaatcaggtgtcactgacatgcctcgttaaaggattctatccatctgatattgccgtggagtgggagagcaacggccagcccgaaaataattataaaactaccccccctgtgttggattccgacggttccttcttcctgtactcaaagctgactgttgacaaatcacggtggcagcagggtaacgtgttctcttgcagtgtgatgcatgaggctctgcacaaccattacacccagaaatctctcagtctgtcccccggttag

SEQ ID NO: 3832 - DNA, 717 bp, Artificial Sequence
  Description of Artificial Sequence: Synthetic coding sequence
atggccgtgatggccccccggaccctggtgctgctgctgagcggcgcgcttgctctgacccaaacatgggccgacatccagatgacccagagtccaagcagcctgtccgccagcgtcggagatcgggtcaccatcacttgccgggcatctcaggacgtaaatacagcggtcgcatggtatcaacaaaaacctggcaaggccccaaaattgctaatttatagcgcctccttcctttattctggagtgccgtcaagattctcgggcagcagaagtggtaccgacttcaccctgaccattagcagtttacagcctgaggactttgcaacctattattgccagcagcattacaccaccccgccaacttttggccaggggactaaagttgagataaaaagaactgttgccgccccttcagtctttatatttccgccgagcgacgaacagctgaaatctggaacagcctcagttgtgtgtctactgaataacttctatccgagggaggcgaaagtccagtggaaggtcgataacgcactgcagagcggcaacagtcaggagagcgtcacagagcaggacagtaaggatagtacttacagtctgtccagtactctgactctttctaaggctgactatgagaagcataaggtatatgcttgtgaagtgacccatcagggcctcagctcccccgtcactaaatcctttaaccgaggggagtgttag

SEQ ID NO: 3833 - DNA, 657 bp, Artificial Sequence
  Description of Artificial Sequence: Synthetic coding sequence
atggccacccggagccccggcgtggtgatcagcgacgacgagcccggttatgacttggacctgttctgcattcctaatcactacgccgaagacctggagcgggtctttatcccgcatggacttatcatggaccgaacggagaggctggccagggacgtgatgaaggagatgggcgggcaccatattgttgccctttgtgtgctgaagggggggtacaaattcttcgccgatttgttggactatatcaaggcgctcaataggaactccgaccgtagcatcccgatgactgtggatttcatccgcctgaagagctattgcaacgaccagtctaccggcgacattaaagtgatagggggtgacgacctgagcaccttgaccggaaagaacgttctcattgtcgaggacatcatcgataccgggaagacgatgcaaaccctcctcagtctagtgcgtcagtataatccgaagatggtgaaggtggcttcactcctggtgaaacgcactcccagatccgtcggctataagcctgacttcgttggattcgagattccagataaattcgttgttgggtacgccttagattataacgaatacttccgcgacctgaaccacgtgtgcgtcatttcagaaactgggaaggctaagtataaagcatag

SEQ ID NO: 3834 - DNA, 657 bp, Artificial Sequence
  Description of Artificial Sequence: Synthetic coding sequence
atggccacccggagccccggcgtggtgatcagcgacgacgagcccggttacgatctggatttgttctgtatcccgaaccactatgcggaggacttggagcgcgtgtttattccgcatggcctaataatggataggacagagagacttgcaagagatgtgatgaaggaaatgggtgggcatcatatcgtggccctctgcgttctgaaaggcggctataaattctttgcggatctgttggattacattaaagccctaaatcggaacagcgacagatcaattccaatgacagtagactttattcgtttgaagtcatactgtaacgaccagtctacaggcgatatcaaagttattggtggagacgatttaagtaccctgacgggcaaatcaaggttgctggccgaggacatcattgacacaggaaaaaccatgcaaaccctgctgtcactagtccgacagtataaccctaaaatggtaaaagtggcttcactcctggttaagagaaccccccgatctgtgggatataagccagacttcgtgggctttgagatccccgacaaattcgtcgttggttatgctctggattacaacgagtatttcagagatctgaatcacgtgtgcgttataagtgaaacaggcaaggccaaatacaaggcctag

SEQ ID NO: 3835 - DNA, 1653 bp, Artificial Sequence
  Description of Artificial Sequence: Synthetic coding sequence
atgccccccccccggaccggccggggcctgctgtggctgggcctggttctcagcagcgtatgtgtagcattgggctccgagacacaagcaaactccaccacagacgccctgaacgtgctgctgataatcgtggacgatcttcgtccttctctgggatgttacggagataagttagtgaggtcacccaatattgatcagttggcgtctcacagtctgctgttccagaatgcgtttgcccaacaggcagtgtgtgccccttcccgagtctcattcctcacaggaaggcgtcctgacactactcggctgtatgattttaacagttattggcgcgtccacgctggtaatttctctaccataccccagtactttaaggaaaatggctatgtcaccatgtcggtgggaaaagtgttccacccaggcatttccagcaatcacacggatgactctccttactcctggtcctttccgccctatcatccatcctccgagaagtatgaaaatacgaagacctgcagaggcccagatggagagctgcacgccaaccttctctgccccgtagacgtgctagatgtgcctgaaggcaccctgcccgacaaacagagcacagagcaggctattcagctcctggagaagatgaagaccagcgccagcccgtttttcctagccgtcgggtatcacaagccccatataccctttagatatcccaaagaattccaaaaactgtatccgctggagaatattacactagctccggaccccgaggtcccagacgggttaccacccgtagcctacaatccctggatggatatcaggcagcgggaggacgtgcaggcactaaatatcagcgtgccttatggccccattcctgtggacttccaaagaaagattaggcaatcttactttgcttcagtgtcgtacctcgatacgcaggtggggcggctactgagcgcccttgacgacctgcaactggcaaacagcacaatcatcgcatttaccagcgatcacggctgggccctgggggaacatggtgagtgggctaagtacagcaacttcgacgtcgccacccatgtgccccttatcttctacgtgcctggacggacggcgagcctcccggaagccggagagaagctgtttccctacctggatcccttcgactcagcctcacagctaatggagcctggcagacagtctatggacctggtcgaactggtgagtcttttcccaaccttggctggactggctgggctacaggtacctccgcggtgccctgtgcctagcttccacgtcgagttgtgcagagagggaaaaaacctcctcaagcattttagatttagagacttagaagaggatccctacctgccgggtaaccctagagaactcattgcttattctcagtacccccggccttccgatattccccaatggaattctgacaagccctctctcaaagatatcaagatcatggggtattctatcaggactattgattaccgatacaccgtttgggtgggattcaatcctgatgagtttttagctaatttctcagacatccacgctggggagctttactttgtggattctgaccccctgcaggaccataacatgtataatgacagccagggcggagatttgttccagctgttaatgccttag

SEQ ID NO: 3836 - DNA, 1032 bp, Artificial Sequence
  Description of Artificial Sequence: Synthetic coding sequence
atgccccccccccggaccggccggggcctgctgtggctgggcctggtattgtcgagcgtgtgcgtagccctcggatcagagacccaggccaacagcacaacagatgccctaaacgtcctgctgatcatcgtagatgacctccgccctagcctgggctgctatggcgataagctggttcggagccctaacatagaccagctggcatcccactccttactgtttcagaatgcatttgcccagcaggcagtttgcgccccctcaagggtttcattcttgacaggcagacgcccggataccacccgcttgtatgactttaactcttattggcgggtacacgccggcaattttagtacaatcccccagtactttaaggagaacggatacgtgacaatgtctgtggggaaggtctttcatccagggatatcctcaaatcacactgatgattcaccttactcttggagcttccctccctatcacccttcgtcagagaaatatgaaaacacaaagacttgccgtggacccgacggcgaactgcacgcgaatttattgtgtcccgttgacgtattagacgtcccagagggtaccttgccagacaagcaaagtactgagcaagccatacagttgctagaaaaaatgaaaacatctgcatcacccttttttctggccgtcggatatcacaaacctcacatcccattccgctatcccaaggagtttcagaagctttaccccctggagaatataaccctggcacctgatcccgaggtgccggacggcctccctccagtcgcatataacccctggatggatatccgacagcgtgaagatgtccaggcacttaacatctccgtaccctacggcccaattcctgtggatttccagagaaaaataagacagtcttactttgcctcagtatcttacctggatacgcaagtgggcaggttactgtccgcattggacgatttgcaactagccaattccactataattgccttcacttccgaccacggcttcctaatgcggacaaacacatag

SEQ ID NO: 3837 - DNA, 939 bp, Artificial Sequence
  Description of Artificial Sequence: Synthetic coding sequence
atgccccccccccggaccggccggggcctgctgtggctgggcctggtactgagctctgtgtgtgtggccttaggtagcgagactcaagcaaattccaccacggatgcacttaacgtactcctgattatagtagacgatctccgtccctcgctgggttgctacggggacaaactcgttcgctctcccaacattgaccaactcgctagccatagtttactatttcagaatgctttcgctcagcaggccgtctgtgcaccatctagggttagctttttaactgggaggaggcccgacacgacaagactctatgattttaatagttactggagggttcatgccggcaatttctccaccatccctcagtacttcaaggagaacggatacgtcactatgagcgtgggaaaagtcttccaccctggcatttctagtaaccacacagacgattccccttactcatggtctttccccccctaccatccctcttcagagaagtacgagaacactaaaacatgtcggggccccgacggtgagctccacgccaatttgctgtgcccggttgatgtccttgacgtccccgaaggaactttacccgataaacagtcaactgagcaggccattcagctgctggaaaaaatgaagaccagtgcttcccccttcttcctcgccgtcggataccacaagccacatataccattccgatacccgaaagaattccagaagctctatcctttggagaatattacactcgccccagacccagaggtaccagacgggcttccccccgtagcctataatccctggatggacatcaggcagcgcgaagatgttcaggcactaaacatctcagttccatacggcccaattcccgtcgactttcaggaggaccagtccagtacaggttttagattaaagaccagcagtacacgaaagtacaagtag

SEQ ID NO: 3838 - DNA, 540 bp, Artificial Sequence
  Description of Artificial Sequence: Synthetic coding sequence
atgccccccccccggaccggccggggcctgctgtggctgggcctggtcctgtcatccgtatgcgttgccctcggctcagagacacaggcaaattctaccactgatgccctaaatgtgcttcttatcatagtggacgatttgcgaccttccctcggatgctatggcgataaactcgtccgcagtcctaatattgatcagctggcctcccattcactgctcttccagaatgctttcgcacagcaggccgtatgcgctccttcccgagtgagcttcttgacaggccggcgcccggataccacacgcctttacgatttcaattcatattggcgcgtccacgctggaaatttcagtacgatccctcagtactttaaggagaacggctacgtgactatgagtgtcggaaaagtgtttcaccctggcacagccccctgtcctgaaagcggttttagttggtttgtggtgtctgagtcgagcattcctattttgggcatgggcctttctctccagtctccgcttctcgctgggcgcgtgccacgctag

SEQ ID NO: 3839 - DNA, 261 bp, Artificial Sequence
  Description of Artificial Sequence: Synthetic coding sequence
atgccccccccccggaccggccggggcctgctgtggctgggcctggtactctcatccgtatgtgtggcactagggagcgaaacccaggctaattctacgaccgacgccctcaacgtccttctgatcatcgtggacgacttgagaccaagcctgggctgttatggcgacaagctggttagaagtccaaatattgaccaattggcctcgcactcacttttgttccaaaatgcattcgcccagcaagccgtctgcgccccctag

SEQ ID NO: 3840 - DNA, 462 bp, Artificial Sequence
  Description of Artificial Sequence: Synthetic coding sequence
atggacctggtggagctggtgagcctgttccccaccctggccggcttggcaggcttgcaagtccctcctcgctgtccagttccaagttttcatgtggagctctgtcgtgagggaaagaatttgctaaagcactttcgttttagagatttggaagaggatccctacctgccggggaaccctagggagctgatcgcgtactcccagtacccccgccctagtgacattcctcagtggaactcagacaaaccatcccttaaagatattaagattatgggatacagtatccgcacaattgactaccggtatactgtttgggtgggcttcaatccagacgaatttctcgctaatttctctgacatccacgccggcgagttgtattttgtggactccgatccactgcaggatcataacatgtacaacgacagccagggtggagacctgtttcagttgctcatgccgtag

SEQ ID NO: 3841 - DNA, 1020 bp, Artificial Sequence
  Description of Artificial Sequence: Synthetic coding sequence
atgaagaccagcgccagccccttcttcctggccgtgggctaccacaagccccacattcccttccgatatcctaaggaatttcagaagctgtatcccttggaaaatataaccctggccccagatcccgaagttcctgacggactgccacctgtggcatacaacccctggatggacatccggcagagggaagatgtacaggcgcttaatatatcagtaccatatggacccataccggttgacttccagagaaagatccgtcagagttactttgcctcagtgagctacttagacacgcaggttggacgcctgctgagtgccttagatgatctgcaactggccaactctaccatcatcgcgttcacctctgatcacgggtgggctctgggtgagcatggtgaatgggctaagtacagtaactttgacgttgccacccacgtgcccctgatattctacgtgccaggccgtacggccagcctccccgaagctggcgagaagttatttccttatttagacccgttcgacagtgcgagccaactgatggaacccggacgacagtccatggatctggtggaactcgtaagtctgtttccaactctggctggcctggccggcttacaggtgccgcctagatgcccagtccccagcttccatgtcgaactgtgtagggaagggaaaaatctgctaaaacacttccgtttccgggatctcgaagaggatccctatctgcccggcaacccccgcgagctgattgcgtactcacagtatcctcgtccctccgacattccccagtggaactcagataagccctctcttaaagatattaaaatcatggggtactcaatcagaaccattgactatcgatacacggtttgggtgggctttaaccctgatgagtttctggcaaacttctcggatattcacgccggcgagctgtatttcgtagattcagatccattgcaggatcacaatatgtacaacgacagccaggggggcgacctcttccagcttttgatgccatag

SEQ ID NO: 3842 - DNA, 1962 bp, Artificial Sequence
  Description of Artificial Sequence: Synthetic coding sequence
atgcggcccctgcggccccgggccgccctgctggccctgctggcctctcttctggctgctccccctgtggctccagccgaagccccacatctggtgcacgtggatgcagcaagagcactctggccactgaggaggttttggaggtcaacagggttctgccccccgctgccacacagtcaggccgatcagtatgtgcttagctgggatcagcagctgaatctggcttacgtcggcgccgttcctcacaggggaattaagcaggtcaggacccattggctgctggagctggtcactacaaggggatccaccggtcgtgggctttcttataacttcactcaccttgacggctatttggatctgctgagagaaaaccagttacttccgggattcgagctcatgggtagcgccagcggtcactttaccgatttcgaggacaaacagcaagtattcgagtggaaagatttagtctcatccctggctaggaggtacatagggcggtacggcctcgcccacgtgtccaagtggaatttcgaaacctggaatgagcccgaccatcatgatttcgacaatgtgagcatgaccatgcagggctttctgaattactatgatgcctgttccgaaggcttacgagccgccagtcctgcgctgaggctcggagggcccggtgattcattccacacccctcccagatctccactgagttggggcctgctacgccattgccacgatggaaccaatttttttaccggagaggcgggggtccgactcgactacatctcattacaccgcaagggagccaggagttccatcagtattcttgagcaggaaaaagtggttgcccagcagatccgccagttattccctaaattcgctgatactcccatttataacgatgaagcggatccactggtaggatggtccctcccccagccttggcgtgctgatgtgacgtatgcagctatggtagtgaaggttattgcacagcatcaaaatctgcttctcgctaatactacatctgcttttccgtacgcattactatccaacgataatgcatttctgtcttaccaccctcatccgttcgcacagcgcacgttgacggcaagatttcaggtaaacaataccagaccaccccacgtgcagctgctgcgcaagccagtgctgaccgctatgggtctcttggccctcctggacgaggaacaactgtgggccgaggtcagtcaagccggtactgtgcttgattccaaccacacagtaggagttctcgccagcgcccaccgacctcagggccctgccgacgcttggcgcgcggccgtgctaatctacgccagcgacgatacccgcgcccaccccaaccggtccgtggctgtaaccctgcgactgcggggtgtgcctcccgggccggggttggtctatgtcaccaggtacctggataacggcctgtgtagcccagatggcgagtggcggagactgggccgccccgtgttccccactgcagaacagtttcgcagaatgagagccgccgaagatcctgttgccgccgcacctcgtcctttacctgcaggagggaggctcaccctccggccagctctgaggttgccaagcctcctactggttcacgtgtgcgctcggcctgagaaaccccccggccaagtcacaagactgagagcgctgcccttgacacaaggccagctggtgctggtctggagcgatgagcatgtcgggagtaagtgtctctggacatacgagatacaattctcccaagacggtaaagcatacacacccgtttctaggaagcctagtactttcaacctgttcgtgttttcccctgacaccggcgcggtcagcggttcctatcgggttcgggctttagactattgggcccgtcccggacccttttccgacccagtgccctacctcgaggttccagtgccaagggggccgccgtccccagggaatccctag

SEQ ID NO: 3843 - DNA, 2028 bp, Artificial Sequence
  Description of Artificial Sequence: Synthetic coding sequence
atgcggcccctgcggccccgggccgccctgctggccctgctggccagcctgctcgctgccccccctgttgctccagccgaggctcctcatctagtccatgtcgacgcagcccgcgcactgtggcctctgcgacgtttttggcgcagcaccggattttggggatctacaggtagggggctgtcatacaacttcacacatctcgacggctatttagacctcctccgggaaaatcaactcctgcctgggttcgagcttatgggatccgcctccgggcactttactgactttgaggataaacagcaagtcttcgagtggaaggatctggtctcctcacttgctagacgctacatcggacgttatgggctcgcgcacgtttcaaaatggaacttcgagacatggaacgaaccagaccaccacgattttgacaacgtgagcatgactatgcagggtttccttaactactacgatgcctgcagcgaggggctaagagccgcgtccccagcactccgccttggcggccccggggactcatttcacactcctccccgcagccctttgagttgggggcttctgaggcactgccatgatggtacaaatttctttaccggagaagctggagtccgactagattacatctccctacatagaaaagtgcggccggcgcctccaagcgcccctgttttttgtgctttaagccgctgcgcgcccggccgggccgaccccggaggtgccgaagccgcaccacccgctgggtgtgcacaactgcaccttcatccaggcgccggagaggggagacgcgccgcagaccccgctgcgctcccccaagttagaggccatccacacctacaaagaagaggtggaccagcaggcggcctcgtccccgctaccgcagtagaaggaggtagggatctgagaggccacggtggggaaggcgggcccgcccagagaccagctcgccccccagccacatttctgcctcggagagacagaagagcggttgcagcgcctccaggcccctcatgccctggtcatccccaggtaatcgcgcagcaccagaatttgctgctggcaaataccacatccgcttttccttacgccctactctcaaacgataacgccttcctgagttatcacccgcatccgtttgcccagcgaacattgaccgccaggttccaagtgaacaacactcgcccaccgcacgttcagctgctgcgaaaacctgtgctcacagccatggggctgctggccctgctggatgaagaacagttatgggcagaggtatcgcaggctgggacagttctggacagtaaccacaccgtgggagtacttgccagtgcgcatcggccacagggaccggccgatgcgtggagagcggccgtgttgatttatgcgagtgatgacacgcgcgcccacccaaacagaagcgtggccgtgaccttgagactgcgcggagtcccccctggccctggcttggtctatgtcacaagatacctggacaatggtctgtgttccccagacggagaatggagacgccttggtagacctgtgttccctacagccgagcagtttagacgtatgcgggcagcagaggatccagtcgccgctgcaccccgcccactgccggcaggaggccgtctgactctgagaccggcgcttcgtctgcccagcctccttctagtccacgtgtgcgctaggcccgagaaacctccagggcaggtgactagattgcgggcccttcctctcacacagggacaactcgtcctggtgtggtctgacgagcatgtgggaagcaaatgcttatggacctacgagatccaattctcacaagacgggaaagcctacacccctgtatcccggaagccaagcacctttaatcttttcgtcttttctcccgatacaggagccgtttccgggagctacagggtgcgggccctggactattgggcccgtcccggcccattctcagatcccgtaccatacttggaggttcctgtcccaagaggaccgccctcaccgggaaacccatag

SEQ ID NO: 3844 - DNA, 603 bp, Artificial Sequence
  Description of Artificial Sequence: Synthetic coding sequence
atggccctgtggatgcggctgctgcccctgctggccctgctggccctgtggggacccgaccccgctgcggcatttgtcaaccagcacttatgtggctcacacctcgtggaggcactgtacctggtgtgcggtgaacgaggatttttctacaccccaaagacccgtagggaggcagaggatctgcaagccagcgctctctccctttcgtccagcacttctacatggccagagggcctagatgccactgcgagggcaccgcctgcactcgttgtgactgctaacataggccaagccggcggatcttcgagccgccagtttcgacagagggctctcggcaccagcgattcacccgtgctgtttatccattgtcccggcgcagccggtacagcgcagggactggaatatcgaggccgtagggttacaactgagctggtatgggaggaggtggattcttccccacaaccacagggatctgagtccctaccggctcaacctcctgcccaacctgcgccacagcccgagccacagcaggcacgcgaaccttccccggaagtcagttgctgtgggctgtggccaaggcgcccccagcgaagccagaattag

SEQ ID NO: 3845 - DNA, 333 bp, Artificial Sequence
  Description of Artificial Sequence: Synthetic coding sequence
atggccctgtggatgcggctgctgcccctgctggccctgctggccctttggggtcccgaccctgccgcagcctttgttaaccagcatctgtgcggcagtcacctagttgaagcgctgtacttggtctgtggggagagggggttcttctatactcctaagacccgcagggaagcagaggacctgcaagtgggtcaggtggagctgggggggggacccggggctggaagccttcaacctttagccctggaaggcagcttacagaaacgcgggattgttgagcagtgctgtacttctatttgttccctctatcagttggagaactactgtaactag

SEQ ID NO: 3846 - DNA, 333 bp, Artificial Sequence
  Description of Artificial Sequence: Synthetic coding sequence
atggccctgtggatgcggctgctgcccctgctggccctgctggccctgtggggcccagacccggctgccgctttcgtgaaccagcacctctgcggcagccatctggtagaagccctttacctggtttgtggagaacgagggttcttttatactcctaagacccggcgggaagcagaggatctgcaggtcggacaggtggagctgggcggtgggcccggtgctggaagtcttcagcccctggccctggaaggcagcctgcagaagcgcggcatcgtggagcagtgttgcacctctatctgctcgctataccaactcgaaaactattgtaactag

SEQ ID NO: 3847 - DNA, 333 bp, Artificial Sequence
  Description of Artificial Sequence: Synthetic coding sequence
atggccctgtggatgcggctgctgcccctgctggccctgctggccttatgggggccagatcccgcagctgccttcgtaaatcaacacctttgtgggagccacctggtagaggcactctatctggtatgcggcgaaaggggattcttctacacccccaaaaccagacgcgaagcagaagacctgcaggtagggcaggtggaactgggtggcggccctggtgctggtagccttcagccactggccttagaggggtctctccagaaaagggggatcgtggagcaatgctgtacctctatttgctctctgtatcagctcgaaaactattgcaattag

SEQ ID NO: 3848 - DNA, 297 bp, Artificial Sequence
  Description of Artificial Sequence: Synthetic coding sequence
atggccctgtggatgcggctgctgcccctgctggccctgctggccctctggggacccgaccccgcagcggcattcgtgaatcaacatctgtgcggtagccatttggtggaagcactgtatctagtgtgtggcgagagaggcttcttctacaccccaaagacacggcgggaagccgaagatttacaggggtcactccaaccactggctcttgaaggatccctccagaaacgaggaatcgttgagcaatgttgcacctccatatgctccctgtaccagctggagaactattgtaattag

SEQ ID NO: 3849 - DNA, 333 bp, Artificial Sequence
  Description of Artificial Sequence: Synthetic coding sequence
atggccctgtggatgcggctgctgcccctgctggccctgctggccctgtggggccctgacccagccgccgctttcgtcaatcaacacctttgtggctcacacctggtagaagcactgtacctggtttgtggcgagcgagggttcttttacacagataagactcggcgtgaggctgaggatttacaagtcgggcaagtagaactaggcgggggaccaggagccggatcactccagccactcgcactagagggatcccttcaaaagcggggaatcgtggagcagtgctgcacctctatctgctccttatatcagctcgagaactactgcaattag

SEQ ID NO: 3850 - DNA, 333 bp, Artificial Sequence
  Description of Artificial Sequence: Synthetic coding sequence
atggccctgtggatgcggctgctgcccctgctggccctgctggccctgtggggcccagaccctgcagcagctttcgtcaatcagcatctgtgtggatctcacctagtggaggcgctatacctggtatgtggcgaacgcgggttcttctacaccccgaaaactcgccgggaagcggaggacttgcaggtcggacaagtggaattgggcgggggccccggagctggctctcttcagccccttgccctcgagggatctctgcagaaaagaggaattgtggaacagtgctgcacatcgatctgcagcctgtatcagttagagaactattgcgggtag

SEQ ID NO: 3851 - DNA, 333 bp, Artificial Sequence
  Description of Artificial Sequence: Synthetic coding sequence
atggccctgtggatgcggctgctgcccctgctggccctgctggccctatggggtcctgaccctgcggctgccttcgtgaagcagcacctttgcgggtcccacctcgtggaggcattgtatctggtctgcggggaacgtggattcttctacacaccggagacccgccgggaggccgaagacttgcaggtgggccaggtggagctggggggaggcccaggggccggttccctgcagcctctggcactggagggctcactgcaaaaaaggggcatcgtagagcagtgctgcaccagcatctgcagtctgtaccagctggaaaattactgcaattag

SEQ ID NO: 3852 - DNA, 333 bp, Artificial Sequence
  Description of Artificial Sequence: Synthetic coding sequence
atggccctgtggatgcggctgctgcccctgctggccctgctggccctgtggggccccgaccctgctgctgcatttgtgaaccagcacctctgcggttcccatctggtcgaagccctgtatttggtatgtggagaaagggggttcttttacacaaaacccactcgcagggaggcggaggacctccaggttggccaggtggaactgggagggggcccaggggccggctcactgcagcccctagcactcgagggttcccttcagaaacgcggtattgtcgagcagtgctgcacatcaatttgctccctgtatcagctggagaactattgtaattag

SEQ ID NO: 3853 - DNA, 570 bp, Artificial Sequence
  Description of Artificial Sequence: Synthetic coding sequence
atggccctgagcttcagcctgctgatggccgtgctggtgctgagctataagtcaatctgttcactcgggtgcgacctgccccagacacactccctgggcaaccgcagggctctgattctgctcggccagatgggcaggatttccccattctcttgtttgaaagaccggcatgacttccggattccacaagaggagttcgacggaaaccaattccagaaggcccaggcaatcagcgtgctccacgagatgatccaacaaacttttaacctgtttagcacggaggacagcagtgctgcctgggaacagagcctgctggaaaagttcagcacggaactttaccagcaacttaatgacctcgaggcttgcgtgatacaggaagtaggggttgaagaaacccccctgatgaacgaggacagtatactggccgtgaggaagtattttcagagaataacgctctacctgatagagcggaagtattctccatgcgcctgggaggtagtcagagctgagattatgcggtccctgagctttagtaccaatttgcagaaaagactccgccgcaaagattag

SEQ ID NO: 3854 - DNA, 573 bp, Artificial Sequence
  Description of Artificial Sequence: Synthetic coding sequence
atgatggccagccccttcgccctgctgatggccctggtggtgctgtcttgcaagagttcctgctctcttggatgcgacctgcccgaaactcacagcctggacaaccggagaactctcatgctcctcgcacagatgtcgcgtattagtcccagcagttgcctcatggatagacatgattttggattccctcaggaggaattcgacggcaatcagttccagaaggctccagcaatctcagtgctgcacgagctcattcagcagatcttcaaccttttcactaccaaggactcctccgctgcctgggacgaggaccttctggataaattctgcaccgaattgtatcagcagcttaatgatttggaagcgtgcgtcatgcaggaggagcgggtgggcgaaaccccactcatgaacgctgacagcattctcgccgtgaagaaatacttccgaaggatcactctctatctgactgaaaagaagtactcgccgtgtgcctgggaagttgtaagagcagaaatcatgaggtccctcagcctgtccactaatctgcaggagcgcctgcgccgtaaggagtag

SEQ ID NO: 3855 - DNA, 570 bp, Artificial Sequence
  Description of Artificial Sequence: Synthetic coding sequence
atggccctgcccttcgccctgatgatggccctggtggtgctgagctgcaagtccagttgcagccttggatgtaacctgtcccaaacccactctctaaacaatcgtagaactcttatgttgatggcgcagatgcggagaatcagtccctttagctgcctgaaggaccggcacgatttcgagttcccgcaggaggagttcgacggcaaccagtttcagaaagctcaggccataagtgtgctgcacgagatgatgcaacagacctttaatctgttttctactaaaaactccagcgccgcatgggacgagaccctgctggagaagttttatattgagttgttccagcagatgaatgacctggaagcttgtgtgatacaggaagtgggagtggaagagacccctctcatgaatgaagacagcatccttgccgtaaagaagtatttccaacggatcactttataccttatggagaaaaaatatagtccgtgcgcttgggaagtggtcagagctgaaataatgaggtctctgtcattcagtaccaatctacaaaaaaggctgcggcgcaaggattag

SEQ ID NO: 3856 - DNA, 570 bp, Artificial Sequence
  Description of Artificial Sequence: Synthetic coding sequence
atggccctgagcttcagcctgctgatggccgtgctggtgctgagctacaaaagtatatgtagcctcggctgtgatctgccacagactcactctctgggaaaccggcgcgccctgatcttgctggcacagatgggcagaatctcccacttttcttgtctgaaggaccggtacgatttcggtttcccccaggaggtctttgatggaaatcagtttcagaaggcccaagctataagtgcgtttcacgagatgatccagcagacctttaacctctttagcactaaggacagcagcgcggcctgggacgaaacccttctcgacaagttttatatcgagctctttcagcagcttaatgacctcgaggcctgtgttacccaggaagtgggagtagaggagatcgcactgatgaacgaggacagtatcctcgccgtccggaagtacttccagcgaataacgctgtacttgatgggcaaaaagtactctccatgcgcctgggaggtggtgcgcgcagaaataatgcgtagtttctcattttccaccaatctgcagaaaggtttgcgccgcaaagactag

SEQ ID NO: 3857 - DNA, 570 bp, Artificial Sequence
  Description of Artificial Sequence: Synthetic coding sequence
atggccctgagcttcagcctgctgatggccgtgctggtgctgagctataagtcaatctgctctcttggatgcgacctcccgcagacccactccctggggaatcgacgagcccttatcctcctcgctcagatggggaggatcagccccttttcgtgcctcaaggatcggcacgacttcgggttgccccaggaggaatttgatggaaaccaatttcagaaaacccaggcaattagcgtgctccatgaaatgatccagcagacttttaatctcttctctacggaagactccagcgccgcttgggagcagagtcttttagagaaattttcaactgaactgtatcagcagctcaataacctggaagcgtgtgtgatccaggaagtggggatggaagagacaccactgatgaacgaggatagcattttagccgtccgtaaatactttcagcgcataactttgtatttgaccgagaaaaaatattctccatgcgcatgggaagtggttagagccgagattatgcgctccctaagcttttcgacgaatttacaaaagatccttagaaggaaggactag

SEQ ID NO: 3858 - DNA, 567 bp, Artificial Sequence
  Description of Artificial Sequence: Synthetic coding sequence
atggccctgaccttcgccctgctggtggccctgctggtgctgagctgtaagagctcctgctctgtggggtgtgatttgccgcagacccactcactgggtagccgtcgaaccctgatgttacttgcccagatgcggcgcattagcttgttttcatgtttaaaggacagacacgacttcggcttccctcaggaggaatttggtaatcagtttcagaaggctgaaactatcccagtgctgcatgagatgatccagcagatctttaaccttttttccaccaaagacagttcagctgcctgggatgagactcttctcgataagttttatacagagctgtatcaacagctaaatgatctggaggcatgcgtcatccagggtgttggagtcacagagaccccactgatgaaagaggattcaattctcgctgtgaggaaatactttcagaggatcacgttgtacctgaaggagaaaaaatatagcccctgcgcctgggaggtggtgagagcagagatcatgcgctcctttagcctctccaccaaccttcaggaatctctgaggtcaaaagagtag

SEQ ID NO: 3859 - DNA, 570 bp, Artificial Sequence
  Description of Artificial Sequence: Synthetic coding sequence
atggccctgagcttcagcctgctgatggccgtgctggtgctgagctataaatctatctgctctctgggttgcgacctgccccagacacacagtttggggaacaggagggcccttattctgcttgcccaaatgggccgaatatccccattcagctgccttaaagaccgtcacgattttggatttccccaggaggagttcgacggtaaccagttccagaaagcccaggcaatcagcgtcctgcacgagatgattcagcagacatttaacctgttttcaaccaaggactccagcgcgacctgggagcagtcactcttagagaagttttccaccgaattgaaccagcagttgaatgacctggaagcctgtgtgattcaggaggtgggcgtcgaagagacccccctgatgaatgttgattctatcctagcagtgaaaaaatatttccagagaatcacgctgtatctgaccgaaaagaagtattcaccatgcgcatgggaagtagtccgggccgagattatgcgttctttcagtctctccaaaattttccaagagagattaagaagaaaagaatag

SEQ ID NO: 3860 - DNA, 570 bp, Artificial Sequence
  Description of Artificial Sequence: Synthetic coding sequence
atggccctgagcttcagcctgctgatggccgtgctggtgctgagctataaatctatctgtagtctgggatgtgacctaccccagactcattctcttgggaaccggcgagctcttatcctgttagcccaaatggggcggatcagccacttttcctgcttgaaggacagacatgatttcgggttccccgaagaagaattcgatggccaccagtttcaaaaggcacaggctataagtgtcctgcatgagatgatccaacagacgtttaacttgttttctactgaggatagctcggcggcctgggaacaatcactgctggagaagttcagcactgaactgtatcagcagcttaatgacctagaggcgtgcgtcattcaggaagtcggagtggaggagacacctctaatgaacgaagactccatactggcggttagaaaatactttcaaagaatcaccctgtacttgaccgagaaaaaatacagcccgtgtgcatgggaagtggtccgtgccgagatcatgcgttctctctcctttagcaccaatctgcaaaagcgactgcggcgtaaagactag

SEQ ID NO: 3861 - DNA, 570 bp, Artificial Sequence
  Description of Artificial Sequence: Synthetic coding sequence
atggccctgcccttcgtgctgctgatggccctggtggtgctgaactgcaagagcatttgcagcctgggctgcgacctcccacagactcattcactttctaaccggcgtacattgatgatcatggcccagatgggccgcatctcacctttctcttgcttaaaagacagacacgactttggcttcccccaggaggagttcgatggcaaccagttccagaaggctcaggccatctctgtgttgcatgagatgatccagcaaaccttcaacctattctccaccaaggattcttctgccacatgggatgaaaccctgctggacaagttttatacagagctgtatcaacagttaaacgatctggaggcttgcatgatgcaggaggtcggcgtggaggatacccccctcatgaatgtggacagcattctgacagtgcggaagtattttcagcgtattactctgtacctcacagaaaagaagtactcaccttgcgcgtgggaagtggtaagagctgaaattatgagaagcttttcgttatctgctaacttgcaggagcgattaagacggaaagaatag

SEQ ID NO: 3862 - DNA, 570 bp, Artificial Sequence
  Description of Artificial Sequence: Synthetic coding sequence
atggccctgcccttcgccctgctgatggccctggtggtgctgagctgcaaaagctcctgcagtctggattgtgacctcccccagactcactcactaggtcacagacgtacaatgatgttgttggcacagatgcgtaggatcagcctgttcagctgcctgaaagatcgacatgattttagatttccccaggaggagtttgatggaaaccagtttcaaaaggccgaagctattagcgtcctgcacgaagttatccagcagacctttaatctgttctccaccaaggattcaagcgtggcctgggacgagagactactcgacaagctctacacagaactatatcagcaactgaacgatctggaagcatgcgttatgcaagaagtctgggtagggggtacacctctgatgaatgaggatagcatcctcgctgtgcggaaatatttccagcgcatcaccctttatttaaccgaaaaaaagtattcaccgtgtgcctgggaggttgtgagagctgagatcatgcgttccttttctagctcccggaatctccaggagcgactcaggcgcaaggagtag

SEQ ID NO: 3863 - DNA, 570 bp, Artificial Sequence
  Description of Artificial Sequence: Synthetic coding sequence
atggcccggagcttcagcctgctgatggtggtgctggtgctgagctataagtccatttgtagcctcggatgtgacttgccacagacacattccctgagaaacagacgagccctgatcctcttagctcagatgggtcgaatttcccccttcagctgccttaaggatagacacgaatttcgcttcccagaggaggaattcgacggccaccagtttcagaaaactcaggctatttccgtgttgcatgagatgatccaacagacattcaatttattctccacagaggactcctccgccgcctgggagcagagcctgctcgagaagttctctaccgagctataccagcagctgaacgatctggaggcttgcgtgatccaggaggtcggggttgaagagacaccactcatgaacgaggacttcatacttgccgtcagaaaatattttcagaggataactctatatcttatggagaagaagtacagcccatgcgcttgggaagtggtgagagcagagattatgagatctttctccttcagcacaaacctcaaaaagggtctgagacgaaaggactag

SEQ ID NO: 3864 - DNA, 570 bp, Artificial Sequence
  Description of Artificial Sequence: Synthetic coding sequence
atggccctgaccttctacctgctggtggccctggtggtgctgagctataaatcgttctcctcgcttggctgcgacttacctcagactcattcactcggcaaccgacgcgccctcatcctgctcgcccagatgcggagaatatccccgtttagctgtctgaaggaccggcatgactttgaatttcctcaggaggagttcgatgacaagcagttccagaaggcacaagccatctctgtcctccatgaaatgatccagcagacttttaacttgttttctactaaggactccagtgcggccctggacgagactctcttagatgaattttatatcgaactagaccagcagctaaacgacttagaatcttgcgtgatgcaagaagtgggggtcattgaatctccgctaatgtatgaggactccattctggcggtgcgcaagtacttccaacgcatcactctctacctgacggaaaagaaatacagctcttgcgcctgggaagtcgtaagggccgaaatcatgcggagttttagtcttagcattaatctgcagaagcgtctgaagtccaaagagtag

SEQ ID NO: 3865 - DNA, 564 bp, Artificial Sequence
  Description of Artificial Sequence: Synthetic coding sequence
atgaccaacaagtgcctgctgcagatcgccctgctgctgtgcttcagcacgaccgccctgagtatgagctacaacttgctgggcttcctccagcggagttctaattttcagtgccaaaaattgctatggcaactgaacggccgcctcgagtattgtctcaaggatcgcatgaacttcgatattcctgaggaaatcaagcaacttcagcagtttcagaaggaggacgccgccttgaccatctacgagatgcttcagaatatctttgcaatctttaggcaggacagctccagtaccggatggaacgagactattgttgagaacctgcttgctaatgtctatcaccagatcaatcacttgaaaaccgtcctggaggaaaagctggagaaagaggacttcacacgtggcaagctcatgtcctcacttcatctgaagcggtattatggcagaatcctgcattaccttaaggcaaaagagtattctcactgcgcctggactatcgtccgagttgagatcctccggaacttttatttcattaatagactcaccggctatctgcgcaactag

SEQ ID NO: 3866 - DNA, 537 bp, Artificial Sequence
  Description of Artificial Sequence: Synthetic coding sequence
atgcacagcagcgccctgctgtgctgcctggtgctgctgaccggcgtgcgggccagcccgggtcagggtacccaatcagagaacagttgcacgcactttcccggcaatctgccaaatatgctaagggacctccgggatgcgttcagccgtgtcaagacattcttccagatgaaagaccaactcgataacctcctgctaaaagagagcctgttggaagatttcaagggatatttgggctgccaggccctgtcagagatgatccagttctacctcgaagaagtcatgccacaagcggagaatcaagatccagatataaaagctcacgtgaacagcctaggagagaacttgaaaacactgcgccttcgtctgcgccggtgtcacagattcctgccctgcgagaacaagtccaaagcggtggagcaggtgaagaacgcctttaacaaactgcaggagaaaggcatctacaaagctatgtcggagttcgatattttcatcaactacattgaagcttatatgacaatgaagatacgcaattag

SEQ ID NO: 3867 - DNA, 489 bp, Artificial Sequence
  Description of Artificial Sequence: Synthetic coding sequence
atgcggagcagccccggcaacatggagcggatcgtgatctgcctgatggtcatattcttgggaacactggtccacaaatcctcctcccagggccaggataggcatatgattaggatgaggcagctaattgatatcgttgaccagttaaagaattatgtgaatgatttggtgcccgagtttctgcctgcgccggaagatgtggaaaccaactgtgagtggagcgcgtttagctgctttcagaaagcacagctcaaatctgccaataccggaaacaatgagaggatcatcaacgtgagcatcaaaaagttgaagaggaagcctccttctaccaacgcaggtagaagacagaagcatcgtctcacatgtccatcttgtgatagctacgagaaaaaaccgcccaaagagtttctcgaacggttcaaaagcctgctccaaaagatgatacaccagcacttgtcgtctagaacacacggcagcgaagacagctag

SEQ ID NO: 3868 - DNA, 534 bp, Artificial Sequence
  Description of Artificial Sequence: Synthetic coding sequence
atgttccacgtgagcttccggtacatcttcggcctgccccccctgatacttgttctcctccctgttgccagttcagactgcgacatcgagggcaaagatggtaagcagtacgaaagtgtcctcatggtgtctatcgaccaactgctcgacagcatgaaggagattggttcaaattgtctgaacaacgagttcaacttctttaagcggcacatctgcgacgctaacaaggaaggcatgttcctgttccgggctgcgcggaagcttcggcaatttctgaagatgaactcaacaggggattttgaccttcacttattaaaagtgagcgagggtactaccatactcctcaactgcacaggccaagtgaaaggtcgaaaaccggctgcactcggcgaggcacagcccaccaagagcctggaggaaaacaagtctcttaaggaacagaagaaactgaatgatttgtgcttcctcaagaggttgttgcaggagatcaagacatgctggaataagatactcatgggtacgaaagagcactag

SEQ ID NO: 3869 - DNA, 216 bp, Artificial Sequence
  Description of Artificial Sequence: Synthetic coding sequence
atgttccacgtgagcttccggtacatcttcggcctgccccccctgatccttgtgctcctgcccgtcgcttcgagcgattgcgacattgaaggcaaagacgggaagcaatatgaatcagtgctaatggtttccattgatcagctcctgaaccaaccgtataagaagaaagagaaaaggaccgaaagaaagcaacagtctgctatgtccaataattag

SEQ ID NO: 3870 - DNA, 393 bp, Artificial Sequence
  Description of Artificial Sequence: Synthetic coding sequence
gtgagcttccggtacatcttcggcctgccccccctgatcctggtgttactgcccgtggcatctagtgactgtgatatcgaggggaaagacggaaagcagtacgaaagcgtgctcatggtgtctattgatcagctgctagactcgatgaaggagataggatctaactgcctcaacaacgagtttaatttctttaagcgacacatctgtgatgccaacaaagtgaaaggtcgaaagccggcggcgctcggagaggcacagcctactaaatcactcgaagaaaataaatcattgaaagaacagaaaaagcttaacgacctctgtttcctgaagcggctcctccaagaaataaaaacctgctggaacaagatcctgatggggaccaaggagcactag

SEQ ID NO: 3871 - DNA, 216 bp, Artificial Sequence
  Description of Artificial Sequence: Synthetic coding sequence
atgttccacgtgagcttccggtacatcttcggcctgccccccctgatcttggtgctgctccctgtggcttcctccgattgcgatatcgaaggaaaggatggcaagcaatatgaaagtgtgctgatggtctctattgatcagctgttaaaccaaccatacaagaagaaggagaagcgcacagagagaaagcagcaatccgcaatgtccaacaactag

SEQ ID NO: 3872 - DNA, 114 bp, Artificial Sequence
  Description of Artificial Sequence: Synthetic coding sequence
atgttccacgtgagcttccggtacatcttcggcctgccccccctgatcctggttcttctccccgtggctagcagtgattgtgatatcgaaggacaacacgagcgaaactggtag

SEQ ID NO: 3873 - DNA, 402 bp, Artificial Sequence
  Description of Artificial Sequence: Synthetic coding sequence
atgttccacgtgagcttccggtacatcttcggcctgccccccctgatcctggttcttctgcccgttgccagtagtgattgtgatatcgagggcaaggacggcaagcagtacgagagcgtgttgatggtaagtattgaccagctcctggatagtatgaaggaaattggctcaaactgtcttaacaacgagttcaacttctttaagaggcacatttgtgacgcgaataaggtaaagggacgcaagccagccgccttgggtgaggctcagcctaccaaatcgttggaggaaaataaaagcctgaaggagcagaagaaactgaatgacctgtgttttcttaagcggcttctacaggaaattaagacctgttggaacaaaatcctgatggggacgaaggaacattag

SEQ ID NO: 3874 - DNA, 114 bp, Artificial Sequence
  Description of Artificial Sequence: Synthetic coding sequence
atgttccacgtgagcttccggtacatcttcggcctgccccccctgattttagtactactccctgttgcgagcagcgactgcgacattgagggtcaacacgaacgtaactggtag

SEQ ID NO: 3875 - DNA, 195 bp, Artificial Sequence
  Description of Artificial Sequence: Synthetic coding sequence
atgaaggagatcggcagcaactgcctgaacaacgagttcaacttctttaaaaggcacatttgtgacgctaacaaggaagaaaacaaaagcctcaaagagcagaagaagcttaacgacctgtgtttcctgaaaagactgctgcaagagatcaaaacctgctggaacaagatcctgatgggcacaaaagagcactag

SEQ ID NO: 3876 - DNA, 2643 bp, Artificial Sequence
  Description of Artificial Sequence: Synthetic coding sequence
atggccgagctgtaccgggtgctggaggccggcaagatcggcatcttcgaatcaccaacgggcaccgggaaaagcctgagtctgatctgcggcgctctcagttggttaagagattttgaacagaaaaagagagaagaagaagccagactccttgagacaggcactggaccactgcatgacgagaaggacgagagtctatgcctgagttctagctgcgaaggcgccgctggtaccccgagaccggccggcgagccagcctgggtcactcagtttgtgcaaaagaaagaagagagggatctggttgatcggctcaaggcagaacaggcacgcagaaagcagcgggaggagaggttgcagcagcttcagcatcgggtacagctgaaatacgcagccaagagattgagacaggaggaagaggagagggaaaatctcctgcggttaagcagggagatgctcgagacgggcccagaagctgaacggttggagcaactggaatcaggtgaagaggaactggtgctcgctgaatatgagagtgatgaagagaagaaggtcgctagtagagtagatgaggatgaagacgatctggaggaagagcacatcacaaagatctactactgtagccgtacccacagccagttggctcagttcgtacacgaagtaaagaagtctccttttggaaaagatgtgaggctggtgtcactgggctctaggcaaaacctatgtgtgaatgaagatgtgaagtccttgggatctgtgcaactaattaatgatcgctgtgtggatatgcaacgctctagacacgaaaagaagaaaggagctgaggaggaaaaacctaagcgcaggagacaggaaaaacaggccgcatgtcctttttataaccacgagcagatgggtctgctccgcgacgaggctctggccgaggttaaggacatggagcagttgctagccctgggaaaggaggctcgggcatgtccttactacggttcaagactggctattccggccgctcaattagtcgtccttccttatcagatgcttctgcatgccgccacgcgacaggctgctggaattcgcttacaggaccaggtagtcattattgatgaggcccataatctgatcgatacaattactggcatgcacagcgtggaggtctctgggagtcagctgtgccaagctcattcacaacttctgcaatacgtggagagatacggcaaaaggttaaaagctaagaatcttatgtatctaaagcagatcctttatctgctagagaagtttgttgccgtcctgggaggcaacattaaacagaatcccaatacgcagagcctgtctcaaactggaacagagttaaagaccatcaatgatttcctgtttcaatcccaaatcgacaacattaacctgtttaaagtgcagcggtactgcgagaagtccatgatatcacggaaacttttcgggtttactgagcgatacggagccgtgtttagcagccgggagcagccgaagctcgcaggatttcagcagtttctgcagtcgctccagcctcgtacaaccgaagctctcgccgctcccgcggacgaatcccaagctagcacactgcgcccagcctcacccctgatgcacatccaggggttcctggcagcactgacaacagctaaccaagatggccgcgtcattctgtcccgacagggatcattaagccagtctactcttaaattcttgctcctcaacccagcagtgcattttgcccaggtagttaaagagtgccgggccgtagtgatcgctggtggaactatgcagccagtgagcgactttaggcagcagctgctcgcctgtgccggtgtcgaggctgagagagttgtggaattcagctgcggccacgtcatcccccccgacaacatcctccctctggtcatctgctccggcatcagtaaccagcccctcgaatttacttttcagaaaagagaactgccacagatgatggatgaggtcggccggatattatgtaatctgtgcggcgtagtgcccggcggcgtagtgtgtttttttccaagctacgaatatctgcggcaagtccatgctcactgggagaaagggggcttacttggaaggcttgctgcacgcaagaagatctttcaggagcccaagagcgcgcaccaggttgagcaggttctgttggcctactcccgttgtatccaggcctgtggtcaggaaaggggacaggtgactggcgccctgctcctgagtgtcgtaggcggcaagatgtcagaaggcatcaatttctccgacaacttgggacggtgtgtagtcatggttgggatgccctttcccaatatcagaagcgctgaactacaggagaagatggcctatctcgatcaaacgctgcctcgtgcccccggacaggcaccacccggcaaagccctggtggaaaatctgtgtatgaaggccgtcaaccagagtattggacgggccattagacaccagaaggatttcgcgtctgtcgtactccttgaccagcggtatgcacgacctcccgttctggctaagctgcccgcctggatcagggcaagagttgaagtgaaagccacgtttggccccgccattgccgccgtgcaaaagttccaccgggaaaaaagcgcgtctagctag

SEQ ID NO: 3877 - DNA, 738 bp, Artificial Sequence
  Description of Artificial Sequence: Synthetic coding sequence
atgaagaagacccagacctggatcctgacctgcatctacctgcagctgctgctatttaatcctctcgttaagaccgaaggaatctgtcgcaaccgggttacaaacaatgtaaaagacgtcacaaaactagtggcaaatttgcctaaagattatatgatcacccttaagtacgtccctgggatggatgttctgccttctcactgttggatcagcgagatggtagttcagctcagcgacagtcttaccgatctgctggacaagttctctaatatctccgaaggattgtcaaactatagcatcatcgacaaactcgtaaacatagtcgacgaccttgtggagtgcgtgaaagagaattcctcaaaagacctgaagaaaagcttcaaatctccagagccaagactgtttacacccgaggagtttttcagaatctttaatcgctcgatcgatgcttttaaggattttgttgtggcaagcgagacaagcgattgtgtcgtgagttccacactcagccccgagaaggggaaagcaaaaaacccaccaggcgactcctccctgcattgggccgctatggctcttcccgcactgttctctctgatcattggcttcgccttcggcgccctatactggaagaaaagacaaccctctctgacacgagctgtagaaaatattcagatcaacgaggaggataacgagatctcaatgctccaggagaaggagcgggagtttcaggaggtctag

SEQ ID NO: 3878 - DNA, 93 bp, Artificial Sequence
  Description of Artificial Sequence: Synthetic coding sequence
ggcatggacgtgctgggccggcccaagatccccctggagacccccgcctacaccggccagccgtggcattgccaacattgctttctgctgtag

SEQ ID NO: 3879 - DNA, 3039 bp, Artificial Sequence
  Description of Artificial Sequence: Synthetic coding sequence
atgcccgccagcgcccccccccggcggccccggccccccccccccagtctctctctgctcctggtgctgctggggctgggaggtcggaggttgagagctgagccaggcgatggggctcagacatgggcacgttttagccgtcccccagcccctgaggctgctgggctattccagggtacttttcctgatggattcctgtgggccgttggcagcgccgcttaccagaccgagggcggctggcaacaacatgggaaaggcgcttccatttgggatacattcacccatcatcccctggccccccccggggattcgcgcaatgcatcgttgcccctgggtgctcctagcccactgcagcctgcaaccggagatgtggcatcagactcatataataacgtgttccgcgacaccgaagcgcttagggagttgggcgtgactcattacaggttttccattagttgggccagggtcctaccgaacggttctgccggcgtgccaaatcgggaggggctacggtactataggagactgctggaaagactacgcgagttgggggtccagcccgttgtcaccctttaccactgggacctcccccagcgcctgcaagacgcctatgggggctgggcaaacagagcactagccgaccactttcgggactacgccgaactttgcttccgacacttcgggggacaggtcaaatattggattacgattgataatccctatgtcgtggcgtggcacggctatgccacagggaggctggcaccgggcatcagaggatcgccgaggttggggtatctagtggcccacaaccttctgctcgcacacgccaaggtctggcacctgtacaacacttccttccgacccacacaggggggccaggtttcaattgctctgagctcccattggattaatcctcgcaggatgactgatcattctattaaagagtgccagaagtccttagacttcgttctgggctggtttgctaaacctgtgtttatcgacggagattacccagaatcgatgaagaacaacttgtctagcattctgcctgacttcacagagagcgagaagaagttcataaaaggaaccgcagattttttcgcactgtgcttcgggcccaccctgtcctttcagcttctcgaccctcatatgaaattccgccagctcgagtctccaaatctgaggcagctgttgagctggatcgaccttgaattcaaccacccacagattttcatcgtcgagaacggctggttcgtgagcgggacgacaaaaagggacgacgctaagtacatgtactacctgaagaaatttatcatggagactttaaaggcgatcaagctagatggcgttgatgtgattggttacacggcctggtcacttatggacggttttgaatggcacagaggctatagcattcgccgcggtctgttttatgtcgattttctgagccaggacaagatgctcctgccgaagagctctgcacttttttatcaaaagctgattgagaagaatgggtttccccctctgcccgaaaaccaaccccttgaaggaactttcccatgtgacttcgcctggggcgtggtggacaactacatccaggtggataccaccctcagccaatttaccgatctcaacgtttatctgtgggacgtgcaccattctaagagattaattaaggtcgacggcgtggtcaccaagaagcggaagagctactgcgtggattttgctgccatccagccccaaatagccttgcttcaagaaatgcacgttactcatttccgattctcgctcgattgggccctgattctgccactgggtaatcagagtcaggtgaatcacaccattttgcagtattaccgctgcatggcatctgagcttgtcagggtgaacatcacgcccgtggtagcactatggcaacccatggcaccaaaccagggcctgcctcgcctgctcgccagacagggggcatgggagaatccttacaccgcgctggcttttgcggaatatgcgaggctgtgtttccaggaattggggcaccatgtcaaattgtggatcactatgaacgagccctacacaagaaatatgacttatagtgccgggcataacctcttaaaggctcacgctctggcttggcacgtttacaatgagaagtttcgtcatgctcagaatggtaaaatcagcatagcgttacaggccgattggatagagcccgcctgcccattctcgcaaaaggataaggaagtcgctgagagggtcctcgagttcgacatcggctggctcgctgagcctatcttcggtagcggggactacccctgggtgatgcgagactggctcaatcagaggaacaatttcctgctaccctattttaccgaggatgagaaaaagttgatacagggcacatttgattttttggcactgtcccattataccacgattctcgtcgactccgagaaagaggatcccattaaatacaacgattatctcgaagtgcaggagatgaccgatatcacctggttaaactccccctcgcaagtggcagtggtaccttggggcctgaggaaagtgctcaactggctgaaattcaagtatggggatctcccaatgtacattatctctaacggcatagatgatggtctccatgccgaagacgatcagcttcgcgtttactatatgcaaaactacataaatgaggccttgaaggctcatattctggacgggatcaatctatgtgggtacttcgcctacagtttcaatgaccgcaccgccccacgcttcgggctgtacaggtacgccgcagatcagtttgagcctaaagccagcatgaaacattaccgcaaaatcattgactctaatggtttccccggacccgagaccctcgaacgcttttgccccgaggaattcaccgtgtgcacagaatgttctttttttcacacacgaaagtcattgctggcctttattgctttcctgttctttgcatccattatttctctctccctgattttttactactcaaaaaaagggcgacgaagctataagtag

SEQ ID NO: 3880 - DNA, 729 bp, Artificial Sequence
  Description of Artificial Sequence: Synthetic coding sequence
atgaccgaccacagcatcaaggagtgccagaagagcctggacttcgtgctcggctggttcgcaaagcccgtctttatagatggtgactacccagaatccatgaagaacaacctgtcctccatcttgcccgactttacggagtccgagaagaagtttataaagggtactgctgattttttcgctctctgcttcgggcctaccctcagcttccagctcctggatcctcacatgaaatttagacagcttgagtctcctaatctgaggcagttgctctcatggatcgatctcgaattcaatcatccacagatttttatcgtggagaacggatggtttgtgtccggcacgaccaaacgagatgacgctaaatacatgtactacctaaagaaatttattatggagacactgaaggcaatcaagctggatggagtggatgtgatcgggtataccgcatggtccctaatggacgggtttgagtggcacagaggatattcaatcaggaggggcctgttttatgtcgactttctgtcccaagacaaaatgctgttgcccaagtccagcgccctcttttaccagaaattaatcgagaaaaatgggtttccccccctacccgagaatcagccacttgagggcacgttcccctgtgatttcgcttggggggtggtcgacaactacattcaagtcagccagcttacaaaacctatctcaagtttaaccaagccttaccactag

SEQ ID NO: 3881 - DNA, 1440 bp, Artificial Sequence
  Description of Artificial Sequence: Synthetic coding sequence
atgcggcagccccccggcgagagcgacatggccgtgagcgacgccttgcttcccagtttctctacctttgctagcggtccagccggaagggagaagaccttgcgtcaagcaggagccccaaacaacagatggcgggaggagctttcccacatgaaacggctgcccccggtgctgcctggtcgcccttacgatttagctgccgctacagtggctaccgatctcgagtctggcggtgctggagctgcttgcggtggctccaacctggcaccactcccaaggcgggagacagaagaattcaacgacctgctcgatctggactttatcctctctaactccctgacacacccacctgagtctgtcgccgcaaccgtgtcatcctccgccagcgcctcaagtagcagcagtccttctagctcagggccggcttccgctcccagtacctgctcattcacgtatcccatcagagcgggaaacgacccgggagtggcacccggagggaccggcggaggactcctatacggccgggagagcgcacctccacccacggcgccatttaatcttgccgacatcaatgacgttagtccatccggaggtttcgtggcagaacttctgcgtcccgagttagatcccgtgtatatcccgccgcagcaaccacagcctcctggcgggggcttgatggggaaattcgtccttaaagcttcactctccgcaccaggtagcgaatacggcagccctagcgttatttcagtgagcaagggcagtcctgatggctcacatccagtggtcgtggccccatataatggaggcccgccacgaacttgccccaagatcaaacaggaggccgtgtcatcatgtactcatctgggtgccggccctccactgtcaaacgggcaccgccccgctgctcacgacttccccctgggcagacaactgccttcccgtactacacccaccctcgggctggaagaagtgctaagcagccgtgattgtcaccccgccctccctctaccacctggtttccacccacatcccggtcccaactacccgtcttttctgcctgaccagatgcagccccaggtcccccccctccactaccaagagctgatgcctcccggctcctgcatgcctgaagaaccaaaacctaagcgcggccgcagatcttggcctcgcaagagaactgccacacacacatgtgattacgctggatgcggcaagacatatactaagtcgagccatctgaaggctcacctacgaacccataccggtgaaaaaccctaccactgtgattgggatggctgcggctggaagttcgcaagatctgacgagctgactcggcattatcggaaacatactgggcacagaccttttcagtgccaaaagtgcgacagggcgttttcaagaagcgatcaccttgctcttcatatgaagcgacacttttag

SEQ ID NO: 3882 - DNA, 699 bp, Artificial Sequence
  Description of Artificial Sequence: Synthetic coding sequence
atggccgtgagcgacgccctgctgcccagcttcagcaccttcgcctctggcccggccggacgagaaaagactctgagacaggctggcgcacccaacaatcgctggcgggaagagctgagtcacatgaagcgcctacctcccgtgcttcccggccgtccctacgacttggccgcagccactgtggcgacagatctggagtccggaggtgccggagccgcgtgcggaggtagcaatctcgcacctctaccccgcagggagacagaagagttcaacgaccttttggacttggactttattttgtctaattcccttacccacccccccgagtctgtggccgctactgtgagtagtagcgcttccgcttcctcttctagcagtccgtctagctccggacctgcaagcgccccctcaacatgctccttcacataccccattcgagccggcaacgaccctggcgtggctcctggcggtaccggcgggggcctattatatggcagggagagtgccccacctcctaccgcgcctttcaaccttgccgatattaatgatgtgagcccttctggtggttttgttgcagagttgttaaggccagaattggatccggtgtacattccgcctcagcagccgcagccccccggggggggtctaatggggaagttcgtgctgaaggccagtttatctgcacccggatctgaatag

SEQ ID NO: 3883 - DNA, 69 bp, Artificial Sequence
  Description of Artificial Sequence: Synthetic coding sequence
atgcggcagccccccggcgagagcgacatggccgtgagcgacgccctgctgccatcattttccacatag

SEQ ID NO: 3884 - DNA, 117 bp, Artificial Sequence
  Description of Artificial Sequence: Synthetic coding sequence
atgcggcagccccccggcgagagcgacatggccgtgagcgacgccttactgccttcctttagtaccttcgcttctggacctgccggccgagaaaagacattgcgacaggccggctag

SEQ ID NO: 3885 - DNA, 1323 bp, Artificial Sequence
  Description of Artificial Sequence: Synthetic coding sequence
atgggcccccccggcagcccctggcagtgggtgaccctgctgctgggcctactgttgccgcctgcagctcccttctggctgctgaacgtgctgttccccccacacactacccccaaagcagagctctccaaccatacacgacccgttattctggtgccgggatgtctcggcaaccagcttgaagcaaagttggacaaacccgacgtggtaaactggatgtgttaccggaaaactgaggactttttcaccatttggctcgatctaaacatgttccttcctctcggtgtggactgctggatcgataacacacgcgtggtatataaccgaagctcagggctggttagtaacgctccaggggtgcagatccgcgtccccgggttcgggaagacctacagtgtggaatacctggattcaagcaagttggccggatacctgcacacacttgtacaaaacctcgtcaacaacgggtacgtgcgcgatgaaaccgtgagggcagccccgtacgattggcgcctggaacctggtcagcaggaggaatactataggaagctggccggattggtcgaagagatgcacgccgcttatggtaagccagtttttctaataggacattctttgggctgccttcacttgctgtatttccttctcaggcagccgcaggcttggaaggaccggtttatcgatgggttcatctcgctgggagctccttggggagggagcataaagcctatgctcgtcctggcatcaggcgacaatcagggcattccaataatgagctccataaaactgaaagaggagcaacgaatcaccacaaccagcccatggatgttcccatcccggatggcctggcctgaagatcacgtcttcatcagcaccccttcatttaattacactgggcgcgactttcaacgcttttttgccgacctgcacttcgaggaggggtggtatatgtggctgcagtcaagagatctcctggccggactcccagctccaggcgtggaagtttactgcctgtacggcgttggcctccccactcctcggacatatatctatgaccacggcttcccttacacagatcctgtcggggtgctgtacgaagacggtgacgataccgtagcgactagaagtaccgaactctgtggcctgtggcaggggcgtcagccacagcccgtgcatctgctgcctctgcatggtatccagcacttaaacatggtgttctctaatttaaccttggaacacatcaatgccatcctactgggcgcataccgacagggaccccccgcttcccccaccgcctcaccagaacccccacctccggaatag

SEQ ID NO: 3886 - DNA, 753 bp, Artificial Sequence
  Description of Artificial Sequence: Synthetic coding sequence
atggccgacaacttcagcctgcacgacgccctgagcggcagcggcaatcctaacccacaagggtggcccggcgcatgggggaatcagccagcaggcgccggtggctatcctggagcatcatacccgggagcctatccgggccaagctccacctggcgcctaccctggccaggctcctccaggggcatatcctggggctccaggcgcctaccccggagcacccgccccaggcgtatatcctgggccaccatctggacccggtgcatatccaagcagcggtcaaccttccgccacaggggcttatccggccacaggaccatacggcgctcccgctggaccactcatcgttccatataacctccccctgcccggaggggtagtgccacgaatgctcatcacgattctgggcacagtgaaaccaaacgcaaacagaattgcactggacttccagcgggggaatgatgtggcatttcatttcaaccccaggtttaacgagaataataggcgggttatcgtttgtaatactaaacttgataacaactggggtcgtgaagaacgccagtctgttttcccattcgagtctggcaagccatttaagattcaggtgctcgttgagcccgaccatttcaaggtggccgtaaatgacgcccacctgttgcagtacaaccatcgtgtgaaaaagctcaacgaaatatccaaactcggcatctctggcgacattgatttgacgagcgcctcttacactatgatttag

SEQ ID NO: 3887 - DNA, 630 bp, Artificial Sequence
  Description of Artificial Sequence: Synthetic coding sequence
atgggcagcgtgagcaaccagcagttcgccggcggctgcgccaaggcagctgaagaggctcctgaggaggcccccgaggacgccgctcgagcggccgatgagccacagctgctgcacggggcagggatttgcaagtggtttaatgtgagaatgggcttcgggttcctttctatgacggcaagagccggagttgccctggatcctccagtggacgtgttcgtgcaccagagcaagctgcatatggaggggttcagatctctcaaagagggcgaagctgtggaatttactttcaagaagagcgctaagggacttgagtccattagagtgacaggccccggaggggtattttgtatcggctccgagaggcgtccaaagggaaagagtatgcagaagaggagatcaaagggcgatagatgttataattgtggcggactggaccatcatgccaaagaatgtaagctgcctccacagcccaagaaatgtcatttttgtcagagcatatcacatatggtggctagctgtccgctcaaggctcagcaggggccatctgcccaaggcaagcccacttacttccgggaggaagaggaagagattcactcccctaccctgctgcctgaggctcagaattag

SEQ ID NO: 3888 - DNA, 630 bp, Artificial Sequence
  Description of Artificial Sequence: Synthetic coding sequence
atgggcagcgtgagcaaccagcagttcgccggcggctgcgccaaggcagctgaagaggccccagaggaagcacccgaggacgccgccagagcagcagacgagccccagctgctccacggtgctggtatttgcaaatggtttaacgtacggatgggttttggttttctctccatgacggccagggctggggtcgccttggacccacccgtcgacgtgttcgtacaccagtccaagctgcacatggaaggcttcagatctcttaaagaaggggaggcggttgaatttacattcaagaagtccgctaagggactcgagagcattcgggttaccggtccggggggggtattctgtataggcagtgaaagacgtccaaagggcaagagtatgcaaaagcggaggtcaaagggggacaggtgctataactgcggcggcctcgatcaccatgctaaggaatgcaaactgccgccccagccgaaaaagtgtcatttctgtcagagcatctcccacatggtggcatcatgccctctgaaagcacagcaaggtccctctgctcaaggtaagccgacctattttcgggaagaggaagaagagattcattcaccaaccttattgcctgaggcacaaaactag

SEQ ID NO: 3889 - DNA, 660 bp, Artificial Sequence
  Description of Artificial Sequence: Synthetic coding sequence
atgaagatgcggttcctgggcctggtggtgtgcctggtgctgtggactctccatagtgagggttccggcgggaagctgacagctgtcgatccagagactaacatgaatgtgagtgagattatcagctactggggcttcccgagcgaagagtatctcgtggagacagaggatgggtacatcctctgccttaatagaataccccacggaaggaaaaaccatagcgacaaaggacctaaaccggtggttttcctgcaacacggtctgctggctgacagttcaaactgggtgactaatttggccaattctagccttgggtttattctcgccgatgctggattcgacgtttggatggggaacagcagaggcaacacatggtctcgcaaacacaaaacgctctcagtcagtcaagacgaattttgggcgttcagctacgacgagatggctaagtatgatctgcctgccagcatcaatttcatcctcaacaagactggtcaggagcaggtgtattacgtcggacactcccaggggactaccattggctttatcgcgttctctcagatccctgagctggctaaaagaattaagatgttttttgcgctcggcccagtggcatctgtggccttctgcaccagtccaatggccaagctaggccgcctgtag

SEQ ID NO: 3890 - DNA, 1200 bp, Artificial Sequence
  Description of Artificial Sequence: Synthetic coding sequence
atgaagatgcggttcctgggcctggtggtgtgcctggtgctgtggactcttcattccgaggggagcggggggaagctgaccgctgtcgaccccgaaactaacatgaatgtgtcagaaatcatttcatactggggatttccaagcgaggaatatctggtagaaaccgaagatgggtatatcctctgtctcaatcgcatccctcacggcagaaaaaatcactccgataagggccctaagccagtggtgtttctgcagcacggtctgctggccgattcctctaattgggtgaccaatctcgcaaacagctccctggggtttatcctcgctgatgccggctttgacgtatggatgggcaatagtcggggtaatacttggtctaggaagcacaaaacacttagtgtgagccaggatgagttctgggccttctcatacgatgaaatggccaaatatgacctcccagcctcaattaattttatcctgaataagacgggtcaagaacaggtatactatgtgggtcatagccaggggaccacaattggctttatcgctttctcccaaattccagaacttgccaaacggatcaagatgttcttcgccttggggcccgtcgccagcgtcgccttttgtactagcccaatggctaagcttggccgactcccagaccatctgatcaaggatctgttcggcgacaaggaatttttaccgcagtctgcattcttgaaatggctgggaactcacgtctgcactcacgtcatcctgaaggaactgtgcgggaacttgtgtttcctcctgtgtggcttcaatgaaagaaacctcaatatgtcccgggttgatgtgtataccacgcattctcccgccgggacatccgttcagaacatgctacattggtcccaggccgtcaaattccagaagtttcaggccttcgattggggctcttctgcaaagaactattttcactataaccagtcatatcctcccacctataatgtgaaagacatgctggtccccactgccgtgtggtccggaggacatgactggctggcagatgtgtatgacgtgaacatcttactgactcagattaccaacctggtcttccatgagtccatccccgaatgggaacatctggattttatatggggtctggacgcgccatggcggctttacaacaagatcatcaacttaatgagaaagtaccagtag

SEQ ID NO: 3891 - DNA, 1074 bp, Artificial Sequence
  Description of Artificial Sequence: Synthetic coding sequence
atgaagctgcggaccctggccgtgagcgccaccgtggtgaaggacggcgtttcaggggtttgcagtttcagatgctccgacgtctcaggcgtcttaccatctggccctaagcccgtggtattcttacaacatggtcttctggctgattcaagtaattgggttacaaatttggccaacagttctctgggctttattctagctgatgctgggttcgatgtgtggatgggtaactcgagaggcaatacatggagccggaagcacaagaccctgtccgtgagtcaggacgagttctgggccttctcttacgacgagatggctaagtacgacttgcccgccagtatcaatttcatcctcaacaagacaggccaggagcaagtgtactacgttgggcatagtcagggcaccaccattgggttcatcgcattttcccagattcccgagctcgcgaagcggataaaaatgttcttcgctctcggaccagttgccagcgtggcattttgcacatcccctatggctaaacttggccgcctgcctgaccatctgatcaaggacctgttcggtgacaaggagtttctgcctcagagcgcttttctcaagtggcttggcactcacgtttgcacacatgtgattctgaaggaattatgcggcaatctctgcttcctgctgtgcgggttcaatgaacgtaacctgaacatgagcagggtcgatgtttacacaacccacagcccggccggcacatccgtgcaaaatatgcttcactggtctcaagctgttaaatttcagaagtttcaagccttcgactggggatctagcgctaagaactactttcattacaatcagtcctatccaccgacctataacgtcaaggatatgctggtgcccactgctgtgtggagcggaggccacgactggctcgccgatgtatatgatgtaaacatactgctaacacagatcaccaacctggtcttccacgagagcattcctgagtgggaacacctggatttcatctggggtctggacgccccgtggagactctacaataaaattattaacctgatgaggaaataccagtag

SEQ ID NO: 3892 - DNA, 1200 bp, Artificial Sequence
  Description of Artificial Sequence: Synthetic coding sequence
atgaagatgcggttcctgggcctggtggtgtgcctggtgctgtggactctccatagcgagggaagtggcggcaaacttactgccgtggacccggagacgaacatgaacgtgagcgagattattagctattggggcttcccctccgaggaatacctggtcgagaccgaggacggttacatcttatgcctcaacagaatcccacacggcaggaagaaccatagtgacaaggggccgaaacctgtcgtgttccttcagcacggattactggcagatagttctaattgggtcacaaacctcgctaacagctctctgggattcatccttgccgacgccggcttcgatgtctggatgggcaactccagaggaaatacctggtcacgcaagcataaaacattaagtgtgagtcaggacgaattctgggccttcagctatgacgaaatggccaagtacgatttgccagcatccattaatttcatcctcaataaaactggtcaggagcaggtatattacgtgggccatagtcaaggaacgacaatcggcttcatcgctttttctcagataccggagctcgccaaaaggatcaaaatgtttttcgctctaggccctgtggcaagcgtggctttctgtacaagccctatggcgaaacttggtcgccttccggaccacctgattaaggatctgttcggtgacaaagaatttctgccacagagcgcattcttgaagtggctgggaacacacgtgtgtacacatgtgattctcaaggaattgtgtgggaacctctgcttcctcctctgcggcttcaatgagcgaaacctgaacatgtcgcgcgtggatgtttataccactcactctcctgccgggacttccgttcagaatatgctccattggagtcaagctgtcaagttccaaaagtttcaggcttttgattggggtagctcagcaaagaactactttcattataaccagagttaccctcccacttataacgtgaaagatatgctggtgcctaccgctgtgtggagcggaggacatgattggttggccgacgtctacgacgtgaacatcctacttactcagataaccaacctcgttttccatgaatctatccccgagtgggaacacctggattttatctggggtctcgatgccccatggcggttatacaataagattataaatcttatgcggaagtatcagtag

SEQ ID NO: 3893 - DNA, 1032 bp, Artificial Sequence
  Description of Artificial Sequence: Synthetic coding sequence
atggcctgcctggagttcgtgcccttcgacgtgcagatgtgcctggaatttctgccatcgggacccaagccagtggtattcctccagcacggtcttctggctgatagctccaattgggtgactaacctggctaacagctcgctcggcttcatcctggccgacgccggttttgatgtttggatgggcaatagtcggggcaatacttggtcccgtaagcacaagaccctttctgttagtcaggacgagttctgggctttttcctacgacgagatggccaagtatgaccttcccgcttccattaactttatccttaacaaaactggccaggaacaggtgtactacgttgggcattcacagggtacaacgattggattcatcgcctttagccagataccagagctcgccaaaaggattaaaatgttttttgcacttggtcccgtcgcatctgtggccttctgcacatcccctatggcaaagctcgggcgacttccagaccacctcattaaggatttgtttggagataaagagttcctgcctcaaagcgccttcctgaagtggttaggcacccatgtttgcacgcacgtgatcctgaaagaactgtgtgggaatttatgcttcctcctgtgtgggtttaatgagcgcaatctgaacatgtcaagggtggacgtgtataccacacactcacctgctggaaccagtgtacaaaatatgcttcactggtctcaggcagtcaagtttcaaaagttccaggctttcgactgggggagctccgcgaaaaactattttcattacaaccaatcttatccaccaacttacaacgtcaaggacatgctcgtgccaacggcagtctggtccggaggacatgattggctggccgacgtttacgatgtcaacatcctattgacccagattacgaatctcgtattccacgaatccataccagagtgggaacacctggacttcatctggggcctggatgcgccctggaggctgtataacaaaataattaatctgatgagaaagtaccaatag

SEQ ID NO: 3894 - DNA, 1206 bp, Artificial Sequence
  Description of Artificial Sequence: Synthetic coding sequence
atggcctgcctggagttcgtgcccttcgacgtgcagatgtgcctggagttcctgccaagcggtgaatttgttgtccttttgaccagcggagtgcagctacagaccttcacggtttccgttacagacctgaaaggcggtgcaagcggcgtcgtacgctctagtcgctgggtcagaggcttcacagatttcagatctaaagcagtggatctctgtggccccaaacctgtggtcttcttacagcatgggttactggctgactcctcaaactgggtaaccaatctggccaattctagcctgggtttcattctggccgacgctggcttcgatgtgtggatgggaaattcaagaggaaatacgtggagcaggaagcacaagactctcagcgtatcccaggacgagttttgggcatttcgcgtacccttcctggactattcgtacgatgagatggcaaagtatgatctgcctgcttccatcaactttatactgaataagactggccaagaacaggtttactacgtcgggcactctcagggcactacgataggtttcattgccttctctcagataccggagctcgccaagcgcatcaagatgttctttgccctgggtcctgtagcaagcgttgctttttgtacgtcgcccatggctaaactgggaaggttgccagaccatttgatcaaggacctgttcggcgataaagaatttttgccccagtccgccttcctgaagtggctgggaacacacgtttgtactcacgtcatactgaaagagttatgcggcaatctttgtttcttgttatgtggattcaacgagcgaaacctgaatatgtcccgtgtggacgtatacaccacacactcccccgccggtacctcagtacagaacatgctgcactggtctcaagcagtcaagtttcaaaagtttcaggcctttgactggggttcatccgcaaaaaactattttcactacaatcagagctaccctccaacgtacaacgttaaggatatgttggtgcctactgccgtttggagcggggggcacgattggctcgctgatgtgtatgatgtaaatatcctcctgactcagatcaccaatctcgtattccatgaatccatccctgagtgggagcaccttgactttatttggggcctggatgctccctggcgtctatacaacaaaattattaacctgatgagaaagtaccagtag

SEQ ID NO: 3895 - DNA, 873 bp, Artificial Sequence
  Description of Artificial Sequence: Synthetic coding sequence
atgaagatgcggttcctgggcctggtggtgtgcctggtgctgtggaccctacacagtgaagggagcggagggaagctgactgccgtcgatcccgagaccaacatgaatgtgtccgaaataatctcttactggggcttcccatctgaagaatacttggtggagacagaagatggctacatcctctgcctcaatcgcatccctcatggccggaaaaaccactctgataagggtcccaagccagtggtcttccttcagcatggcttgctcgcagactcctccaactgggttactaaccttgctaacagcagtctagggttcattctcgccgatgcaggctttgacgtttggatggggaatagccgaggtaatacttggtccaggaaacataagaccctttctgtatcacaagatgaattctgggccttttcatacgacgagatggcaaaatatgatctgccggctagtattaatttcatcctgaataagaccggtcaggagcaggtctattacgtggggcactcccagggcaccactatcgggttcatagctttcagccagattcccgagttggcgaagagaatcaagatgttcttcgcattggggccagtggcgtctgtggccttttgcacctcacctatggcaaagctggggcggttaccagatcacctgatcaaagacctgtttggcgacaaggaattcctgccacagtcagcctttcttaaatggctgggtacacacgtctgcacccacgttatccttaaggagctgtgtggaaatctgtgctttctgctttgcggttttaatgagaggaatctgaatatgtcccgcgtggatgtctacacaacccattcgccggccggcactagcgtgtag

SEQ ID NO: 3896 - DNA, 1200 bp, Artificial Sequence
  Description of Artificial Sequence: Synthetic coding sequence
atgaagatgcggttcctgggcctggtggtgtgcctggtgctgtggaccctacactcagaggggagcgggggcaaattgaccgccgtagaccccgagaccaatatgaatgtttccgagatcatttcatactggggctttcccagcgaggaatatcttgttgagactgaggacggctatatcctgtgtctcaaccgcatcccacacggacggaagaaccactcagacaaaggccctaagccagtagtattcctgcaacacggattgttggccgactcttctaactgggtcaccaacctcgcaaactcctcactcggcttcatactggccgacgcgggcttcgatgtttggatgggcaattcaaggggaaacacttggtcacgcaagcacaagacattgagtgtttcacaggacgagttctgggcattttcatacgatgagatggctaaatatgacttaccagcttctataaatttcatcttgaacaagactggccaggagcaagtatactacgttgggcacagccaaggaaccactatcggattcatcgcctttagtcagatacccgagctggccaaaagaatcaagatgtttttcgctttggggcccgttgctagcgtcgccttttgcaccagccctatggccaagcttggccggttaccagaccaccttatcaaagatctgtttggcgacaaagagttcttacctcagtctgcatttctgaaatggctgggaacgcacgtgtgtactcacgtgattctgaaagagttgtgtggtaacctgtgctttcttctctgtgggttcaatgaaagaaacttgaacatgtcccgggtggatgtttataccacacatagcccggccggtacatcagtccaaaatatgctgcactggtcacaagctgtgaaattccaaaagttccaggcgtttgattggggtagtagcgctaagaactacttccattacaaccagtcatacccgccgacctacaatgtcaaggacatgttggtgcccacggctgtgtggagtgggggtcacgactggttggcagacgtatatgatgtcaacatcctgctcacccagatcaccaatctggtgtttcacgagtccattccggaatgggagcatttggattttatctggggactggacgccccttggagactgtataacaagatcattaaccttatgaggaaataccagtag

SEQ ID NO: 3897 - DNA, 87 bp, Artificial Sequence
  Description of Artificial Sequence: Synthetic coding sequence
ctgtgcttcctgctgtgcggcttcaacgagcggaacctgaacatggccgtgaaatttcaaaaatttcaggctttcgactggggctag

SEQ ID NO: 3898 - DNA, 1200 bp, Artificial Sequence
  Description of Artificial Sequence: Synthetic coding sequence
atgaagatgcggttcctgggcctggtggtgtgcctggtgctgtggaccttacactccgaaggttcaggcggtaagctcaccgccgtggatccagagacaaacatgaacgtgtcggaaattatcagctattggggctttccaagtgaggagtatctcgtggagacggaagatggctacatcctctgcctgaacaggatcccacacggacggaagaaccatagcgataagggcccaaagccagtggtgtttctccagcacggactcctggcagatagctctaattgggtgacaaacctggccaatagttctctggggttcattctggcagacgctggattcgatgtttggatggggaactctcggggaaacacatggtccagaaagcacaaaacgctgtcagtttcgcaggacgaattctgggcctttagctacgatgaaatggcaaaatacgatcttccagcatctattaatttcattcttaataaaacggggcaggagcaagtgtactacgttggccattcacagggaacaaccataggtttcatcgctttttctcaaatacctgagttagctaaacgtatcaaaatgttttttgctttgggccctgttgcctcagtggcattttgcacctcccctatggcaaaattaggtaggttaccagaccatctcataaaggacctgtttggtgacaaggagtttttaccccagagtgcatttctcaagtggctcggcactcacgtttgtacgcatgtcatactgaaggaattatgcggaaatctatgctttctgctgtgtggctttaatgaaaggaaccttaacatgtccagggtggacgtgtacaccacccacagtcctgccggaacatcggtccagaacatgctgcactggtcacaggccgtgaagttccaaaagttccaggcttttgactggggcagttccgctaaaaactactttcactacaatcaatcctatccaccaacttacaatgttaaggatatgctcgtgccgacagccgtctggtccggagggcatgattggctcgctgatgtgtacgacgtcaatatccttctgactcagattacgaatttagtatttcacgaatcgattccggagtgggagcaccttgactttatttgggggctcgacgctccttggcgcttatataataagataatcaacctgatgcgaaagtaccagtag

SEQ ID NO: 3899 - DNA, 411 bp, Artificial Sequence
  Description of Artificial Sequence: Synthetic coding sequence
atgaagatgcggttcctgggcctggtggtgtgcctggtgctgtggacgctgcactccgagggctctggcggcaaactgaccgccgtggacccagaaactaatatgaacgtgagcgaaatcatttcatactggggtttcccttctgaggaatacttggtcgagaccgaagacggatatatcttgtgcttaaaccggataccgcatggacgtaagaatcatagcgataaggggccaaaacctgtggtgtttttacagcacggtcttcttgccgactccagcaactgggtaaccaacttggccaactccagccttggatttattctagctgacgccggatttgacgtgtggatgggcaattcccgcggtaacacctggtcgcggaaacatgtgaccctcgaacccggttgctag

SEQ ID NO: 3900 - DNA, 1428 bp, Artificial Sequence
  Description of Artificial Sequence: Synthetic coding sequence
atggagagcaaggccctgctggtgctgaccctggccgtgtggctgcagtcactgactgcttctagaggaggagtggcggcagccgaccagcgccgggacttcattgacattgaatcaaagtttgctctccgcactccagaggacacagcagaagatacctgccatctgattccaggggtcgccgagtcagttgctacatgccatttcaatcatagctccaagacattcatggtgatccacgggtggacagtgacaggcatgtatgaaagctgggttcctaaattggtcgccgcgctatataaacgagagccagatagcaacgtgattgtagtggattggttgtcacgggctcaggaacattaccccgtatctgccggctacaccaagctcgtgggacaagatgtggcaagattcatcaactggatggaggaggaattcaattaccccttggacaatgttcatctgctgggatattcactgggagcgcatgctgccgggatcgctggaagcctgacaaacaagaaagtgaatagaattaccggcctggaccctgcggggccaaactttgaatatgcagaagctcctagcagactgagtccggacgacgcagattttgtagacgtccttcatactttcactaggggctctcccggcagatccattggcatccagaagcccgttggacatgtggatatctatcccaacggagggacatttcagcccggttgtaacatcggggaagccatcagggtaattgccgaacgcggtctcggcgatgtggatcagcttgtgaagtgctctcacgaacgctccatacatctatttatcgatagccttctaaatgaggagaacccttcaaaagcataccgttgcagttccaaggaggcatttgagaagggtctgtgtctgtcttgccgaaagaatcggtgtaataacctcggatacgagattaataaggttcgggccaagaggtcctctaagatgtatttaaagaccagatcacagatgccatacaaagtcttccattatcaggtgaaaattcacttcagtggaaccgaatcagagacacatactaaccaggcctttgaaattagcctttatggtaccgtcgcggagtcagagaacattcctttcacgttacccgaggtgtccaccaacaagacatactcctttctcatctacacagaggtagatatcggagagttgctgatgctgaagctgaaatggaaaagcgattcctatttttcttggtcggattggtggagcagccccgggtttgcaatccagaagattcgggtgaaggctggcgagacccagaagaaggtcattttttgctctcgtgaaaaagtctcgcaccttcaaaaaggcaaggctcccgcagtatttgtgaagtgccatgacaaaagtcttaataaaaaatccggatag

SEQ ID NO: 3901 - DNA, 348 bp, Artificial Sequence
  Description of Artificial Sequence: Synthetic coding sequence
atggtgatccacggctggaccgtgaccggcatgtacgagagctgggtacctaagctggtggctgccctctataaacgcgaacctgatagcaatgtcatcgtggtggattggttgtccagagcacaggaacattacccagtttccgcaggatacaccaagctcgtcggacaggacgtggcccgctttatcaattggatggaagaagagtttaactaccctctcgataacgtgcaccttctgggctacagcctcggcgcccacgctgcaggaatagcaggaagcctgactaataaaaaggtgaaccgcatcactggcctcgacccagcaggccccaattttgagtactag

SEQ ID NO: 3902 - DNA, 321 bp, Artificial Sequence
  Description of Artificial Sequence: Synthetic coding sequence
atggagagcaaggccctgctggtgctgaccctggccgtgtggctgcagtctctgaccgcaagtcgcggtggtgttgccgctgcagaccagcgaagggactttatagatatcgaatctaaattcgctcttcgaacccccgaagataccgcagaggacacttgtcacctcattcccggcgttgccgaatctgtggctacttgtcatttcaatcattcctcaaaaactttcatggtgattcatggttggaccgttacagggatgtatgaaagttgggtcccaaagcttgttgctgccctgtataagagagagcccgactcctag

SEQ ID NO: 3903 - DNA, 393 bp, Artificial Sequence
  Description of Artificial Sequence: Synthetic coding sequence
atggagagcaaggccctgctggtgctgaccctggccgtgtggctgcaatctcttaccgcctctaggggaggcgtggccgcagccgaccaaaggcgcgattttatcgacatagagtcgaagttcgctctgaggacccccgaggacacagctgaggatacatgtcacctcattccgggagtggcggaatccgtcgccacttgccactttaaccattcatccaaaactttcatggtaattcatggatggaccgtcactggaatgtatgaaagctgggtgcctaagctggtcgccgccctttacaagagagaaccagacagcaacgtgattgttgttgattggttgtccagagcccaagaacactacccagtgtccgccgggtataccaagctttag

SEQ ID NO: 3904 - DNA, 1386 bp, Artificial Sequence
  Description of Artificial Sequence: Synthetic coding sequence
atggagagcaaggccctgctggtgctgaccctggccgccgccgaccagagaagagactttatagacattgaatcaaaattcgcactccgtaccccagaggataccgcagaggatacttgtcacctgattcctggagttgctgaaagtgtcgcaacctgtcactttaaccactcttccaagactttcatggtgatccatggctggacagtgacaggcatgtacgagtcctgggtgcccaaactagtggccgccctgtataaacgcgagcctgattcgaatgtgatagtggttgattggctcagcagagctcaggagcattacccagtgtccgcagggtataccaagctggtgggccaggatgtggccagatttattaattggatggaggaagaattcaattatcctctggacaatgtccacttacttggttacagcttaggcgcacacgcagctggcatcgcaggctccttgacaaataagaaagtaaatcgtattaccggactggatccggctggcccaaacttcgaatacgcagaggcgccatcaagattgagccctgatgatgctgactttgttgacgttttgcacacctttacgagaggttctccaggaagatctatcgggatccagaaacctgttggacacgtggacatttaccctaatggcggtacctttcagcccgggtgtaatatcggcgaagcaatccgggtaatagcagagcgggggctgggcgatgtagaccagttagtgaaatgctctcacgagcggtctattcacctgtttatcgactccctcctgaatgaggaaaatcccagcaaggcgtaccggtgttcctcgaaggaggcctttgagaaaggcctgtgcctgtcctgccgaaaaaaccggtgcaataatttaggatatgagattaataaagtgcgtgccaaacgcagcagcaaaatgtacctgaagacccgcagtcagatgccatataaagtattccactatcaagtgaaaatccactttagcgggaccgaaagcgagacccacaccaaccaggcttttgaaatctcactgtatggaaccgtagctgaaagtgaaaacatcccctttactctgccagaggtctctactaataagacctactcgttcctcatatataccgaggtggatataggcgagcttctgatgttgaaacttaagtggaagtccgacagttatttctcttggagcgactggtggtctagtccaggcttcgccattcagaaaatccgggtcaaggctggcgagacgcaaaaaaaggtgatcttttgctcgagggagaaggtgtcccacctacaaaagggcaaagcgcccgctgtctttgtgaagtgtcacgacaagagcctaaacaagaaatctggctag

SEQ ID NO: 3905 - DNA, 828 bp, Artificial Sequence
  Description of Artificial Sequence: Synthetic coding sequence
atggtgatccacggctggaccgtgaccggcatgtacgagagctgggttccgaagctagtagctgccctgtacaagagagaacccgactccaacgtgatcgttgtggactggctttctagagcgcaggagcattatccagtctctgcggggtacacaaaactggtgggccaggacgtcgccaggttcattaactggatggaggaggaatttaactacccgctggacaacgtgcatctcctggggtacagcctcggggcccacgctgcgggaattgccggctcgcttactaacaagaaggtgaaccggatcactggcttagaccccgccggtcccaactttgagtacgccgaagcacccagtcggctctccccagatgatgcggactttgtggatgttctgcacacctttactagaggctcccccgggcgctcaatcggcattcagaagcctgtcggccatgtggacatctatccgaatgggggaacttttcagccaggctgcaatataggtgaggccattcgggtgatcgcagaacggggattgggggacgtagatcagttagtgaagtgttcacatgagagatccatccatctgtttatagactccttgctgaacgaagagaacccttcaaaagcttatcgctgtagttctaaggaagccttcgagaaagggttgtgcctctcgtgtcgaaagaaccggtgtaacaacctagggtacgagattaacaaggtgagagccaaacggagctccaagatgtatgaggacagcttcagcgatgcactgcagagcttgccattaccgtctaaggattcttttttctgggattag

SEQ ID NO: 3906 - DNA, 2079 bp, Artificial Sequence
  Description of Artificial Sequence: Synthetic coding sequence
atgggcccctggggctggaagctgcggtggaccgtggccctgctgcttgcagctgcgggcactgcagtgggtgatcggtgcgagcggaacgagtttcagtgtcaggatgggaagtgcatctcgtacaaatgggtttgcgacggcagcgccgaatgccaggacggctctgacgagtcccaggaaacatgcctgtcagtaacctgcaagtcaggagatttttcttgcggtgggagggtcaatcgctgcatcccccaattttggcgatgtgacggacaagtggactgcgataacggctctgatgagcagggctgcctcactctttgcgagggcccgaacaaatttaagtgccactcaggcgagtgcatcaccctggacaaagtgtgcaacatggccagggactgtagggactggagtgacgaaccgattaaggagtgcggaaccaatgagtgcctggacaacaacggcggctgttctcacgtgtgtaatgatctgaagattgggtatgaatgcctctgccctgatggtttccagctggtggcccaacggcgatgcgaggacattgatgagtgtcaggatcccgacacgtgttcacagctgtgtgttaatctcgaagggggctataaatgccagtgcgaagagggctttcagctggatcctcataccaaagcttgcaaggctgtggggtctatcgcctacctattcttcacgaaccgccacgaagtcagaaaaatgactctggacaggtccgaatacacttccctgattcctaatctgagaaacgtagtggcgcttgatacagaagtggcgagtaaccgtatctattggagcgacttaagccagaggatgatctgcagcacccagctggacagggcacatggagtgtcatcgtacgatacagtcatttcacgggatatacaggctcccgatggtctcgctgtagactggattcactccaacatatattggacagatagtgtccttggtacagtgtcagtggctgatacaaaaggtgtcaagcggaaaactctgttccgtgaaaacggaagcaagcctagggccattgttgtggacccagtccatggcttcatgtattggaccgattgggggaccccagccaaaataaaaaagggcggcctcaacggagtggacatctacagtttagtgaccgagaacatccaatggcctaatggaattactttggacctcttatccggaaggctatactgggtcgatagcaagttacatagcatctcatcaatcgacgtcaatggcggcaaccgaaagaccattctggaggacgaaaaacgcttggcccatcccttctcactggccgtctttgaggacaaggttttttggactgacataataaacgaagccatcttctccgcaaatcggcttactggatccgacgtcaacttgctggccgaaaatctgctctccccggaggacatggttctcttccacaaccttacacagcctaggggagttaattggtgtgaaagaactaccctgtcgaacggcggatgccagtacctgtgccttccagcccctcaaatcaacccacattcccccaaattcacctgcgcctgtcccgatggcatgctcctcgccagagacatgcggagttgcctgacagaggccgaggccgccgtggctacccaagaaacttcaactgttagactcaaagtgagctctacggccgttcggacccaacataccactaccagaccagttcccgacacatcacgcctgcctggtgctacacccggcctgacaactgtcgagatagtaaccatgagccatcaggctctgggagacgtggcaggaagaggaaatgagaagaagccctcctctgtgcgggcactatcaatcgttctgcctattgtgctgctagttttcctttgtctaggtgtttttctcttatggaagaactggaggctgaaaaacataaacagcatcaattttgataaccccgtctaccagaagaccaccgaagacgaggtgcatatctgccacaaccaggatggctattcttatccttcacgccaaatggtttctcttgaggatgatgtcgcctag

SEQ ID NO: 3907 - DNA, 2460 bp, Artificial Sequence
  Description of Artificial Sequence: Synthetic coding sequence
atgggcccctggggctggaagctgcggtggaccgtggccctgctgctggcggcagccgggacggcggtcggagatcgttgtgagaggaacgagttccagtgccaggacggtaaatgtatcagttacaagtgggtctgtgacggaagcgctgaatgtcaggacggatctgacgaatcacaggagacctgctcacccaaaacatgtagccaagacgaatttcggtgtcacgatggcaaatgcatctcccgacagttcgtatgcgacagcgacagagactgcctcgatggctctgatgaggcaagttgcccagtcctgacctgcggcccggcctctttccaatgcaattcttcaacatgcataccacagctctgggcttgcgacaacgatcccgactgtgaggatgggtctgatgaatggcctcagaggtgtagaggattgtatgtgtttcagggcgatagcagtccctgttctgccttcgagtttcattgcctgagtggtgaatgcatccatagtagctggcggtgcgacggcggcccagattgtaaagataagtcagacgaggagaattgtgcagtcgccacctgcagacccgacgagttccagtgctctgacggaaattgcatccatggttcacggcagtgcgaccgagagtatgactgtaaagacatgtctgacgaggtaggttgcgtcaatgtcacactttgcgaggggccaaataaattcaaatgtcactcgggggaatgcatcaccctggacaaggtatgtaacatggccagggactgccgggactggagcgacgagccgataaaggagtgcggtactaacgaatgtctggacaataatggcggctgctcacatgtctgtaacgatctaaaaattgggtatgaatgtttatgccccgacgggttccagctcgtcgctcagcgcagatgcgaagacatcgatgaatgccaggatccagacacctgctcccagttgtgcgtgaatttagagggtggctataaatgtcaatgcgaagaaggattccagctcgatccccacaccaaggcttgcaaggccgtcggatctattgcgtacttgtttttcactaatagacacgaagtcaggaagatgaccctcgataggtcagagtacacatcccttattcctaacctgcgcaacgtcgttgccctcgacacagaggttgccagtaatcggatatattggtcggacctgagccaacggatgatctgttctacccagcttgatcgagcccatggtgtgtcctcttacgatacagttatctctcgggatatccaagcacccgatgggttagctgtcgattggatccacagtaatatttattggacggacagcgtgctgggcaccgtgagtgtcgctgacacaaaaggagtgaagcgaaaaaccctcttcagggagaatggatcgaagccgcgagccattgttgtggatcctgtgcacgggtttatgtactggacggattggggaacccctgctaaaataaagaagggagggctgaatggagtcgatatctattctctcgtcactgagaacatacagtggcccaatggcatcacactggatttgttgtccgggcggttgtactgggttgattccaagctccactcgatatcttcaatcgatgtaaacggaggaaaccggaagacaatcctggaagacgagaaacgcttggcacaccctttcagtctcgccgtgttcgaagacaaggtcttctggaccgacattattaatgaggccatattcagtgctaacagattgactggcagtgatgtgaatctgcttgccgagaatttactctcacccgaagatatggttctttttcacaacttgactcagcctcgtggggtgaattggtgtgaacgaactacactttcaaacggtggctgtcaatacctctgtctgccagcgccccaaatcaaccctcattcccctaagtttacctgtgcatgcccagatggaatgctactggctagagacatgcgaagctgcctgacggaagccgaagcggcagttgctacccaggagacgagcacagtcagactcaaggtgagcagcaccgcagtgagaacacagcacactacaacccggccagttcccgatacaagtagactacccggcgccaccccagggttgaccaccgtcgaaattgtgacgatgtcccatcaggccctgggcgatgttgcaggacggggaaatgagaagaagccctcttccgtgcgggcccttagcatcgttctcccaattgtcctcctggtgttcttatgtctgggagtgttcttattatggaagaattggaggcttaagaatatcaacagtatcaactttgacaaccccgtttaccaaaagaccacagaggacgaggttcacatttgccacaatcaggacggatacagctatccatccaggcagatggtctccctcgaggacgacgtggcctag

SEQ ID NO: 3908 - DNA, 2049 bp, Artificial Sequence
  Description of Artificial Sequence: Synthetic coding sequence
atgggcccctggggctggaagctgcggtggaccgtggccctgctgctggccgctgctgggacagctgtgggcgatcggtgcgagagaaacgaatttcaatgccaggacggcaagtgtattagctataagtgggtatgcgacggaagtgcagagtgccaagatggatcagatgagagccaggaaacctgcctcagcgtgacttgtaaatctggggacttctcatgcggcggaagagtgaataggtgtataccgcaattctggcggtgcgatggacaggtggattgcgacaatggctccgatgagcaggggtgcccagttgccacatgccgtcctgatgagttccaatgttctgacggcaactgtatacatggcagcaggcaatgtgatcgtgagtatgattgcaaggatatgagcgacgaagtaggctgtgtcaacgttacactatgcgagggacctaataagttcaagtgccactctggggaatgtatcactctggacaaggtatgtaacatggcacgcgattgccgggactggtctgatgagccaatcaaagagtgtggtactaacgaatgcctggataataatgggggctgttcccacgtgtgcaatgacctaaagattggctacgagtgtttatgtcccgatggcttccagctggtggcccagaggcgatgtgaggacatcgatgaatgccaggatccagacacgtgtagccaattatgcgtgaacttagagggagggtataagtgccaatgtgaggaaggcttccagctggatcctcacaccaaagcgtgtaaagctgtggggagcatcgcctaccttttcttcaccaatcgccacgaagtcaggaaaatgactctggataggtcggagtatacctctctcattcccaatctgagaaacgtggttgctctcgatactgaagtcgcatccaaccgaatctactggtctgacctttcccagcgcatgatttgctccacacagctggatagggctcacggtgtgagtagctatgataccgttattagtagagatatacaggctccagatggcctcgccgtggactggatccactcaaacatatattggaccgacagcgtcctaggcaccgtgtctgtcgcggacaccaagggggtgaaaaggaaaaccctctttcgcgagaacgggtcaaagcctcgagccatcgtggtggaccctgttcacggcttcatgtactggactgattggggaactcccgccaaaatcaagaaaggtggcctgaatggcgttgacatttactccttggtgactgaaaatatccagtggcccaacgggattactctggatctgctgtctggccgcctctattgggtcgattctaagctgcattccatcagctctattgacgtgaacggaggaaatcgaaaaacaatcttagaagacgagaagcgccttgcccacccgtttagccttgccgtgttcgaggataaagttttttggaccgacattatcaatgaggcaatcttttcggcaaacaggctgacaggatccgacgtcaacctcttagcagagaatctgctgtctcccgaggatatggtcctgtttcacaatctaacccagccgcgcgaggccgaggccgcagtggccactcaagaaaccagtaccgtcagactgaaagtgagcagcactgctgttagaacccagcataccactacgagaccagtaccagatactagccgcctgccaggggcgactcccggtctcactaccgtagagatcgtgactatgagccatcaagccctcggagatgtggccgggcgcggtaatgagaagaagccttcaagtgttagagctctatctattgtcctgcccattgtcctgctggttttcctctgcctgggtgtgtttctcttgtggaagaactggaggcttaaaaatatcaattctataaacttcgacaaccctgtctatcagaagaccactgaggacgaggtgcatatctgccacaatcaggacggatattcatatccctctaggcaaatggtgagtttagaggacgatgtcgcatag

SEQ ID NO: 3909 - DNA, 2577 bp, Artificial Sequence
  Description of Artificial Sequence: Synthetic coding sequence
atgggcccctggggctggaagctgcggtggaccgtggccctgctgctcgctgccgcaggtactgccgtcggcgaccggtgcgaacgaaacgaatttcagtgccaggacggtaaatgcatctcttacaagtgggtgtgcgatgggagcgctgagtgtcaggacggctctgacgaatcgcaggaaacatgtcttagtgtgacatgcaagtccggcgacttcagttgcggaggcagggtcaatcgatgtatacctcaattttggcggtgcgacgggcaggtggattgcgacaacggcagtgatgagcagggatgtccacccaagacttgttctcaggacgagtttcggtgtcatgatgggaagtgcatttcacgccagtttgtgtgcgattccgaccgagactgtctagacggaagcgatgaagccagctgtcctgtcttgacttgtggacccgcttcatttcaatgcaacagctccacatgtatcccccagctgtgggcttgcgacaatgatccggactgtgaagatgggtccgacgaatggcctcagcgctgtaggggactctacgtctttcagggtgattccagcccttgctctgcatttgaatttcactgtctgagcggggaatgtatccacagcagctggaggtgcgatggcggaccagattgcaaagacaagtccgacgaagagaactgtgccgtggccacctgtaggcctgatgagttccagtgtagcgatgggaactgcatccatggttcccggcagtgcgatcgtgagtacgattgtaaggatatgtccgatgaggtagggtgtgtcaatgtgaccctttgtgagggacctaataagtttaagtgtcacagtggggaatgcatcacactcgacaaagtctgtaacatggcaagagattgtagggattggtctgatgagccaatcaaggagtgtggtaccaacgagtgccttgataacaatggtggatgttctcacgtgtgtaatgatttaaagatcggttacgagtgcttgtgccccgacgggtttcagctggtcgcccagcggcggtgtgaggatatcgatgaatgtcaggatccggatacatgcagccagctatgcgtgaatcttgaagggggctataagtgccagtgtgaagaagggttccagctcgacccccacacaaaggcttgcaaggccgtggggagcattgcttacctcttcttcacaaatcgtcatgaggtccgcaaaatgactctggatcgatctgaatacacctcactcatacctaaccttcgcaatgtggtggccctcgacacggaagtggctagcaatcgcatctattggtcagatcttagccagcggatgatctgctctacccagcttgaccgcgctcacggagtgagcagttacgacaccgtgatctcacgcgacatccaggctcccgacggattagcagtcgactggattcactctaacatctactggactgattcggtactgggcactgtatccgtggcagacaccaagggcgttaagcgtaagacacttttccgcgaaaatggatcgaagcctcgcgccattgtcgtcgatcccgtgcatggttttatgtactggacagactggggcaccccggccaagattaagaagggaggcctgaacggcgtggacatatactctctggttacagaaaacatacagtggccgaatggaataacgctggacctcctttcaggaaggttgtattgggtggactctaagctgcacagtatctcaagtattgatgtcaatggggggaaccgtaagaccattttggaagatgagaagagactggcgcacccctttagtctggccgtctttgaggacaaggtcttttggaccgatatcatcaacgaagcaatattttcagcaaatcgtttaacaggtagtgacgtcaatctgctcgccgaaaatctgctctctcccgaagatatggtgctgtttcataacctcactcaaccccgaggggtgaattggtgtgaacggactacactgtccaacgggggctgccagtacttatgcctgcctgccccccaaataaacccacatagtcctaagttcacatgcgcctgcccggacgggatgctgcttgctcgtgacatgcggtcttgcctgactgaagcggaggctgcagtcgccacccaggaaactagcaccgttagactgaaagtgagttcgactgctgtcaggacacaacacacaaccacaaggcctgtccccgacacctctcggctgccgggagcaacccctggcctcacgaccgtggagattgtcactatgagccaccaggccctgggcgatgtagctggaagagggaacgagaagaaaccctctagtgtgcgtgccctgagtatcgtgctccccattgtcctgctcgttttcctgtgtctgggggtgtttctactgtggaagaactggcgactcaagaacattaacagcatcaacttcgataatccagtttaccagaaaacaacagaggacgaggtccacatttgtcataatcaagatggctactcttacccatccatggtaagccttgaggatgatgtggcctag

SEQ ID NO: 3910 - DNA, 2583 bp, Artificial Sequence
  Description of Artificial Sequence: Synthetic coding sequence
atgggcccctggggctggaagctgcggtggaccgtggccctgctgttggcagcggcaggaacggccgttggagacagatgcgaacggaatgagtttcaatgtcaggacggcaagtgtatttcatacaaatgggtctgcgatggatctgcagaatgccaagatggctccgatgaatcacaggaaacgtgcctatctgttacatgtaaaagcggtgacttttcatgtggtggacgagtgaataggtgcataccacagttctggagatgcgatggccaggtcgattgtgataatgggagcgatgaacagggctgtcctcctaagacgtgcagccaggacgaatttcgatgccacgatggcaagtgcatcagtcggcagtttgtatgtgactctgacagggattgtctggatggctctgacgaagcctcttgcccggtacttacctgtggacccgctagctttcagtgtaactccagtacctgtatccctcagttgtgggcttgcgacaatgaccctgactgtgaggatggctctgacgagtggccacagagatgtcgtgggttgtacgtgtttcagggagatagtagcccctgcagtgccttcgagtttcattgtcttagtggggagtgcattcacagctcgtggcggtgtgatggcggccccgactgcaaggataagtcagacgaagagaattgcgcggtggccacctgcagaccagacgagtttcagtgtagcgacggtaactgcatccatgggtcaaggcaatgcgaccgcgaatacgattgcaaagatatgtctgacgaagtcggttgcgttaatgtcaccctatgcgagggtcccaataaatttaagtgccattctggggagtgtattactctggacaaagtgtgcaacatggcgagagactgcagagattggagcgacgaacccattaaagaatgcggaacaaacgagtgcctggacaataatggagggtgctcgcatgtgtgcaatgacctcaagatcggatacgaatgcctgtgcccagatggcttccagttggttgctcagagacggtgtgaggatattgatgagtgccaggatcctgatacctgcagtcaactttgcgtcaaccttgaaggaggatacaagtgtcagtgcgaggaaggatttcagttagatcctcataccaaagcctgcaaggccgttggaagcatagcctacctgttctttactaacagacacgaggtgaggaagatgacgttggacaggagtgaatacactagcctaatccccaatctgaggaacgtcgtggccctggatactgaagtagcaagcaacagaatctattggtctgacctctctcaacgcatgatctgttcgacccaactcgatcgggctcatggtgtctcatcctacgacacggtgattagcagggatatacaggctcccgacgggctggctgtggactggatccattccaatatctactggacagactctgttctgggcaccgtgtccgtggccgacactaaaggagtcaagcggaagaccctcttcagagagaacggctctaaacctcgggccattgtcgtcgatcccgtgcacgggtttatgtattggacggattggggaactccggctaagatcaaaaaggggggacttaacggcgtggacatatactctctcgtaacggagaatatccagtggcctaatggcatcacactcgacctcttgtcaggccgcctgtactgggtggatagcaaactccatagcattagctctatcgacgtgaatggaggaaaccggaaaactatcctcgaggatgagaagcgcctcgcacatccattctccctggccgtcttcgaagacaaagtcttttggactgacattatcaatgaagccatcttctcggccaatcgcctgactggcagcgatgtcaatctcctcgcggaaaatctgcttagtcccgaagatatggtgctgttccacaatcttacacagccgcgcggagtcaactggtgcgagaggactactttgtcaaacggaggctgccagtacttatgccttcccgcaccacagatcaatccacacagccctaaattcacatgtgcttgccctgatggtatgctcctggcacgggacatgcgtagctgtctcacagaagccgaagctgctgtggctacacaggaaacttcgactgtaaggctgaaggtaagttcaactgccgttcgtacacagcatacaacaaccaggccagtacccgacacttccagactccctggagctacccccggtctgactactgtcgaaatcgtgacgatgtctcatcaagctttaggagatgtagcaggcaggggtaacgagaaaaaaccctcatccgttcgggctctttctatcgtgctgcctatagtcttgttagtatttctttgcctcggtgtctttctcctgtggaaaaactggagacttaagaacatcaattccattaactttgacaatcccgtgtaccagaaaactacagaggacgaagtccatatttgccacaaccaggacgggtactcttatccttctagacagatggtcagcctggaggatgatgtagcatag

SEQ ID NO: 3911 - DNA, 2220 bp, Artificial Sequence
  Description of Artificial Sequence: Synthetic coding sequence
atgggcccctggggctggaagctgcggtggaccgtggccctgctgctcgccgccgccggtactgctgtgggggaccgctgcgaacgcaatgattttcagtgcaactcaagcacctgtatcccacagctatgggcatgcgacaatgaccccgattgtgaggacggaagcgatgagtggcctcaacgatgcaggggactctatgtttttcagggggattctagcccatgttccgcctttgagttccattgcttgagcggtgaatgcattcatagcagctggcgatgtgatggtggaccagactgtaaggacaagtccgacgaagagaactgcgccgttgcaacctgtaggcctgacgaatttcagtgctccgacggaaattgcatccacggcagtaggcagtgcgatagagaatatgattgtaaagacatgtctgacgaagtgggttgcgtgaatgtcacattgtgtgaaggaccgaacaaatttaagtgccactcgggcgaatgcatcaccctggacaaagtgtgtaacatggctagggactgccgcgactggtccgatgaacccatcaaggagtgtggcacaaacgagtgtttagataataacggcgggtgctcccacgtgtgtaatgatctgaaaatcggatacgagtgcctctgcccagatgggtttcagttagtggctcagcgacgatgcgaggatatcgatgagtgccaggatcctgacacatgctctcagctgtgcgttaacctggaagggggttataaatgtcagtgcgaggagggcttccaactggacccacacacaaaagcctgcaaagctgtgggctctatcgcctacctgttcttcactaatcgccatgaagttagaaaaatgacgcttgataggagtgagtacaccagcttgatccccaatttacgaaacgtagtggcgctcgacacagaagtggcttccaataggatttattggtcggatctcagtcagcgaatgatttgctcgacgcagcttgaccgggcccatggagtgtcctcctatgacaccgtaataagcagagacatccaagccccggatggtcttgctgtggactggatccattctaacatctattggactgattccgtgttaggaacagtcagcgtagctgatacaaaaggggtgaagcgaaaaacgctgtttagagagaatggcagtaaaccccgcgctattgtggtcgaccccgttcatggttttatgtactggacagactggggcacacccgcaaagattaagaaaggcgggttaaatggagtcgatatttattccctagtgacggagaacattcagtggcctaatggcataactctggacctcctgtctggaaggctgtattgggtcgactctaaacttcatagcatatcctctattgacgttaacggagggaaccggaaaacaatcctcgaggacgaaaagcgtcttgcacacccgttctccctggctgtgtttgaggacaaagtcttctggactgatataattaatgaagcgatcttctctgcaaataggctcactggcagtgacgtgaacttgctcgcggagaatctgctgtccccagaagatatggtgctcttccacaacttgacacaacctcggggagttaattggtgcgagcggacgaccctctctaacgggggttgccagtacctctgtctgcctgcccctcagataaacccgcactcaccaaagttcacttgcgcttgcccagatggtatgctgctggcacgcgacatgcggagctgtctgacggaagctgaggccgctgttgccacacaggagacctccaccgtcagactcaaagtgtcctcaactgccgtgcgcacacagcacacgaccaccagacccgtccccgacacaagtagactgcccggcgccactcccggattgaccacggttgagattgtcaccatgagccaccaggcccttggagatgtggccggcaggggaaatgagaagaagccaagcagtgtcagagcgctctcgattgtgttgcccatagtcttactggtgtttctgtgtttaggggtgtttctgctttggaagaattggaggttaaagaacattaattccatcaattttgacaacccagtctaccagaaaacaactgaagatgaggtacacatttgtcacaaccaggatggctatagctatccaagccggcagatggtttccttggaggatgatgtggcatag

SEQ ID NO: 3912 - DNA, 2838 bp, Artificial Sequence
  Description of Artificial Sequence: Synthetic coding sequence
tgaggccggcccggcgtgcccccccggttcctgagccagcggcggcgtcaggtgcccggccctaggtccaggttacgcgatatccacgagtcgcccagtgtgattctgggtccccctggtgaagtccccggctttcgctgcgccctttggaggcacttgcgaccccacctggtgcttggaggagccttagccccacccgcccctatcaagtttactgagggccctcccgctactctgaaggcatccgtgccttacgaggttgagactctgccccaaaatcttcctgccccgccttggtctgctgctgagattttctctcacgtgggggaccggtgtgagcgcaacgaatttcaatgtcaagatggcaagtgcatttcctacaaatgggtgtgtgacggtagcgcagagtgtcaggacgggtctgatgagagccaggaaacatgcttgtctgtcacctgcaagtccggagatttctcttgcggaggccgagtgaaccggtgcattcctcagttctggcggtgtgacggacaggttgactgtgataatgggtcggatgagcaagggtgtcccccaaaaacctgtagccaagacgagtttaggtgtcatgacggtaagtgtatcagccggcagtttgtgtgcgatagcgaccgggattgcttagatggaagtgatgaggccagctgcccggtactcacctgtggccctgcttcctttcagtgcaactcaagcacttgcatccctcaactatgggcttgtgataacgaccccgattgcgaagatggtagtgatgaatggcctcagcggtgccgcggcctgtatgtgttccagggtgattccagtccttgttctgctttcgaattccactgcctgtccggcgaatgtatacatagcagctggcgctgtgatggaggaccagactgtaaagacaagtctgacgaagagaactgcgctgtggctacctgcagacctgatgaattccaatgttctgacggaaattgtatccatggctcgcgccagtgcgaccgtgaatatgattgtaaagatatgtcggatgaagttggttgtgtgaacgtcacattgtgcgagggccccaacaaattcaagtgccactcaggcgagtgcatcaccttggacaaggtgtgcaatatggcccgcgactgccgcgactggtctgacgaaccgatcaaggaatgcgggacgaatgaatgtctggacaacaatggaggctgcagccacgtgtgcaatgatctcaaaatcggctatgaatgtctctgcccggacggatttcagttggtcgctcagcgtaggtgcgaggacatcgatgagtgtcaagacccagacacctgctcccagctctgcgttaacctagagggcggctacaagtgccagtgtgaggagggatttcagctcgacccacacacgaaggcatgcaaggctgtagggtcaatcgcctacctcttctttaccaacagacatgaagtgagaaagatgaccctcgaccgctcagaatacaccagcctgatcccgaatttgcggaacgtggttgccttggatactgaggtagcgagcaatagaatctattggtcggatctgagccagagaatgatttgtagcactcaactggatcgggcccatggagtgtcttcatatgacaccgttatcagtagagatattcaggccccagacgggctagccgtggactggattcattcgaacatctactggaccgattctgtcctgggaaccgtctcagtcgcagacacaaaaggtgtgaaacgcaagaccttgtttcgcgagaacggatccaagcccagagcgattgtggtcgaccctgtgcatggattcatgtattggaccgattggggcactcccgctaaaataaagaaaggcggtctcaacggggttgatatctacagcctggttactgagaatatacagtggccaaatggaattactctggacctgttgagcggtaggttgtactgggtggattcaaaactccatagtatatcctctatcgatgtgaacggtggcaaccgcaagaccatattagaagatgaaaaacggctagcgcatccgttttcccttgccgtgtttgaagacaaggtcttctggactgacatcattaatgaggccattttttccgcaaaccgactgaccggctcggacgtgaatctactcgcagagaacctgcttagccctgaggacatggtgctatttcataatttgacccagccacgcggagtcaattggtgtgagcgtaccacgctgagcaacgggggatgccaatacttatgtctcccggctccgcaaattaatccacacagtcccaagtttacctgcgcctgccccgacgggatgttgctcgccagagacatgcgctcatgcctgactgaggcggaggccgctgtagctacgcaggagacgtccaccgtgcggctgaaggtttcatcgaccgcagtcagaacccagcacacaactacacgaccagtccccgatacatcccgattaccgggcgctacacccggtctaacgaccgttgaaatagtgaccatgagtcatcaagccctcggcgacgttgcgggacggggcaacgagaagaaaccctctagcgttcgcgccctgtccatcgtcctgccaatcgtgttgctggtcttcttgtgcctcggggtgttcttgctatggaaaaattggaggctgaagaacatcaactctattaacttcgataaccctgtctaccagaaaaccactgaagatgaggtgcatatctgccataatcaggacgggtacagttacccaagccgacagatggtctccctggaggacgacgttgcctag

SEQ ID NO: 3913 - DNA, 1770 bp, Artificial Sequence
  Description of Artificial Sequence: Synthetic coding sequence
atgagccggcggctgctgccccgggccgagaagcggcggcggcggctggagcagagacagcaaccagacgaacaacggagacggtctggggccatggtcaaaatggccgcagctggggggggtgggggcggaggtagatactacggtggaggatccgagggtggacgcgcacctaagaggctgaaaactgacaatgccggagatcaacacgggggcggggggggtggaggtggtggtgcgggtgcagccgggggtgggggaggcggagagaactatgacgatccgcacaagactcccgccagtccggtggttcacatcagaggtctcattgacggcgtcgtggaggccgatctggtagaagctctgcaggagttcggaccaatatcttacgtagtagtcatgccgaagaagagacaggcactggtcgaattcgaggatgtgcttggagcttgtaatgcggtcaattatgcagccgacaaccagatttacattgcaggacatccagccttcgttaactactctacatcacagaagatttctagacccggggactcagatgattcacggtctgttaattccgtcctgctgttcaccattctcaatcctatctacagcataacaacggacgtgttgtataccatttgcaacccctgtggtccggtgcaacgtatcgtgatcttccgtaaaaatggagtccaagccatggtggaattcgatagtgtgcagtccgcgcagagagcgaaggcctctctgaatggcgccgacatttattctggctgctgcacccttaaaatcgagtacgccaagcccacccgcttaaatgttttcaaaaacgaccaggacacatgggattacacaaaccctaacctcagcggccaaggcgatcccggaagtaacccgaataaacggcagagacagccccccctcctgggagatcaccctgcagaatatggcggccctcacggtgggtaccatagtcattaccacgacgaaggttacgggccgccacctccacactacgagggccgccggatgggtcccccggtcggaggacaccgccgaggcccttcacgctacggaccacaatacggccatccccctccaccaccccctcctcctgagtacggcccccacgctgactcaccagtgttaatggtgtacggattggatcagtccaaaatgaattgcgatagagtctttaacgtgttctgcctttatggcaacgtcgaaaaggtcaagttcatgaagtctaaacctggagctgccatggttgaaatggccgacggctacgctgtcgatcgggccattacccatttgaataacaacttcatgtttggacagaagttaaacgtctgcgtttctaagcagccagcgattatgccaggtcagagttacggactcgaggacggatcttgctcttataaagacttcagcgagagtaggaacaatcgattctctacgcccgagcaggccgcaaaaaacagaatccaacatcccagtaacgtgctgcacttttttaacgcacccttagaagtgacggaggaaaatttcttcgagatatgtgacgagttgggagtcaaacgacctagctctgtgaaggtgtttagcgggaaaagtgagcggagttcctctggcctgctggagtgggaatcaaagtccgacgcccttgaaaccttagggttcctgaatcattaccagatgaagaatcccaacggcccatatccatacactctgaaattgtgttttagcacggcccaacacgcgtcctag

SEQ ID NO: 3914 - DNA, 540 bp, Artificial Sequence
  Description of Artificial Sequence: Synthetic coding sequence
atgggccggcccggcctgggcgccgccgtgagcgacctgggcgaggctgtaagcctgagccagggactgctcctgcttctgctcctctccatgggcggggcttgggccagccgggagccgctgcggccttggtgccacccaatcaacgcgattttggccgtagaaaaggaggggtgcccagtatgtatcacagtcaatacaaccatttgtgcaggatactgccctacaatgatgagggtactccaggccgtgttacctccccttccccaagttgtgtgcacatatcgtgacgtaagatttgaatcaatcaggctgcccggttgtcccaggggcgttgaccctgtggtgagttttcccgtggcattgagctgcaggtgcggaccatgcaggcgttcaactagcgactgtggaggaccaaaggaccacccgctgacttgtgatcacccccagcaggcctcctcctccagcaaggacccccccaggtctctgccaagtccatccaggctactggagccagacacgcccatactgccccagtag

SEQ ID NO: 3915 - DNA, 294 bp, Artificial Sequence
  Description of Artificial Sequence: Synthetic coding sequence
atgcagctgggcaccggcctgctgctggccgccgtgctgagcctgcagttggctgccgctgaagcaatttggtgccaccagtgtacaggctttggtggctgcagccacggaagcagatgtcttcgcgattctactcactgtgtgaccacagccacccgtgtgctgtccaatacagaggacttgccattggtaacgaagatgtgtcatattggctgccctgatatcccctcgcttggcttgggcccatatgtgagcattgcctgttgccagacgagcctgtgtaaccatgactag

SEQ ID NO: 3916 - DNA, 2058 bp, Artificial Sequence
  Description of Artificial Sequence: Synthetic coding sequence
atgcccgcctacacccacgccagccccatccacaacacccacaagccatatgaatgcaaagagtgcggaaagtatttctcatgtggttcaaacctcatccagcatcaatctatccacaccggtgaaaagccctacaaatgtaaagagtgcgggaaggccttccagcttcatattcaactaacccggcaccagaaatttcacacaggcgagaagacattcgaatgcaaggaatgcggaaaggccttcaacttgcctacccagctcaaccgacacaaaaacattcacacagttaagaagctctttgagtgcaaggagtgcggcaaatcctttaatcgctcatctaatcttactcagcaccagtctatccacgccggagtaaaaccatatcagtgcaaggagtgtggtaaggccttcaaccgagggtctaacctgatccagcaccaaaagatccacagtaacgagaagccattcgtgtgccgcgaatgtgagatggcctttcgctaccactaccagctgattgaacactgtaggattcataccggtgaaaagccatttgagtgcaaggaatgtaggaaggcctttaccttgctgactaagctagtgcggcaccagaaaattcatatgggagagaagccctttgagtgccgcgaatgtggaaaggcgttttcattgttaaatcagctcaatcggcacaaaaatatccatactggagagaaaccttttgaatgcaaggaatgtgggaagtcgtttaaccggtcttctaacttaatccagcatcagagcatacacgccgacgtgaagccgtacgaatgcaaagagtgcggaaagggattcaaccgtggcgctaacttaatccagcatcagaagattcactcgaatgaaaaaccgtttgtgtgtcgagagtgcgagatggccttccggtaccattaccaactgatacagcattgccaaatccacaccggcggcaaacccttcgaatgtaaggagtgcggcaaagccttcagcttgctcacgcagttggcacgacacaaaaatattcacacaggcgaaaagccatttgaatgtaaggactgcggtaaggcattcaacagaggctccaatttggtgcagcaccaatcaatccatacaggtgagaagccctacgagtgcaaagagtgcgggaaagccttccgccttcacttacagctgagccagcacgagaagacccacaccggcgagaagccgtttgagtgtaaagaatgcggaaaattcttccggcggggtagcaatctcaaccagcatcggtctatacatactggcaagaagccatttgagtgcaaagagtgcgggaaggcattcagattacacatgcatctgataaggcaccagaaatttcataccggcgagaaacctttcgagtgcaaggaatgtggtaaagctttcagcctgcacacacagctcaatcatcataagaacattcacacgggtgagaaaccttttaaatgtaaggaatgcggcaaaagctttaaccgagtgagcaatctggtgcagcaccagtcgatccacgctggggtgaagccctacgagtgcaaggaatgcggcaaaggtttttccagagtctccaaccttatacagcatcaaaagacgcattcctcggccaaaccattcgtctgtaaggagtgtcgaaagaccttccggtatcactaccagctaactgagcactaccgcatccacaccggagaaaaaccgtttgagtgcaaggagtgcggtaaggccttcggactgcttacccaacttgcccaacaccagattattcacactggcgagaaaccattcaaatgcaaggagtgcgggaaagcgtttaatcgcggctccaacttggtccagccccagtctatccacactggagaaaagccatacgagtgcaaagaatgcgggaaggcctttcgcctgcatctgcagctgagcttgcaccaaaaactggtccaagtgagaaacccactgaacgtgcggaacgtcgggcagccatccgatatttctagcaacttacttaatattcggaagttcatccttggttag

SEQ ID NO: 3917 - DNA, 564 bp, Artificial Sequence
  Description of Artificial Sequence: Synthetic coding sequence
tgacggggcggcggcgacagctacggcgtgctgctgagcaacgccttggccaggctgaggggatttaaggaccacttcactttttgccagcagcttaatatatctatctgtcccctgtctcagacagccgcccgcttccaggtgatcgtctacaatccactaggaagaaaagtgaactggatggtccgattgcctgtaagtgaaggcgtcttcgtcgtgaaagaccctaacggacggacggtgcccagtgacgtcgtgatattcccatcgtccgattcccaggcacatcctccggagttactgttcagcgcctccctgcctgctctgggcttctccacatatagcgtagcccaggtgccacgctggaagcctcaggcccgagctccccagccaatcccacgccgatcctggtctccggccttgacgattgaaaatgaacatatacgcgctaccttcgatcccgataccggactcctgatggagattatgaacatgaatcagcagctcctactgccagtacggcagacgttcttttggtataatgccagcattggagacaactag

SEQ ID NO: 3918 - DNA, 3036 bp, Artificial Sequence
  Description of Artificial Sequence: Synthetic coding sequence
atgggcgcctacgcccgggccagcggcgtgtgcgcccggggctgcctggacagtgcgggaccatggactatgagccgtgcccttcggccccccctgccacccttgtgtttttttctcctgctccttgcggccgccggagcacgagctggcggatatgagacttgcccaactgtccagcccaatatgctaaacgtgcacttgctgcctcatactcatgacgatgttggttggttgaagaccgtcgatcagtacttttacggaattaagaatgacattcaacatgccggtgttcaatacatactggattctgtcatctccgccctattggctgatccaactagacgattcatctacgtggaaattgctttcttctcaagatggtggcatcaacagacaaatgcaacacaagaagtggttagggatctggtgaggcagggacggcttgaatttgccaacggcggttgggtcatgaatgatgaagcggctacccactatggcgctattgtggaccagatgaccctggggctgcgctttttggaagacacatttggcaacgatgggcgaccacgcgtcgcatggcacattgatccatttggccacagtcgcgagcaggcttccctgttcgctcagatgggcttcgatggttttttctttggtaggcttgactaccaggacaagtgggtgcgtatgcagaagctggaaatggaacaagtctggcgcgcctccacatcactgaaaccaccaacagccgatctcttcaccggagtgttgccgaacgggtacaatccacctagaaacttgtgttgggacgtgctttgtgtggatcaaccgcttgtggaggacccccgctctcccgaatacaacgccaaagagttggtggactattttctaaacgtcgccacagcccagggacgatattaccgaacaaaccacactgtgatgacgatgggaagtgattttcagtacgagaatgccaatatgtggtttaaaaatcttgataaacttatccgcctggtgaatgcacagcaggcgaaagggtcttctgtacatgtgctatactctaccccagcttgttatttgtgggaactcaataaggcaaatttgacatggagcgtgaagcatgacgatttcttcccttatgccgacggccctcaccagttttggacgggctatttcagctccagaccagccctgaaacggtatgagcgcctgtcttataactttttgcaggtgtgtaatcaactggaagcgctggtgggacttgccgccaatgtgggcccatacggttcaggcgactcagccccccttaacgaagcaatggccgtgctgcagcatcacgacgctgtgtccggtaccagcaggcagcatgtggccaacgattacgctcgccagctggctgccggatggggaccatgcgaggttctccttagtaacgctctcgcccgcctgcgagggttcaaagatcactttacattctgtcagcagcttaatatctcaatctgtcctctatcccaaaccgctgctcgctttcaggtgatcgtgtacaacccactgggtcgaaaagttaactggatggtgcggttaccagtgtccgagggcgttttcgtggtgaaagatcccaatgggcgtacggtccctagcgacgtggtgatttttccctcaagcgatagccaggcccatcctccagaacttcttttctccgcatcgttaccagccctcggtttctctacctactctgtagcccaggtgcctaggtggaaaccacaggcacgtgcgccacagcccatccctagaagaagctggagccccgccctgacaatcgagaacgaacacatccgggcaacctttgatcccgatacgggtctgttgatggagataatgaatatgaaccagcagttactgctgcccgtccgacaaactttcttttggtacaacgcaagcatcggggataacgagtctgaccaggcatctggcgcttacattttccgcccaaaccagcagaaaccgctcccggttagccgttgggcacaaattcacctggtgaagacacctctagtgcaagaagtgcaccagaatttctcagcatggtgcagtcaggtagtgcggctttatcctggacagcgacatcttgagctcgagtggagcgtggggccaatacccgttggtgacacatggggaaaggaagtgatctctcggttcgatacaccgttagagaccaagggcagattttatacagacagtaacgggagggagatattagagaggcgaagggattacaggccgacttggaaactgaaccaaacagaacccgtagcgggcaattactatcctgtgaatacccggatctatattaccgacgggaatatgcaattgaccgttcttactgataggtctcagggtggaagttctctgcgtgacggaagtcttgagctaatggtgcatcgccgactgcttaaagacgatgggcgcggagtctctgaaccactgatggagaatggctcgggcgcttgggtacgggggcgccacctggtattgttggacaccgcacaggccgcagcagccggccaccgcctactggctgagcaggaagtgttggcgccacaggtcgtgctggcaccgggagggggcgcagcgtacaacctgggagctccacctagaactcaattctcaggtctgaggcgtgatttaccacccagcgtgcacttgctcacgttagcgagttgggggccggaaatggttctgttacggttagagcaccagtttgctgtaggtgaagatagcgggaggaaccttagcgcccccgtgaccctcaatttacgggacctgttttctaccttcactatcacaagactccaggagacaacactggtggctaaccagctgagagaggccgcctcacgcctgaaatggacaaccaataccggaccgacgccacatcagactccgtaccagctcgatccagccaatatcactctcgagcccatggagattcggactttcctggcctctgtacaatggaaagaggtggatggctag

SEQ ID NO: 3919 - DNA, 2853 bp, Artificial Sequence
  Description of Artificial Sequence: Synthetic coding sequence
atgctgaacgtgcacctgctgccccacacccacgacgacgtgggctggctaaaaactgtcgatcaatacttctacggcattaaaaatgacatacagcatgctggcgtccagtatatcctggatagtgtgatatctgctctgctagccgacccaactcggcgcttcatctacgttgaaattgctttcttttcccgttggtggcatcagcagaccaacgcgacgcaagaggtcgtgcgcgacctcgtccgccaaggtcgcctggagttcgctaacggtgggtgggttatgaacgacgaagctgcaacacactacggtgcaatcgtggaccagatgaccttgggtctcaggttcctggaagacacgttcggtaacgacgggcggccacgcgttgcgtggcatatcgatccatttgggcactcccgtgaacaagcctcactcttcgctcagatgggctttgacggcttttttttcggaaggctggattaccaggacaaatgggtgagaatgcagaagctcgagatggaacaagtctggcgggcgtccacctctctgaagccccctactgctgacctgttcactggcgttctccccaatggatataatcctccgaggaacttgtgttgggacgttctttgtgtggatcagccgctcgtcgaggacccaaggagtccggagtacaacgcgaaggagctcgtagactattttctgaacgtggcaactgcccagggacggtactatcgcactaaccacaccgttatgactatgggaagtgacttccaatacgagaatgctaacatgtggtttaagaacctggataagctcattcgtttggtgaacgctcagcaggccaaggggtccagcgtgcatgttctgtattcaacccctgcatgttacctgtgggagcttaataaagcaaaccttacctggtcagtcaagcatgacgactttttcccgtacgcggatggccctcatcagttctggaccggctacttcagctctagacccgctcttaagcgttatgagagactgtcctacaacttcctgcaggtttgcaaccaactagaagcactcgtcggcctggcagcaaacgtagggccctatggcagcggggattcagctcccttaaacgaggctatggccgttttgcagcatcatgatgctgtgtctggcaccagcagacagcacgtggccaacgattatgcgcggcagcttgcagccggctggggaccatgtgaggtactgctaagtaacgccctggccagactccgggggttcaaagaccactttacattctgtcaacagttaaatatttcaatttgtccactgtctcaaacagcggcccgttttcaggtcattgtgtacaatcccctgggcaggaaagttaactggatggtgcgactacctgtgtcagagggcgtcttcgtggtcaaggacccaaatggacgcaccgtcccttctgatgtggttatcttcccctcctctgactcgcaagcccatcctcccgagctcctgttcagcgcatccctccctgcactgggattcagcacatattcagtagcccaagtgccgagatggaaaccacaggccagagccccgcaaccaatccctcgccgctcttggtcacccgctctgactatcgagaacgaacatatccgcgctacattcgatccagacactggcctcctaatggagatcatgaatatgaatcagcagttactcctaccggtgaggcagacttttttctggtacaacgcctctatcggtgacaatgaatcagatcaggcatccggagcatatatcttcaggcccaaccaacagaaacctctgcccgtcagccggtgggctcagatccacttggtgaagactcctttagttcaggaagtccatcagaacttctctgcctggtgcagccaggttgtgaggctgtacccaggtcagagacatctagagcttgaatggagcgtagggccgatcccggtgggggatacgtggggtaaggaggtcatcagcagatttgatactcctctcgagacaaagggtaggttttataccgattccaacggccgcgaaatccttgagcggaggagggactaccgccctacttggaaactgaaccagacagaacccgtcgcaggaaactactacccagttaatacccgcatctacatcacagatggcaatatgcagcttactgtgctgacagaccgatcccaggggggctctagcctgagagacggatccctcgagctcatggttcaccgtcgcctgctaaaagatgacgggcgaggagtatctgaacccctcatggagaatggcagcggagcttgggtgagaggacggcatctggttttgcttgatactgcccaggcggccgctgcgggccacaggctgcttgctgaacaagaagtgctcgctccacaggttgtgttagctcccggcggcggcgctgcttataaccttggggctcccccgaggacccagttctccggcttgaggagagacttgccgccttctgtgcaccttctaaccctcgcgagctggggcccagagatggtgctgctgaggctcgaacatcagttcgctgtcggggaggattcaggccggaacctttccgcccctgtgacactcaatctgcgagacctgtttagcaccttcacaatcacccgcctgcaggaaactacactggtagcgaatcagctgcgggaagctgcatccaggctgaaatggaccacgaacaccggccccacccctcatcaaactccataccagttagacccagctaatattacgctggaaccaatggagatacgcacattcctcgccagtgtccagtggaaggaagtggatggctag

SEQ ID NO: 3920 - DNA, 882 bp, Artificial Sequence
  Description of Artificial Sequence: Synthetic coding sequence
atgggcttccccgccgccgccctgctgtgcgccctgtgctgcggcttgctggcccctgccgctcgcgcgggctatagcgaggagaggtgtagctggaggggcagcggactgactcaagagccaggctcagttggccagctggcccttgcctgtgctgaaggcgcagtcgagtggctctacccggctggtgctctgcggttgacactcggagggccagatccccgcgcccgacccgggatagcatgtctcagacccgtccggccgttcgcgggcgcccaggtgtttgccgaacgcgccggaggagctctggaacttttgttagccgagggcccgggacccgctggcggtagatgcgtgcggtgggggccccgcgagagacgggcactgttcctgcaagcgacgccacaccaggatatctcccgacgggtcgccgcatttaggttcgagcttcgagaagacggccggccagaactcccacctcaagcgcatggccttggcgttgatggagcttgtaggccttgtagtgatgcagagcttttgctcgcagcatgcacttccgattttgtgattcatggcattatccacggagtaacccatgatgtcgagctgcaggaatccgtgatcaccgtagtcgctgctcgggtcctgcgccagacgcctccgttgtttcaagccggaaggtcaggcgaccagggcctgacaagcatacgcacgcccctgagatgtggagtgcacccaggccccggcacgttcctgttcatgggatggagcaggttcggagaagcaagacttggttgcgccccccgcttccaagagtttcgacgagcttacgaggccgccagagccgcccatctgcacccatgcgaagttgcgctgcattag

SEQ ID NO: 3921 - DNA, 708 bp, Artificial Sequence
  Description of Artificial Sequence: Synthetic coding sequence
atggagcaggacgaccccgtggaggccctgaccgagctgcgggagcgacgactcggcgctttggaattgctgcaggccgcagctggaagcggactggccgcctatgctgtttgggcgctgttgcttcaacctggattcaggcgcgttccccttagactgcaggttccgtacgtaggcgcttcagctcgccaggtcgaacacgttctgtccctactgcgtggaaggcctggaaaaactgttgacctcggtagcggagatgggagaatcgtgcttgctgcccatagatgcggcttacgtcctgccgtggggtatgagctgaacccatggttggtggctctggccaggctgcacgcgtggagggcggggtgcgcaggctccgtgtgctaccgtcggaaagacctatggaaagtctcactgcgggactgcaggaacgtgtccgtctttcttgcgccatccgtgctgccactactggaagataaattaagaacagaactacccgccggagcgagggtggtctctgggaggtttcctctcccaacatggcagccagttaccgcggtcggggaggggctggacagagtgtgggcctacgatgtgcctgagggagggcaggcgggcgaggccgcttcctctagaatccccatccaagcagctcctgggccatcctctgcaccaatccctggggggctcattagccaggcttcctag

SEQ ID NO: 3922 - DNA, 2253 bp, Artificial Sequence
  Description of Artificial Sequence: Synthetic coding sequence
atgctgcgggccaagaaccagctgttcctgctgagcccccactacctgcgacaagtgaaggaatccagtgggtcccggctcatccagcaacggttgctccaccagcagcagccgcttcaccccgagtgggcagcattagctaagaagcagcttaaagggaaaaaccctgaggatctcatttggcacactccagaggggatcagcatcaagcctctttactctaagcgcgacaccatggaccttccagaggaactcccaggagtgaagccctttactaggggaccgtacccgaccatgtatacatttcgcccatggacaatacgtcagtatgcaggtttcagcacagtagaggaatcaaataaattttacaaggacaacattaaggccggtcagcaggggctaagcgtggcgtttgacctggcgacccataggggatatgacagtgacaaccctcgggtgcgtggtgatgttggcatggccggagttgcgattgatactgtcgaagataccaaaatcctctttgacgggattcctcttgaaaagatgagcgtttcaatgaccatgaacggggcagtcatacctgtgttagccaatttcatcgtcacaggggaagaacaaggcgtgcctaaagagaaattaacgggcaccatccaaaacgatatcctaaaagagttcatggtgaggaacacctacatctttccacctgaaccttctatgaagatcatagcagacatctttgagtacactgccaaacacatgccgaagtttaatagtattagcatctcgggatatcacatgcaggaagccggagcagatgctatactcgagcttgcttacacgttggcagacgggctcgagtactcccgcacagggcttcaggccgggctgaccatcgacgaatttgcaccgcggctttctttcttctggggtatcggcatgaatttttacatggagatcgccaagatgagagcaggacggaggctttgggcccacttgatagagaaaatgtttcaacctaagaactctaagtcactgctcctcagggctcactgccagaccagtggctggagcctcaccgaacaggatccctataataatatcgtccgcactgccatcgaagctatggctgcagtttttggaggcacccaatctttgcacactaactcgttcgatgaggcactcggcctgccaaccgtcaagagcgccagaatcgcgaggaacacccaaataataatacaagaagagtctgggatccccaaggtggctgatccatgggggggaagttacatgatggaatgtcttacaaacgatgtatatgacgctgccctgaaactgatcaatgaaatcgaagaaatgggcggcatggcaaaggcagtggccgaaggaatccctaagctccgaattgaggagtgtgccgcaagacgccaggccagaatcgatagcggttccgaggtgattgtgggggtcaacaaatatcagctggagaaagaagacgcggtggaagtcctagctatcgacaatacatccgtaagaaacagacagattgagaagctaaagaagattaagagctccagggaccaagccctggccgagaggtgccttgcagccctgacggagtgtgcggcaagcggggatggtaatattctggctctggcggtggacgcctcccgggcccgctgtaccgtgggagaaattactgatgccttaaagaaggtcttcggggaacacaaggcaaacgaccggatggtgtccggtgcctatcgccaggaattcggcgagagtaaggaaataacctctgccatcaaaagagtacataaattcatggagagggaggggagaaggccacggctgctcgttgcgaagatgggacaggatggccatgaccgcggcgcgaaggtgattgcaacggggtttgcggatctgggctttgacgttgacatcggaccactgttccagaccccgcgcgaggtggcccagcaggcggtagatgccgatgttcatgctgtgggcatcagtacgctggccgccggccacaagaccctggtgccagagcttattaaggagctaaactcgttgggcagacccgacattctggtcatgtgcggcggtgtcattccgcctcaagattacgaattcttgttcgaagttggggtgtccaacgtatttggaccaggtacaagaatccctaaggcagccgtgcaggtactggatgacattgagaagtgtttagagaagaaacagcagtcagtctag

SEQ ID NO: 3923 - DNA, 594 bp, Artificial Sequence
  Description of Artificial Sequence: Synthetic coding sequence
acccggtacctggcccggtgcaccgtgggcgagatcaccgacgccttgaaaaaagtctttggcgagcacaaggccaacgacaggatggtctcgggtgcttatagacaggaattcggtgagagtaaggagattacatcggctatcaagcgggtgcacaaattcatggaaagagaaggacggcggcctcgactgctggtggcgaaaatgggacaggatgggcatgataggggggctaaagtcattgccacaggattcgctgatctggggtttgacgtggacattggtcctctctttcaaactcctcgcgaagtggcccagcaagctgtagacgccgacgtgcacgctgtgggtatttcaactctggctgcaggccataaaacacttgtccctgagctgattaaggaattaaattctctgggtagacccgatatactggtgatgtgtggcggtgtgatccccccacaagactatgagtttctgtttgaagtgggtgtgtcaaacgtgtttgggccaggaacaagaatcccaaaagcagccgtacaggtattagatgacattgaaaagtgtctggaaaaaaagcagcagtcagtgtag

SEQ ID NO: 3924 - DNA, 2685 bp, Artificial Sequence
  Description of Artificial Sequence: Synthetic coding sequence
atgatcctgctggccgtgctgttcctgtgcttcatcagcagctactcggcctcagtgaaaggacataccactgggctgtccctaaataatgatcggctctacaaattgacctactccacagaggtgctgttggatagaggaaagggcaagctgcaggattctgtcgggtatagaattagtagtaacgtggatgttgccctcctgtggagaaatcctgacggagacgatgaccagcttatacagatcaccatgaaagatgtgaacgtggagaatgtaaaccagcagagaggggaaaaaagcatattcaagggcaagtccccttctaaaattatgggtaaagagaatcttgaagcactccagaggccaaccctcctgcatcttattcatggcaaggtgaaggaattctatagttaccagaacgaggccgtcgccattgagaatattaagcgaggacttgcctccctcttccagacccagctgagttcaggcaccacaaacgaggtggacatctcgggcaactgtaaagttacttaccaggcccaccaggataaggtgattaaaatcaaggcacttgacagctgcaagatcgcacgcagcgggtttacaacacccaatcaggtgctcggcgtcagttcaaaggcaacaagcgtgacaacctacaagattgaggattccttcgtgattgccgtcctggctgaggaaacccacaattttggtctaaacttcttacaaaccatcaaaggaaagattgtttctaaacagaaactcgagctgaagactaccgaggcaggaccgagactgatgagcggtaagcaggccgctgccatcattaaagctgtagattccaaatacactgccatccccatagtgggccaagtttttcagtcacattgcaaggggtgcccgagcctgagcgagctatggcgctccacccgcaaatatctgcagcccgacaaccttagcaaagccgaagcagttagaaatttcttggcatttatccagcacttgcggaccgctaagaaggaagagatccttcagattttgaaaatggagaacaaggaagtattacctcaattggtggacgcagtcacgtcggctcagacatcagacagcctggaggctatccttgatttcttggatttcaaatctgacagcagcattattctgcaggagcgctttctttatgcctgcggcttcgccagtcatcctaacgaggagttgctccgcgcgcttatttccaagttcaagggatctatcggaagcagcgacatcagggaaaccgtgatgattattactgggacgcttgtcaggaagctatgccagaacgagggctgtaaattgaaagcagtagttgaggccaagaagctcatcctgggagggctcgaaaaagctgaaaaaaaggaagatactaggatgtatctgctcgccctgaagaatgctctcctacccgagggcatcccgagtttactgaaatacgccgaggctggtgaggggcctatctcacatctggccacgaccgctcttcaaagatacgacttgcccttcattacagacgaagtgaagaaaacactcaatcgtatctaccatcagaatcggaaagtgcatgaaaagaccgttcgtactgccgctgccgcaatcattctgaacaataacccttcctacatggacgtgaaaaacatcctactgtcgattggggaattaccacaggaaatgaacaaatacatgcttgccatagtgcaggatatcctaagattcgaaatgcctgcctccaaaatcgtccggagagtgctaaaggagatggtagcacacaactatgatcgattttctaggagcggatccagcagtgcctatactggctatattgaaagatccccgcgatcagcttcaacctatagcctggacatactgtactcaggaagcggaatcctccggaggtctaacttgaatatatttcagtacatcggcaaagctggccttcacggatcacaagtggtgatcgaggcccagggtctggaagctctgatagccgcgacccccgacgaaggggaggaaaatctagattcttatgcagggatgagtgccattctgtttgacgtgcagttgcggcccgttactttttttaacggttactctgatcttatgtcaaagatgctgtctgcatctggggaccccatttcagtcgtgaagggattaattttactcatcgatcacagccaggagctgcagctccagtccggcctgaaggccaatatcgaagtgcaaggagggttggccatcgacatctccggagcgatggaatttagtttgtggtatcgggagtcaaaaacacgggtcaaaaatcgcgtcacagtggtaatcacaacagacatcactgtcgattccagctttgtgaaggcagggctggaaacgtcaaccgaaactgaggctggactcgagtttattagtactgttcaattctctcagtacccttttttggtatgcatgcagatggacaaggatgaggccccgtttaggcagtttgaaaagaagtatgaaagactgtccacaggaaggggctacgttagccagaagcgaaaggagtccgttcttgccggttgcgagtttccccttcaccaggagaactcagagatgtgcaaagtcgtattcgccccccaaccagatagtaccagcagcggatggttctag

SEQ ID NO: 3925 - DNA, 2685 bp, Artificial Sequence
  Description of Artificial Sequence: Synthetic coding sequence
atgatcctgctggccgtgctgttcctgtgcttcatcagcagctactctgcatcagtcaaaggacacacgactgggctgagcctgaacaacgataggctatataagcttacatatagcaccgaagttcttctggatcgtgggaaaggcaagctgcaagattctgtagggtaccggatttcatccaatgttgatgtggctttgctgtggagaaaccccgatggagatgacgatcagctgattcagattaccatgaaggatgtgaatgtggaaaacgtgaatcagcagagaggcgagaagagtattttcaaggggaagtccccttcaaagattatggggaaggagaacctggaggctctgcagcggcctaccctattgcacctgatacacggcaaagtgaaggaattttactcgtatcagaacgaggcagtagccatcgagaacataaaaaggggactcgcatctctgtttcagacacagctatcttcaggaactactaacgaggtggatataagcggaaactgtaaagtgacttaccaggcacatcaagacaaggtcataaagatcaaggccctcgatagttgcaagattgcaagatctgggtttaccacacccaatcaagttctgggcgtcagctcgaaagccacgtcagtgactacctacaagatcgaagactccttcgtgatcgctgtgttggccgaggagacgcataacttcggtctgaacttcctccagacgattaagggcaaaattgttagtaagcagaagctcgaactgaaaaccaccgaggctggcccgaggctcatgtcagggaagcaagccgccgcaatcattaaagccgtggatagcaagtatacagcaatcccaatcgtaggtcaggtcttccagtcccattgcaagggatgcccctccctgtcagagctctggcggtccacccggaaatatctgcagcccgataacctctccaaggcggaggctgtgcggaactttttggcattcatccagcatttgcgaaccgcaaagaaggaggagattttgcagatactgaaaatggagaacaaggaggtgttgcctcaacttgttgatgcagtcactagtgcccagacttcagactcgctcgaagctatcctcgattttctggacttcaaatcagattcatcaattatactgcaggagcggttcctgtatgcttgcgggttcgcctctcatcccaacgaagaattacttcgggcactaatttcgaagtttaagggctctattggcagctccgacatccgggagaccgtcatgataatcaccggcacccttgttcggaaactgtgtcagaacgagggctgcaagctcaaagctgtagtggaggccaagaagttaatactgggtggcttagagaaggctgagaagaaagaggacacacgcatgtacctgctcgctctaaaaaatgcccttttgcccgaaggcatcccatcactattgaagtacgccgaggctggcgagggaccaatctctcatttggcgacaaccgctctgcagaggtatgacctgccatttattaccgatgaggtaaaaaagactttgaatcggatttatcaccagaaccgcaaggtgcacgagaagactgtgagaaccgccgccgcagcgattattctgaacaacaatcctagctacatggatgttaagaacattttgctgagcatcggcgagttgccacaagaaatgaacaagtacatgctagctattgttcaggacatattacggttcgaaatgcctgcgagcaaaatcgtcagacgggtcctgaaggagatggtagcacacaattacgacagattcagccggagtggtagctccagtgcttatactggatacattgaaaggtccccccgctcggcctcaacctactcactggatatattgtacagtggctctggcattttgcgaaggtcaaacttgaacattttccagtatatcggcaaagcaggcttacacgggagccaggtcgttattgaggcccaggggcttgaagcactcattgctgcaacacccgatgagggcgaagagaatttggacagttacgcaggaatgtcggcaattctgttcgacgtgcagttaaggcctgtgaccttcttcaacggttactccgacctgatgagtaagatgctatcagcctccggagacccaatctccgttgttaaggggctgattctcctcatcgatcacagtcaggagctccaacttcagagtggcttaaaggctaacattgaagtacagggcggcctagccatagacatcagcggagccatggagttctccctttggtatcgggaaagcaagacacgggtaaaaaaccgagtgacagtggtgatcaccaccgatattactgtggacagctccttcgtaaaggcaggcctggagacctccaccgaaactgaggcaggtctggagtttatctctactgtccagttcagtcagtatccatttcttgtgtgtatgcagatggataaagatgaggcaccttttcgacagtttgaaaaaaaatacgagagactgagcactggacgtgggtatgtctcacagaaaagaaaggagagcgtgttggcagggtgtgagtttccactgcatcaggaaaactccgagatgtgcaaggtggtattcgcaccccagcccgatagtacatcctcaggctggttctag

SEQ ID NO: 3926 - DNA, 537 bp, Artificial Sequence
  Description of Artificial Sequence: Synthetic coding sequence
atggcccgggcccccctgcggcccgagaacaccatcgtgcggggctctgccaatcaatgccaggacacataccgggcagaggagttgacaggtcacactaccggcctgagcctgaataatgatagactctataagctgacatattccactgaggtgctgcttgaccggggcaaagggaagttgcaggacagcgtggggtaccggattagctccaacgtcgacgtcgctctgctatggaggaatcctgatggggacgatgaccagctgattcagatcactatgaaggacgtcaatgtggagaacgtcaatcaacagagaggggagaaatctattttcaagggcaaaagcccttcaaagattatgggcaaggagaacctcgaggccctccagagacccacactgctgcatctgattcacggcaaggtaaaagaattctactcttatcaaaatgaggcagtggctattgaaaatatcaagagggggctagctagcctgttccagacccaactgagctccggcaccactaatgaggtgtag

SEQ ID NO: 3927 - DNA, 1551 bp, Artificial Sequence
  Description of Artificial Sequence: Synthetic coding sequence
atgatcctgctggccgtgctgttcctgtgcttcatcagcagctactcggcaagtgtcaaaggccatactactggcctgtctctgaacaacgatcggttgtataaactgacctacagtacagaggttctactagatagaggtaaaggcaaactgcaggactccgtgggataccgcatatctagcaatgtggatgtggctctcttgtggaggaatccagacggggatgacgaccaacttatccagatcacaatgaaagatgtcaacgttgagaacgtgaaccagcagcggggagaaaaatccatatttaaaggaaagagcccttcgaagataatgggaaaagagaacttagaggcgctgcagcgtcccactctgctgcatctcatccacggcaaggtgaaagaattctattcctaccaaaatgaagccgtagcaatagagaacataaaaagaggactggcttcgctcttccagacgcagttatcaagcggtacaaccaacgaagtggacataagtgggaattgcaaagtaacttatcaggcgcatcaggacaaggtgattaagattaaagcattagattcctgtaaaattgccagaagtggcttcaccacacctaaccaggtactgggggtctcaagcaaggcaacttctgtaaccacatacaagattgaagatagctttgttatcgccgtcttggcagaggagactcataactttggcttgaattttttgcagacgatcaagggcaagatcgtctctaaacagaagctggaacttaaaacgactgaggctgggccacgactgatgtcagggaaacaagctgccgccatcatcaaggcggtggactcaaaatatactgccatccctatcgttgggcaggtcttccaatcgcattgcaaaggctgtccatccctgagtgagctgtggcgaagtacgagaaaatatctgcagcctgacaacctttctaaagccgaagccgttcgcaattttctagcttttatccagcatctccgtacagccaagaaagaggaaatcttacagattctaaagatggagaacaaagaagttctcccgcagctcgtggacgccgttacaagcgcacagacaagtgactccttggaggccatactagactttctcgactttaagtcagattcctcgatcatcttacaggaacgctttctatacgcttgtggattcgcaagccaccctaacgaagagctgctgagggctctgatttctaagtttaaaggaagcatcgggagttcagatataagagagacagtcatgatcatcacaggaaccctggtaaggaaactgtgtcagaacgaaggttgtaagctgaaggccgtagtggaagctaagaaactgatactgggcgggctggaaaaagccgagaaaaaagaggacacccgcatgtatctgttggctctcaagaatgccctcttacctgaaggcatcccatccctgctgaagtacgccgaggcaggagagggtccaatctctcatctcgccacgaccgcactccagaggtacgatctgttccataactag

SEQ ID NO: 3928 - DNA, 3771 bp, Artificial Sequence
  Description of Artificial Sequence: Synthetic coding sequence
atgctgttcaagctgctgcagcggcagacctacacctgcctgagccatcgttatgggctctatgtgtgtttcctcggggttgtcgtaaccattgtgtcagcctttcagtttggtgaagtcgtgttagagtggagcagggatcaatatcatgtgttgttcgactcctatcgcgacaacatcgccggtaagtcatttcaaaacagattgtgcctccctatgccaattgatgtggtatacacatgggtcaatggaactgatctagaacttctaaaagaactacagcaggttcgggaacagatggaggaggagcaaaaggcgatgagagagattctaggcaaaaataccacagagccaactaagaagtctgagaaacagttagagtgtttgcttacacattgcattaaagtgccaatgctggtcttggaccccgcgctccccgctaacatcaccctgaaggaccttccgtcactgtatccctcattccactctgccagtgacatctttaatgtggccaagccgaaaaatccaagcactaacgtgagtgtcgtcgtcttcgattccactaaagatgtggaagatgcccactccggcttgttgaaagggaatagccggcagaccgtgtggcggggctacttgacaacagacaaggaggtaccagggttagtgctcatgcaagatctggcttttctgagcgggtttcccccaaccttcaaagaaaccaaccagctgaaaactaaattgcccgagaacttgtcaagtaaagttaaactcctccagctgtattcggaagcttctgtggctctgctgaaactgaacaacccgaaagacttccaggagctgaataaacagaccaagaagaacatgacaatcgatgggaaggagttaaccatcagccctgcctacctcctctgggacctttccgctattagtcaatctaagcaagatgaagatatctcggctagtcgctttgaagataatgaagagctgcgttatagccttcgttctattgaacgccatgccccctgggtccgcaatatctttattgtcaccaacgggcagattccaagttggctgaatctcgacaatccgcgggtgacgatcgtcacccaccaagacgtcttccgcaacctgtcccatctgccaactttctccagtccagctatcgagagtcacatccatcgcatcgagggcctgagccagaaattcatctatctcaacgatgatgtaatgttcggaaaggacgtgtggccagatgacttttacagtcacagcaagggccagaaagtttatctgacatggcccgtccccaactgtgccgaggggtgccccggttcctggatcaaagatggttattgtgataaggcctgtaacaactctgcatgtgattgggatggtggagactgttctggaaatagtggtggctctaggtacatcgccggaggcggaggcaccggttcaattggcgtcggccagccctggcagtttggcggcgggattaatagcgtgagctactgcaatcagggatgtgccaatagttggctggctgataaattttgtgatcaggcttgcaatgtgctatcgtgcggttttgacgcaggagattgtggtcaagaccatttccatgagttgtacaaagtcattctactgccaaaccaaacacactatattatcccgaagggcgagtgccttccttatttctcattcgcagaggtggcaaaaagaggagttgagggcgcgtattccgataatccaatcatccgccatgcctccattgcaaataagtggaagaccatccatctcattatgcacagcggcatgaacgctaccaccattcatttcaatctgacttttcaaaacacgaacgacgaggaattcaagatgcagatcaccgtggaggtcgatacaagggaggggccaaagctaaactccacagctcagaaggggtacgaaaatctggtttcgcctatcacgctcttgccagaagctgaaatactctttgaagacattccgaaggagaagagattcccaaagttcaaacgccatgacgttaatagcacaaggcgcgcccaggaggaagtgaagatcccgttagtgaacataagtcttctccctaaggacgcccagctgtccctaaatactctggatctgcagttggaacatggcgacattacgctcaaagggtacaatcttagtaagagcgctctgttgcgctctttcttgatgaatagccaacacgctaaaattaaaaaccaggcaattattaccgacgaaactaatgattctctcgtcgccccccaggagaaacaagtgcataagagcatcttgccaaactcactgggagttagtgagcggctgcagcgtctgactttccccgcagttagtgtcaaagtgaacggccacgaccagggccagaatccaccattagacttggaaacaacagctcgtttcagggtggagacacatactcagaagactatcggtggcaacgtaacaaaagaaaaaccacctagcctcattgttccattggagagtcagatgactaaagagaaaaaaatcaccggaaaagagaaggaaaacagccgcatggaggaaaatgccgagaaccatatcggggttacagaggtgctgctgggtcggaaactccagcactataccgatagctaccttgggttcctgccgtgggaaaaaaagaagtattttcaggatctccttgacgaggaggaatcactgaaaacccagctcgcatatttcacagactcaaaaaacacgggacgccagctaaaggatacgtttgccgacagcctgcggtacgtgaataaaattctgaactcgaaatttgggttcactagccgtaaggttccggcccatatgccacacatgatcgaccgcatagtgatgcaggagctgcaggacatgtttcccgaggagttcgacaaaacatcctttcataaggtgagacatagtgaggatatgcaattcgccttctcatacttctactatttgatgtccgcagtccaaccactgaacatctcacaagtgttcgacgaggtagatacagaccagagcggtgtgctgtcagaccgtgagataagaactctggcaactcggatacacgagctgccactgtctttacaggacttgacaggcctggaacacatgcttatcaactgttccaaaatgttgcccgctgatattacacagctcaataatataccacccacacaagaaagctattatgatccaaatctccccccggtaacaaagtcgctcgttaccaattgcaagccagtcacagacaagattcacaaagcttacaaagacaaaaataaatatcgctttgaaattatgggggaagaagagatagcgtttaaaatgataagaacaaacgtctcgcatgtggtaggccagctcgacgatattcggaagaacccgaggaagtttgtgtgtctcaatgacaatatcgaccacaaccacaaggacgctcagacggtgaaagcagtgctgcgcgacttttacgagtcgatgttccctatacccagtcaattcgaattacccagagagtatagaaatcgcttcttgcacatgcatgaattacaggaatggcgggcctatagggacaaattgaagttctggacccattgtgttctcgcaaccctcattatgtttacgattttttcgttcttcgccgagcagctgatcgcactgaagaggaaaatcttccctagaagaaggatacacaaggaagcatctcctaatagaatcagagtgtag

SEQ ID NO: 3929 - DNA, 1473 bp, Artificial Sequence
  Description of Artificial Sequence: Synthetic coding sequence
atgctgttcaagctgctgcagcggcagacctacacctgcctgagccaccgatatgggctgtacgtgtgcttcttaggcgttgtcgtcaccattgtgtcggcattccagtttggcgaagttgtattagagtggagccgcgaccagtaccacgtgctattcgatagttatcgggataacatagcaggcaaaagcttccagaataggctgtgtctccctatgcccatcgatgtggtatacacttgggttaacggcaccgacctagaactgctgaaagaactccagcaagtgcgggagcaaatggaggaagaacagaaggcaatgcgcgagatcctgggaaaaaatacaaccgaaccaactaagaagagtgagaaacagttagaatgtctgctgacccactgtataaaggtgcctatgcttgtactggatccagcactgccagccaatattacccttaaggaccttcctagcctgtatccaagtttccattcagcctccgatatatttaacgtggccaagcctaaaaatcccagtacgaatgtaagcgtcgtggttttcgattccacaaaggacgtggaggacgcccattctgggctcctcaaggggaactcccggcagacagtatggcggggctatttgactaccgataaggaagtcccaggccttgttctgatgcaggatttggcctttctttccggttttcctcccactttcaaggagacaaaccaactgaagaccaagttgcccgaaaatttgtcgtccaaagtgaagttactccagctatacagcgaggcatctgtggctctccttaagctcaacaatccaaaagacttccaggagctcaacaaacagacaaaaaagaatatgactatcgacggcaaggaactgactatctcacccgcttatctgttatgggacctgagcgctatctcacagagcaagcaggacgaggacattagcgccagcaggtttgaggataacgaggaactccgatattccttgcgctccatcgagcggcacgcaccctgggtccgtaacatctttatagtgaccaacggccagatcccctcatggctcaacctggataaccctcgggtgacaatcgtaacccaccaagatgtgttccgaaatctatctcatcttcccaccttctcaagccctgccatcgaatcccatattcataggattgagggcctgtcccaaaaatttatctacctgaatgatgacgtcatgtttgggaaggatgtgtggcctgacgacttttacagccacagtaaaggacagaaggtttatttgacgtggccagtgccaaattgcgcggaggggtgcccaggcagctggattaaagatggttactgcgacaaggcctgcaacaattccgcctgtgactgggacggtggagattgttccggcaaagatgtgctcaattgcaacagctttatctttatggagtattttcttctgaatcattattag

SEQ ID NO: 3930 - DNA, 1605 bp, Artificial Sequence
  Description of Artificial Sequence: Synthetic coding sequence
atggccaccgccctgatggccgtggtgctgcgggccgccgccgtggcaccaagactgaggggccgcggcggaacagggggagcacgcagactgtcttgtggagctagaagacgggcagcacgcggaacctcccccgggaggaggctatcgaccgcttggtcccaaccacagccaccccctgaagagtacgccggagcggacgatgtgtcccagtctccagtggccgaggagccttcctgggtcccatccccacgaccacctgtacctcacgagagtccagagcccccttccggaaggtccctggtgcagcgcgacatccaggcttttctcaaccagtgtggcgcctccccaggggaagccagacactggctcacgcagttccaaacatgtcatcacagtgcggataaacccttcgccgttattgaagtggacgaagaagtcttaaagtgccaacaaggcgtatcaagtctggcttttgctttggccttcctgcaaagaatggacatgaagccactggtcgtcctggggctccccgctccgacagcaccgtcagggtgtctgtcattctgggaagccaaagcacagctggctaaatcatgtaaagtcctcgtggacgcacttagacacaacgcagccgctgccgtaccgttcttcggtggcggttcagtacttcgggctgcagaaccagcaccacacgcctcctacggaggtatcgtgtctgtggaaacagacctgcttcagtggtgcttagagtcaggctcaattccaatcctctgtcccatcggagaaacagccgctcgcagatcggtgttgctagattcgctggaggtgaccgcttcattagcgaaggccctcaggcctacaaagatcatcttcctgaacaatacaggtgggttgcgtgattctagtcataaagttctctctaacgttaaccttcctgcagatctggatctggtgtgcaacgctgaatgggttagcacgaaagagcggcagcaaatgaggttgattgtggacgtgctttcccgcctccctcaccatagcagtgccgttattactgccgccagtacactcctgaccgagctgtttagcaataaaggtagtggcacgctattcaagaacgcagaaagaatgctccgagtaagatcccttgacaaacttgaccagggccgcctggttgacctggtgaacgcttcattcggcaagaaactgagagatgactacctggcttctctgcggcctcggttacattctatctacgtatccgaaggctacaatgctgcagccattctgactatggaaccagtgctcgggggaaccccataccttgataagtttgtcgtcagcagctcaagacagggacagggatctgggcagatgctgtgggaatgccttcgtcgtgacttgcagaccctcttttggcgctcacgggtgactaatcccattaacccttggtacttcaagcattcagatggcagtttctctaataagcagtggatttttttctggtttgggctagctgacatcagggattcctacgaacttgtcaatcacgcaaagggtttacctgactcattccacaagccagcctctgatcctgggagctag

SEQ ID NO: 3931 - DNA, 1107 bp, Artificial Sequence
  Description of Artificial Sequence: Synthetic coding sequence
atggacatgaagcccctggtggtgctgggcctgcccgcccccaccgcgccaagcggctgcctttccttctgggaagccaaagctcaactggctaaatcatgtaaagtgctggtagatgcgctgaggcacaacgctgccgccgccgtgccattctttggcggggggtccgtactcagggcagcggagcctgcacctcacgcctcctacggcggcatcgtttctgtcgagactgatcttttgcagtggtgcctggaaagtggcagtattccaatactatgtcctattggggagactgcagcccggcggagcgtgcttctcgactccttagaggtgactgcatcgttagccaaggccttgaggccaactaagattatcttcttgaataacacagggggcctccgagactccagccataaggtgttgtcaaacgtcaaccttccagcagatctggatctcgtatgcaatgccgaatgggtgtcaacgaaggagagacagcagatgcggctcatcgtggatgtcttgtcccgactaccacaccattcctccgcagttattacagccgcttccacactactaacggagctcttcagtaacaaagggtcaggaacgttattcaaaaatgcagaaaggatgctccgggtaaggtctctggacaagctggatcagggacgactggtcgatcttgtaaatgcatccttcggaaaaaagcttcgcgacgactatcttgcaagcctcaggccccggctgcacagtatttatgtcagcgaaggatataacgcggcagctatattaactatggaaccagtcctaggaggaacaccatacctggataagtttgtggtgtcatcgtccaggcagggccagggctcgggtcagatgctctgggaatgtctcagacgtgacctgcagactttgttctggcgctcccgcgtcactaatccaatcaacccgtggtatttcaaacattccgacggatcctttagcaacaagcagtggatctttttctggtttggcttggctgatatccgcgactcctacgaattggttaaccacgccaaaggactgcccgacagttttcacaagccggcctccgacccgggtagttag

SEQ ID NO: 3932 - DNA, 1188 bp, Artificial Sequence
  Description of Artificial Sequence: Synthetic coding sequence
atgcccggccggagctgcgtggccctggtgctgctggccgccgccgtctcctgcgcggtcgcacaacacgcccccccttggaccgaggattgccggaaatccacgtacccacctagcggacccacctataggggtgctgtcccttggtacacgattaacttagacttgcccccatacaagaggtggcacgaattgatgctcgacaaagcacccgtgttgaaggtaatcgtgaactccttgaaaaacatgatcaatacctttgtaccttcaggaaaaatcatgcaggtagtcgatgagaaactacccggattgttggggaattttcctggccccttcgaggaggagatgaaaggaattgctgccgtgaccgatatccccctcggagagattatttccttcaatatcttttacgagctcttcacaatttgcacctcaatagtcgcggaagacaagaagggacacctgattcacggacgtaacatggattttggagtattcttgggttggaatattaataatgatacttgggtgattaccgagcagctgaaacctttgactgtgaacctcgacttccagcggaataacaaaacagttttcaaggcgagtagtttcgccggatacgtagggatgctcaccggttttaagcccggactgttctccttgacccttaacgagaggttcagcattaacggcggatatctcggcatccttgagtggatcctcggtaaaaaagacgtgatgtggatcggcttcctgacacgcactgtgttggagaacagcacatcatacgaagaggccaaaaacctactgacaaagactaagattctggcacctgcctattttatcttaggcgggaaccaaagcggagagggctgtgtgatcacccgagacagaaaggaaagtcttgacgtctacgagctcgacgcaaagcagggacgatggtacgtggtccaaactaattatgatcgctggaaacatcccttttttttggacgaccggaggacacctgctaaaatgtgtctaaatcgcacctcacaggagaacatcagcttcgaaacaatgtacgatgtcctgtcgacgaagcctgtcttgaataaattgactgtgtataccactctgatcgacgtcacgaagggacagtttgagacgtatttgagggactgtccagatccttgtatcggctggtag

SEQ ID NO: 3933 - DNA, 1170 bp, Artificial Sequence
  Description of Artificial Sequence: Synthetic coding sequence
atgaactgctgcatcggcctgggcgagaaggcccggggcagccacagagctagttacccatccctctccgcgctgtttaccgaagcaagtatcctcggctttggcagcttcgccgtcaaagctcaatggacagaagattgtcggaagagtacttatcccccctccgggcccacagtgtttcctgcagttatccgctatagaggggctgtgccatggtatacaattaatctagacctgcctccatacaagcgatggcatgaattgatgctagataaggcgccagtccctggcttgctggggaatttccctggacccttcgaggaggaaatgaaaggcattgctgccgtaacggacatccccttgggcgaaataatatctttcaatatcttttacgagttgttcacgatttgcactagcatcgttgccgaggataagaagggccatctcatacacggaagaaatatggacttcggagtctttctcggctggaatataaataacgacacctgggttatcaccgagcaactgaagcctctcaccgtaaatctggatttccaaagaaataacaaaacagttttcaaagcatccagctttgccggctacgtgggcatgttgactggattcaaaccagggctgttcagccttactcttaatgaacgcttctcaattaacggaggctatctgggaattctggagtggatcctggggaaaaaggacgtgatgtggatcgggtttctgactcgcacggttctggaaaacagcacttcctatgaagaagccaaaaacttgctgaccaaaaccaagatcctggccccagcttacttcattctcggcggcaaccagagtggtgaaggctgtgtaattaccagagatcggaaagaatccctagacgtttatgaactggatgccaagcagggcagatggtatgtggttcagacaaattacgatagatggaagcaccctttctttctggacgaccggcgcacgccggccaaaatgtgcctgaaccgcaccagccaggagaatatatcttttgagacaatgtacgatgtgctgagcactaaaccagtcctgaataagctgacggtttacacaacactaatcgatgtgaccaagggccagttcgagacgtatttacgcgattgtccagatccatgtattggatggtag

SEQ ID NO: 3934 - DNA, 1236 bp, Artificial Sequence
  Description of Artificial Sequence: Synthetic coding sequence
atgaactgctgcatcggcctgggcgagaaggcccggggcagccaccgggcctcctaccccagcctgtctgccttattcactgaggcgtctatactaggtttcggctcctttgctgtgaaagcccagtggaccgaagactgcagaaagtctacatacccaccttcgggcccaacataccgtggagcagttccatggtacacaataaacctggaccttccaccatacaagaggtggcatgaattaatgctggacaaagcccctgtcctcaaggtaattgtgaattctctgaaaaacatgattaatacttttgtacccagcggtaaaattatgcaagttgtggatgaaaagctgccaggcctgctgggaaattttccggggccgtttgaagaggaaatgaagggaatcgctgccgtgacagacattccccttggagagatcatctcttttaacatcttctacgagctattcaccatctgtacctcaattgtggccgaagacaaaaaaggacacttgatccacggaagaaacatggactttggggtgtttctcggctggaatatcaacaatgatacgtgggtgataaccgagcagttaaaacccctcactgtaaatcttgacttccaacggaataacaaaacagtattcaaggcaagctcttttgctgggtacgttggaatgctgaccgggtttaaacctggacttttttctttgaccttgaacgaacgtttttcaatcaatggcggatatctgggcattctcgagtggatcctagggaaaaaggatgtgatgtggattggtttcctgactcgcactgtgctggaaaattccacgtcatacgaagaagccaagaatttgctgacaaagacgaaaattctggcccctgcttactttattctgggcggtaaccagagcggcgagggatgtgtgattacccgagatcgcaaggaatcccttgatgtgtacgaattggatgccaagcagggcagatggtatgtggttcagactaactacgatagatggaaacacccattcttcttggatgatcggagaacccccgccaagatgtgtctcaacagaacatcccaggagaacatttctttcgagaccatgtatgatgttttgtccactaagcctgtcctgaataagcttaccgtgtacacaacactcatagatgtgaccaagggccagttcgaaacgtatctacgcgactgccccgacccgtgcatcggttggtag

SEQ ID NO: 3935 - DNA, 918 bp, Artificial Sequence
  Description of Artificial Sequence: Synthetic coding sequence
atgctggacaaggcccccgtgctgaaggtgatcgtgaacagcctgaagaatatgataaacacattcgtaccaagtggcaagatcatgcaggtagtcgatgaaaagttgccaggcctgctggggaacttccctggccccttcgaggaggagatgaagggtattgctgctgtgacggacatccctttgggccacctgatacacggtaggaatatggatttcggtgtgttcctcgggtggaacatcaataatgacacctgggttattaccgagcagcttaagccactaaccgtcaacctggactttcaaagaaacaacaagaccgtcttcaaggccagtagctttgcgggctatgtgggcatgctgacggggttcaaaccgggcctcttttctctgactctcaacgagcggttcagtattaatggtgggtacctcggaatccttgaatggatacttggaaagaaagatgttatgtggattggattccttacacggactgtgctggagaatagcacctcctacgaggaggccaagaacctgcttaccaaaacgaaaatcctggctccagcgtattttatcttaggcggcaaccagagcggtgagggctgtgtgatcaccagggaccggaaagaatcactagacgtctatgaactggacgccaaacaagggagatggtatgtcgtgcaaaccaactatgatcggtggaaacacccttttttcctcgacgacaggcgaacccccgcaaaaatgtgcttaaacaggacctctcaggagaacataagttttgaaactatgtacgacgtgttatcaactaaaccagtgctcaataagttaaccgtatatacaactctcattgacgtgaccaagggacagtttgagacttacctgagagactgtcctgatccttgcatcggctggtag

SEQ ID NO: 3936 - DNA, 1113 bp, Artificial Sequence
  Description of Artificial Sequence: Synthetic coding sequence
atgcccggccggagctgcgtggccctggtgctgctggccgccgccgtatcatgcgccgtggcacaacacgcccctccatggacagaagattgccgaaagagtacctatcctccttccggtcctacttaccgcggcgctgtgccttggtatacgattaatctggatttgcccccctataaaagatggcacgaacttatgcttgacaaagctcccgtcttgaaagtcattgtaaactctctcaagaacatgattaataccttcgtgcctagcggtaaaattatgcaggttgtggacgagaaacttcctggcctcctgggaaattttcccgggccatttgaggaagaaatgaagggaatcgccgcggtgacggatatcccactcggacacctgattcacggccgtaatatggatttcggcgtgtttctcggctggaacatcaataacgacacttgggtgatcactgaacagctcaagcccctcaccgttaacctggatttccaacggaataacaagactgtgtttaaggcaagtagtttcgcaggatatgtcgggatgctgaccggatttaaaccgggcctgttcagcttgaccttgaatgagagatttagcattaatggaggctatctggggatcctcgagtggattctcggaaaaaaggacgtcatgtggataggattcttgacacgcacagttctggagaactccacctcatacgaggaggccaaaaatctgctcaccaaaacaaaaatcttagcacccgcgtatttcattctgggaggtaaccaaagtggagaggggtgcgtaatcaccagggaccgtaaggaatcacttgacgtgtacgaacttgacgctaaacaaggccgttggtacgtggtgcaaaccaattacgacagatggaagcacccattcttcctggatgaccgacgtacacctgccaagatgtgtcttaacagaacatcacaggagaatatttcctttgagactatgtacgacgttctgtccacgaaaccggtactgaataagctgacggtctataccacgctaattgatgtgaccaaaggacaattcgaaacctatctgcgcgactgcccggacccatgtatcggttggtag

SEQ ID NO: 3937 - DNA, 405 bp, Artificial Sequence
  Description of Artificial Sequence: Synthetic coding sequence
atggacccccagaccgcccccagccgggccctgctgctgctgctgttcttgcacctggccttcttgggggggcgctctcacccccttggttcaccaggctcagccagcgatctcgagactagtggcttgcaagagcagcgtaaccatctgcagggcaagctgtccgaacttcaggtagagcagacgtcgttggaacctctgcaggaatcacctcgccccacaggcgtttggaagtccagagaggtcgctacggaaggaatcagggggcacaggaagatggtcctttacactttgagagctcctagatcccccaaaatggtgcagggaagcggttgttttggaagaaagatggatagaattagtagctcaagcggcctgggatgtaaggttctgagacggcattag

SEQ ID NO: 3938 - DNA, 726 bp, Artificial Sequence
  Description of Artificial Sequence: Synthetic coding sequence
atgagcatgctgttctacaccctgatcaccgccttcctgatcggcattcaagccgagccccattctgagtccaacgtgccagcaggccacactattccacaggcccattggaccaagctacaacattctctagatactgctttgcgtcgggcccgctcagcacctgcagccgcaatagcagcccgcgtcgccggacagacccgcaacataaccgttgatccaagactgttcaagaagagacgcctgagatctccacgggtcctgttctccacacagccaccgcgcgaggcggccgatacacaggacttggattttgaggtcgggggcgccgctccattcaatagaacccatagatccaagcggagtagttcacaccctatcttccacaggggtgagttctctgtgtgcgacagtgtctctgtgtgggtgggtgataaaaccacggctacagatataaaggggaaagaggttatggttctgggggaggtgaatatcaataactccgtgttcaagcagtattttttcgagactaaatgccgcgatccgaatcccgtcgattccggctgtcggggtatcgattcgaaacactggaactcatactgcactaccacacatactttcgtcaaagcgctgactatggatggcaagcaggcggcgtggaggtttatccgcatcgatactgcatgcgtatgtgtgctttcgagaaaggccgtcaggcgtgcctag

SEQ ID NO: 3939 - DNA, 1923 bp, Artificial Sequence
  Description of Artificial Sequence: Synthetic coding sequence
atgagcgagcggaaggagggccggggcaagggcaagggcaagaagaaagaacgtggctccggtaaaaaacccgaatctgccgccgggtcacaaagtcctgccctcccccctcggctgaaagagatgaaatctcaggaatcagctgccggaagcaaattggtcctccgttgcgaaacaagtagtgagtactccagcttaaggttcaaatggttcaagaacggaaacgaactgaatcgtaagaataaacctcagaacattaaaatccagaagaaaccaggtaaaagcgagctgaggatcaataaggcctctttagcggacagtggcgaatacatgtgtaaagttatttccaaactcgggaacgattcagcttctgccaacatcactattgtggaatccaacgagattattacggggatgcctgccagtacggaaggcgcgtacgtctcgtccgaatcacccattcgtatttccgtcagcacagaaggagccaatacttcctcttcaacatccacatcaacgaccggaaccagccatctggtgaaatgcgccgagaaagaaaaaaccttttgcgtgaacggtggggagtgcttcatggttaaggatctaagcaatcctagtaggtatctttgtaaatgccagcctgggtttaccggtgcccgatgtacggaaaacgttcctatgaaagtgcagaatcaggaaaaagcagaagagctctaccagaagcgagtactgacaatcactggcatttgcattgccttgttagtggtaggcatcatgtgcgtggtagcgtattgtaagacaaagaagcagcggaaaaaactccacgaccggttacgtcagtcactgcggtcagaaagaaacaacatgatgaacatcgcaaacggaccccaccaccctaatccgcctcctgagaacgtgcagctcgtcaaccaatacgtctcaaagaacgtcatttcttcagaacatattgtggagcgcgaagccgagacatctttttctacaagccactacacttcgactgcccatcattccaccactgtcacccagaccccaagtcacagctggtccaatgggcacaccgagtcaattctgagtgagagtcacagcgttatcgtcatgagttcagtcgaaaactctcgacactcttctcccactggcggcccacgcggaagacttaacggaactggaggcccacgagagtgtaatagttttctacgccacgctagagagacacccgattcctatagggacagccctcactctgaacggtatgtgtcagccatgactacgcccgcacgaatgtctcccgtggacttccacaccccttcttctcccaagtcccccccatcggagatgtcacccccagtgagttccatgactgtgtcaatgccttccatggcggtgtccccgttcatggaggaggagcggccactgcttctggtgacccctcctcggttgagagagaagaaattcgatcatcacccacagcagttcagctcattccaccacaatccggctcatgactcaaacagcctgcccgcatctcccctaaggattgtggaagacgaagaatatgaaacaactcaagaatatgagccagcacaggaacccgtaaaaaaactcgccaacagcagaagagccaagcgaaccaagccaaatgggcacattgccaatagattggaagtggatagcaacacttcgtcacagagctcaaactccgagagtgaaaccgaggacgaacgtgtgggagaagacacacccttcctcggcatccagaatcctttggcggccagcctcgaggctacccccgctttccgtctggccgacagccgaaccaatccggcagggagattcagcacacaagaggaaattcaggctcggttgtccagtgtcatcgccaaccaggatccaatagccgtgtag

SEQ ID NO: 3940 - DNA, 1914 bp, Artificial Sequence
  Description of Artificial Sequence: Synthetic coding sequence
atgagcgagcggaaggagggccggggcaagggcaagggcaagaagaaagaaaggggctctggaaagaaacccgaatccgccgcgggttcccaatcgccagctctgcctcccaggttgaaggaaatgaaaagccaggagtccgccgctggttctaagttggtgctaaggtgcgaaacctccagcgagtactcaagtctgaggttcaagtggtttaaaaatggaaacgagttaaataggaaaaataagccacaaaacatcaaaattcagaagaagcccggaaaatcagaactccgaattaataaagccagcctggccgacagcggagagtatatgtgcaaagtaatcagcaaactgggtaacgacagtgcctcggctaatatcactattgtggagagcaatgagattatcacgggtatgccagcgagcacagaaggcgcttacgtgtcttccgagagtcctatcagaattagcgtgagtacagagggggccaacaccagttcaagtacatccacatctaccaccggtacatcacacctcgtcaagtgcgcagagaaggagaagacgttctgtgtcaacgggggagagtgctttatggtcaaagacctctccaacccctcacggtacttgtgtaagtgtcctaacgaattcaccggcgacaggtgccagaattacgtgatggcctctttttataaagctgaggagctgtaccaaaaacgcgtgctcactataaccggaatttgcatcgctcttctggtcgtaggcataatgtgtgtcgtcgcctattgcaagactaagaagcagcggaaaaaactgcacgaccggctgaggcagagcctgagatctgagcgcaataacatgatgaatattgctaacgggccccaccatcctaatccacctccagagaatgtacaacttgtgaaccagtacgtgtctaagaacgttatatcttcagagcacatagtagagagggaagcagaaacatcttttagtacgtcacactatacctctaccgcccatcattccaccacagtcacccagaccccttctcacagttggagtaatgggcataccgaatcgatcctgagcgagagccattcagtgatagtgatgtcaagtgtggaaaactcccgccacagctcccctactggaggcccgaggggtcggctgaatggaacaggcggcccacgcgagtgtaatagctttctgagacacgcccgcgaaacaccagacagctaccgcgactctcctcattctgagcgctacgtgagtgctatgaccacacctgccaggatgagtccggttgactttcatacccccagcagccccaagtcacccccttcagagatgagcccacctgtgagtagtatgaccgtcagcatgccttcaatggccgttagtcctttcatggaggaagagaggccattgctgcttgtgacgcctccacggctgcgggaaaaaaagtttgaccatcatccccagcagttctctagctttcatcacaatcctgcccatgactccaattcgcttcctgcctctccattaagaattgtagaggatgaggagtacgagaccactcaagagtacgagccagcccaggagccagtgaaaaagctggccaactctaggcgggccaaacgtacaaaaccaaatggccatatcgccaatcggctcgaggtggacagcaacacaagttcccagtcctcgaacagcgaatcagaaacagaggacgaaagagtgggcgaagataccccattcctggggatccaaaatcccttagccgcctcgttggaggccacaccggcttttcgcctcgccgattcacggactaatccagcaggacgattttcgactcaagaggagatacaggcccggctatcttctgtgatagcaaatcaggatcccatcgcggtctag

SEQ ID NO: 3941 - DNA, 1836 bp, Artificial Sequence
  Description of Artificial Sequence: Synthetic coding sequence
atgagcgagcggaaggagggccggggcaagggcaagggcaagaagaaggagaggggctcagggaaaaagcctgagagcgctgctgggtcacagtctcccgccctgcccccacgcttgaaagagatgaagtcccaggaaagcgcagcaggttccaaactggtgctccggtgcgagactagctcagaatacagctctctccgattcaagtggtttaaaaacggaaatgagctgaaccgaaagaataaaccccagaacataaaaattcaaaaaaagcccgggaagtctgagttacgtattaataaggcctccctagcagactccggagagtatatgtgcaaggttatcagtaagctcgggaacgacagcgcctcagctaacatcacaattgttgaatccaacgcgaccagcacgagtactacaggcacttcgcaccttgtcaaatgtgccgagaaagagaaaaccttctgtgtgaacggaggcgaatgctttatggtgaaagacctgtcaaacccctccaggtacttgtgtaagtgcccgaatgagtttacaggtgatcgatgtcaaaactatgtcatggcctcattttacaaacatctggggatcgagttcatggaggctgaggagctgtatcaaaaacgggtactgacgattaccggtatatgtattgcactccttgtggttggcattatgtgcgtggttgcctattgcaagaccaagaagcagcgcaagaaattgcatgatcgtctgagacaaagcctcagatcggagcgaaacaatatgatgaacatagccaatggtccgcaccaccccaaccccccacccgaaaacgttcagttggtaaatcagtatgtcagtaagaatgtgatcagcagtgagcacattgtggagcgcgaagctgagacgtctttctccacgtcccattatactagcactgcccaccacagtaccacggtgactcagacgcccagccattcctggagcaacgggcacaccgagtccattctctctgaaagtcatagcgttatcgtgatgtcctccgtcgaaaacagtcgccattcctcccccaccggcggtcctcgcgggcgtctcaacggtaccgggggacctcgcgaatgtaacagcttcctgagacatgctcgggagactcccgattcgtatagagatagcccccattcagaaagatacgtctctgccatgaccacccctgctagaatgtcaccggttgacttccatacgccctcaagccccaaatcccccccttcagagatgtccccacccgttagcagtatgacagtgagcatgccttctatggcggtcagccctttcatggaagaagaacggcccttgctcctggtgaccccacctaggctgcgcgaaaagaagtttgatcaccacccccaacagttcagcagtttccatcataatccagcccacgactccaactccttgccggcttcacccttaaggattgtggaggatgaagagtatgaaaccacccaggaatatgagccagctcaggagccggtgaagaagctagctaattccagacgagctaagcgtacaaaacccaacggccacattgccaaccggctggaggttgattccaatacatcttctcagtcttctaattctgagtcagagaccgaagatgagcgcgtcggcgaggacactccattccttgggatccaaaaccctctcgccgcgtctttggaggccactccggcctttagactggcagatagccgcaccaaccccgcaggcagattcagcactcaagaggaaattcaggccagactgtcttccgtgattgccaaccaggaccctatcgctgtatag

SEQ ID NO: 3942 - DNA, 1947 bp, Artificial Sequence
  Description of Artificial Sequence: Synthetic coding sequence
atgagcgagcggaaggagggccggggcaagggcaagggcaagaagaaggagcgaggcagtgggaagaagccagaaagcgccgcaggatctcagtcaccggctctgccaccaagactgaaggagatgaaatcgcaggaatcagcagccgggtccaagcttgtcctgagatgcgaaacgtcgtctgaatattccagcctgagatttaaatggtttaaaaacggtaacgagctgaatcggaagaacaaaccccaaaatataaagattcagaagaagcctgggaagtcggagctgaggattaataaggcatccttggctgactcgggggaatatatgtgcaaggtgattagtaagttgggcaacgacagcgcctctgccaatatcactatcgtggagagcaatgaaattatcaccggtatgcccgctagcaccgagggcgcgtatgtgagcagtgaatcaccgatcaggatcagcgtgtctactgagggggctaacacctctagcagcactagcacttccactactggaacatcacatctggtcaaatgtgcagaaaaggagaagaccttctgcgttaatggaggtgagtgctttatggtgaaagacctgtccaatccctcacggtatctatgtaaatgccaacctggatttacaggtgccagatgcactgaaaatgtgcctatgaaggtgcaaaatcaggaaaagcactctggcgaacctttccccgaagccgaggaactgtaccaaaagagagtgctgacaatcacaggcatctgcatcgcactccttgtcgttgggataatgtgtgtcgtagcctattgcaagaccaagaagcagagaaagaaattgcatgaccggctccgacagtccctacgctcagagcggaacaatatgatgaacatagctaacggcccccaccacccaaaccctccaccagaaaacgtgcagttggtgaatcagtacgtctcaaaaaacgttatcagctccgaacacattgtcgaaagagaagccgagactagcttttcaaccagccactacacctcaacagctcatcactccactacggtaactcagactccatctcattcttggtccaacggccacactgaatcaatattgtccgaatcacactccgtcatagtgatgagcagcgtggagaatagtcgacattcaagccccaccggcggcccccggggccgactcaatggaactggcggccccagggagtgtaattctttcctgaggcacgctcgcgagacgcctgactcttacagagattccccccatagcgaacgttatgtgtctgctatgacgacccctgcacgcatgtcccctgtggacttccacacaccttcaagcccaaagagtccgccgtcggagatgagcccccccgtcagctctatgaccgtgtctatgccaagtatggctgtctcgccctttatggaagaggagcgtccactgcttctggtcactcccccacgccttagagaaaagaagtttgaccatcacccccagcaatttagcagctttcaccacaacccggcgcatgacagcaacagcttgccggccagcccactgcgaattgtcgaggatgaggaatatgagaccacgcaggaatacgagccagctcaggagcccgtcaaaaaactggccaactcccggagagccaaaagaactaaacccaacggacacatcgctaatcgccttgaagtggatagtaataccagtagccaatcttccaactctgaaagcgaaactgaagatgaaagggtgggggaagataccccatttctgggcatacagaaccctctggctgcgtctctggaagcaaccccagccttccggctcgctgacagccgcaccaatcctgccggccgctttagtacacaggaggagatacaggcacggctcagcagcgtgattgcaaaccaggatcccatagccgtgtag

SEQ ID NO: 3943 - DNA, 744 bp, Artificial Sequence
  Description of Artificial Sequence: Synthetic coding sequence
atgagcgagcggaaggagggccggggcaagggcaagggcaagaagaaggaaaggggcagcgggaaaaagcccgaatctgctgccgggagccagagtcccgcactgccaccaaggctgaaggagatgaaaagccaggagagtgcagccgggtcgaagcttgtgttaaggtgcgagacatcctcagagtattccagcttgagatttaagtggttcaagaatgggaatgaactaaaccgtaagaataagcctcagaatatcaaaatccagaaaaaaccagggaaaagcgaacttcggatcaataaagcctctctggctgactccggagagtatatgtgtaaggtcatctcaaagctgggaaatgactctgcctcggccaacatcacaattgtggaatccaatgaaataattaccggaatgccagcatctacggagggcgcttatgtcagcagcgaatcccccattcgaatctccgtgagtaccgagggggctaacacctcgagttccacctctacgagcaccacaggcaccagccatctggtgaaatgtgcagagaaagagaaaacgttctgcgtgaacggaggggagtgtttcatggtgaaagacctgtcaaacccttcaaggtacctatgtaaatgtcagccgggatttacaggcgctaggtgcacagaaaatgtcccgatgaaagtacaaaaccaggaaagtgcccaaatgagcctgctggtgatagctgcaaagaccacatag

SEQ ID NO: 3944 - DNA, 1938 bp, Artificial Sequence
  Description of Artificial Sequence: Synthetic coding sequence
atgagcgagcggaaggagggccggggcaagggcaagggcaagaagaaagaaagggggagcgggaagaagccggagtccgctgctgggtctcagagcccagcgttgcctcccagactgaaagaaatgaagtcccaggagtccgctgctggttctaagttggtgctcagatgcgaaacatcttccgaatacagcagcttgcggtttaagtggtttaaaaatgggaacgaactgaaccgtaaaaacaaaccccaaaatatcaagatccaaaaaaagcccggtaagagcgaattacgcatcaacaaggcatctctagccgatagcggggagtatatgtgcaaggtaatctcaaaactgggaaacgattccgctagcgccaacattaccattgtcgagtccaacgaaattatcacaggcatgcccgcgtcaacagaaggggcttacgtgtcaagcgagagcccgataaggattagtgtgagtactgagggggctaatacatcctcatccacttcgacctcaactaccgggacctcccacctagtcaagtgtgccgaaaaagaaaagacattctgcgtaaacggcggagaatgtttcatggtgaaagacctgagcaaccctagtcgctacttatgcaaatgcccaaatgagtttaccggagatcgctgtcagaattatgttatggcctctttttataagcacttggggatcgaattcatggaagctgaagagctatatcaaaagcgagtactgacaatcactggcatctgcatcgcactgctggtcgtcggaatcatgtgcgtcgtggcttactgtaagaccaaaaaacagaggaagaaacttcatgacagactccgacagtcattgagaagcgagcgcaacaacatgatgaacatagcaaacggcccacaccacccgaaccctccacctgaaaatgtgcagctggtcaaccagtatgtgagcaaaaacgtcatatcatccgaacatattgtcgagcgcgaggctgagacctccttttcaacatctcactatacatccacggctcaccacagtactactgtgacccaaacccccagccactcttggagtaatgggcacaccgagtctatcctgagcgaatcccattctgtaatagtaatgtcctctgtggagaacagcagacatagctcacccacgggcggccctcgtggcagactcaacggaactggcggccctagagagtgcaacagctttctgcgccatgctcgcgaaactccagacagctacagggactccccacacagtgagaggtacgtctccgccatgaccacccccgctcgaatgtcccctgtagactttcatactcccagctccccgaagagtcctccaagcgagatgtccccaccagtatcatctatgactgtgagcatgccctcaatggccgtctcccccttcatggaagaggagaggccgttgctgctggtaaccccccctaggctcagggagaagaagttcgatcatcatcctcagcagttttcaagttttcatcacaaccccgcccacgactccaattccttgccggcctcccctctgcgaatcgtcgaagacgaagagtatgagaccacccaggagtatgagccagcacaggaacctgttaagaagttggccaattcccgacgggctaagcggaccaagcctaacggtcatattgcaaaccgcctagaggttgacagcaacacatccagccagtcttccaatagtgagagcgagacagaagacgaaagagttggcgaggatacgcccttcctcgggatacagaaccctcttgccgcctctctcgaggccacccctgccttcaggctcgccgactcacggactaatcctgctggtcgcttctctacacaggaggaaatccaggccaggttgtcttcggttattgccaaccaggaccccattgctgtttag

SEQ ID NO: 3945 - DNA, 1923 bp, Artificial Sequence
  Description of Artificial Sequence: Synthetic coding sequence
atgagcgagcggaaggagggccggggcaagggcaagggcaagaagaaggaacgaggaagcgggaagaaacccgagtctgcggctggatctcagagtccagcactaccccccagactgaaagagatgaaaagtcaggaatccgcagccggaagtaaacttgttctgaggtgtgagacctcatcagaatacagtagcttgagatttaagtggtttaagaacggaaatgaactgaatcgaaaaaacaagccacagaacatcaagatccagaaaaaaccaggaaagtccgaactgcggattaacaaagcaagcctcgcggatagtggagagtatatgtgcaaggtaatctcaaagctgggcaacgatagcgcatctgcgaacatcaccatcgtcgagtcgaacgagatcatcactggcatgcccgcctcaaccgagggcgcgtatgtttcttccgagagcccaatccgcattagcgttagcaccgagggggccaatacatcctcttcaacaagtacctcaaccaccggtacctctcacctagtcaagtgtgccgagaaagagaaaactttctgtgtgaacggaggcgaatgctttatggttaaggatctgtccaacccctctagatatttgtgtaagtgccagcccgggtttacaggtgctcggtgcacggagaacgtgcctatgaaggtccaaaatcaagagaaggcagaagagctgtaccagaaaagagtcctaacaatcacagggatttgtattgcactgttggtcgtgggcataatgtgtgtggttgcctattgtaagaccaagaagcagcggaagaagctgcatgatcggctcagacaaagtcttagaagtgagcggaataacatgatgaacatcgccaacggtccgcaccatcccaacccaccccctgagaatgtgcagctggtgaatcagtacgtttcaaagaacgtaatctcttcagagcatattgtcgagcgggaggctgagacgagtttcagcacctctcactatactagcacagcacaccattcaacaacagtgacccaaactcccagccattcatggagtaatgggcatactgaaagcattctctccgagagccactcagttatagtgatgagttctgtggagaacagccggcatagcagcccaaccggcggtccacgcgggcgcctcaacgggaccggagggccgcgggaatgcaatagctttctgagacacgcacgcgaaacccccgacagctacagagattcgccacactcagagcgatatgtttccgccatgaccacccctgctagaatgtctcccgtagattttcacacccccagctcaccaaagtcccccccctctgaaatgtcccccccagtgtcatctatgaccgtcagtatgcccagcatggctgtgagcccttttatggaggaagaaagacccctccttctcgttacaccccctcggctgcgcgaaaaaaaattcgatcatcatccacagcaattctctagtttccaccataacccggctcatgactcaaactccttgccagcctcaccccttagaatcgtagaggatgaggagtacgagaccacgcaggagtatgagcccgcacaggagccagtgaaaaagctggctaacagtcggcgggccaaacggaccaagccaaatgggcatattgctaatcgcctggaagtggactccaacacctccagtcagtccagtaattccgagtccgagaccgaagacgagagggtcggcgaagataccccttttctcggaatccagaatcccttggcagcctccctggaagccacccctgcattccggctggctgacagccggactaatcccgcaggtcgtttcagtactcaggaagaaattcaagctcgactttccagtgtgatcgctaatcaggatcccatagctgtgtag

SEQ ID NO: 3946 - DNA, 1773 bp, Artificial Sequence
  Description of Artificial Sequence: Synthetic coding sequence
atgggcaagggccgggccggccgggtgggcaccaccgccctgcccccccggttgaaggagatgaagagccaggaatccgccgctggctcgaagctcgtgcttcggtgcgagactagcagtgaatatagcagccttaggttcaaatggtttaagaacgggaacgagctgaataggaaaaataaaccacagaacataaagatacagaaaaaaccggggaagtccgagctgcggataaataaagcctccctcgccgacagcggtgaatatatgtgcaaggtgatctccaagctcgggaatgactccgcatccgcgaatattacaatcgttgagtcaaatgctacgagcaccagcacaaccggtactagtcatctggtaaagtgtgcagaaaaggagaaaacgttctgtgtcaacgggggtgagtgttttatggtgaaggacctctcaaatccaagccgttatttgtgtaagtgcccgaacgaattcacaggcgaccgctgtcagaactatgttatggcttcattctataaacatctaggaatcgagtttatggaggccgaagaactgtatcagaagcgggtgctgacaatcactggaatttgcatcgctttgttggtggttggaatcatgtgtgtggttgcctactgcaagacgaagaagcaaagaaaaaaactacacgatcggctccgacaatcccttcgctccgagcggaataacatgatgaatatcgctaacggtccccatcaccccaatcctccgccagagaatgtccagctcgtgaatcagtatgtgagcaagaatgtgatatcttctgaacacatcgttgaaagggaagctgaaacttccttctctaccagtcactatacgagtacagcgcaccattcaacaactgtgacacagaccccttcccactcttggagcaatggccacaccgaatcgatattgagtgaatcacacagcgtgattgtaatgagtagcgtggaaaattcgcgtcatagctctcctacagggggaccaagaggcaggcttaacggcactggcggcccccgcgagtgcaactctttcttgcgacatgcgcgagaaacgcctgattcttatagggacagcccccatagtgagcggtacgtcagtgctatgaccacacctgctagaatgtctccagtggactttcacacaccgtcgagtccaaaaagtccgccctcagagatgtcccctcctgtttccagtatgactgtgagtatgcctagcatggccgtatctccattcatggaagaggaaaggccattgctattagtgacacccccccggctccgggagaagaaatttgatcaccatccccagcaattctccagcttccatcataaccccgcgcatgacagcaattctcttccagcctcccctctgcgcatagtggaagatgaagaatatgagacaacgcaagagtatgagcccgcacaggaaccagtgaaaaaactcgcaaacagcagacgtgcgaagagaacgaaacctaacgggcatatcgcaaacagattggaggtcgacagtaacacaagtagccagagcagcaacagcgagagcgagaccgaggacgagagggtcggcgaggacacaccattcttggggattcagaaccccttggcggcctccctggaggccacccccgccttccgcctggctgacagccgaacaaacccagccggtagattcagcactcaggaggagatccaggcacgtctaagctccgtaattgcaaaccaggatccgatcgctgtctag

SEQ ID NO: 3947 - DNA, 1269 bp, Artificial Sequence
  Description of Artificial Sequence: Synthetic coding sequence
atgcggtggcggcgggccccccggcggagcggccggcccggcccccgcgcacagcgacccgggagcgcagccaggtcttctccacccctgccattacttccccttctcctcctccttggaactgcggccctggcccccggagccgcagccggaaatgaggccgccccggccggggcgagcgtttgttattcttcacccccatcagttggtagcgtgcaggagctggctcagcgggctgctgtggtcatcgagggtaaggtccacccgcagcgcaggcaacagggagcccttgacaggaaagccgccgccgccgccggcgaggcgggcgcttgggggggcgacagagaacctccggctgcaggtcctagagctttggggcctccagcagaagaacctctgctggccgcaaacggaacagtgcctagctggcccaccgctccagtcccaagcgccggagagcccggtgaggaagccccctatctagtgaaagttcatcaagtgtgggccgtcaaagcgggcggcctgaaaaaagacagtttacttaccgtacggcttggaacatggggacaccctgcattccctagctgtggccgcctgaaggaggactcacggtacattttcttcatggagcccgacgccaactctacgagcagggctccagccgccttcagggcttctttccccccgctggagacagggcgcaacttaaagaaagaggtgagtcgggttctctgcaagagatgtgcgcttccacccaggctgaaggagatgaagtcacaggaatccgccgcaggctccaagctcgtcctgcgttgtgaaaccagctcagaatatagtagcctgcgctttaagtggttcaagaatggaaacgaactgaacagaaagaataaaccacagaacattaagattcagaaaaaaccaggaaagtccgagttgaggataaataaagctagtctggccgactccggagagtatatgtgtaaagtgattagcaaattaggaaatgattctgcctctgcaaatatcaccatcgtggaatcaaacgctacatcgacaagcaccacaggaaccagccacctggtgaagtgcgccgagaaggagaaaactttttgcgttaatggcggggagtgctttatggtcaaggatttgtcaaatcccagtcgttacctgtgtaagtgccctaatgagtttactggagaccgatgtcaaaactatgtgatggcatcattttattccacatcaactcccttccttagtctgcccgaatag

SEQ ID NO: 3948 - DNA, 891 bp, Artificial Sequence
  Description of Artificial Sequence: Synthetic coding sequence
atggagatctacagccccgacatgagcgaggtggccgccgagcggtcttcaagcccaagtacacagctgtctgcggacccgtcactggacggtctgccagccgccgaggacatgcctgaaccccagacagaggacggacgaacaccagggttggtcgggcttgcggtgccttgctgtgcctgcctggaagcggaaaggctgcgcggctgcctcaatagtgagaaaatatgcatcgtgccaatcctggcttgccttgtgtctttatgtctgtgtatcgctggactgaagtgggtgtttgtggacaagatctttgagtatgacagccctacgcatctcgaccctggcggattgggtcaggatccgatcatcagcctggacgctacggcggcgtcagccgtctgggtctcaagtgaagcttatacttcacctgtttcaagggctcagtcagagtctgaggtacaggtcacagtgcagggggacaaggctgtggtgtcattcgaaccttcagctgcccccactcctaagaatcgcatctttgcgttttccttcctgccctctaccgcaccctcatttccatccccgactagaaacccagaggtgcgcacccctaaatctgcgacccagcctcagactacggaaaccaacctccaaaccgcccctaagctgtccacaagcacaagtactaccggcacttcccacctggtaaagtgcgcggagaaagagaagaccttctgtgtgaacggaggagaatgtttcatggtgaaggaccttagtaatccttcacgatatttgtgcaaatgtcctaatgagttcaccggggatcgttgtcaaaattatgtgatggcatcattttattcgaccagtactcccttcctctctttgccagaatag

SEQ ID NO: 3949 - DNA, 1389 bp, Artificial Sequence
  Description of Artificial Sequence: Synthetic coding sequence
atgagcgagcggaaggagggccggggcaagggcaagggcaagaagaaggagaggggttccggcaagaaacccgaatctgccgccggctcccagagtcctgcgctaccacctaggctgaaggaaatgaaaagtcaagagagtgcagctggcagcaaactagtattacgatgcgaaacctccagcgaatacagcagtttacggttcaagtggtttaaaaacgggaacgagttgaatcggaagaataagcctcagaatattaagatccagaaaaagccaggaaagagcgagcttagaatcaacaaggcatctctcgctgatagcggagaatatatgtgcaaggtgatctctaagcttggcaacgacagtgcttcggcgaacatcactattgtggagtcaaatgaaattatcacggggatgcctgctagcaccgagggggcttacgttagcagcgagagcccgatccggatctctgtgtccacagaaggcgcgaatacttcttcctccacctctacttccacgacaggcacctcccatcttgtgaagtgcgctgagaaggaaaagacgttctgcgtgaacggaggggaatgcttcatggtgaaagatctgagcaatccgagtagatacctgtgtaaatgccagcctgggttcacaggagcccgatgcaccgagaatgtgcccatgaaagtgcaaaatcaggagaaagcggaggagttataccagaagagggtcctaacaataaccggaatctgtattgccctactggtcgtgggtatcatgtgcgtggttgcatactgtaaaacaaaaaaacagcggaagaaactccatgatcgactgcgccagagcctgcggtccgaaaggaataacatgatgaacatagctaatgggccccatcatccaaaccctcctccagaaaatgtgcagttggtaaatcagtatgtgagtaaaaatgttatcagttccgagcatatagtggaacgcgaggcggagacttccttctccacctctcactacacctcgaccgcacatcattcaactaccgttacacaaactccatctcacagttggagcaatgggcacaccgaatccatcttgtccgagagccacagcgtgattgtaatgtcttccgtcgagaactcccggcatagcagtcctactggaggacccaggggaaggttaaacggcaccggaggaccaagagagtgcaactcctttctgcggcatgctagagagactccagactcctacagagactctccccattccgaaagacataaccttatagccgaactcagacgcaacaaggcccaccgctctaagtgcatgcaaattcaactgtcggcaactcatctgcggtcttcttccatcccacatctcggctttattctttag

SEQ ID NO: 3950 - DNA, 1452 bp, Artificial Sequence
  Description of Artificial Sequence: Synthetic coding sequence
atgcagatccccaagcacatcagcatcgaggacatcaccgccacctcaacatcaacgaccggcacctcacacctggttaaatgtgccgaaaaggaaaaaacattttgcgttaatgggggcgagtgtttcatggttaaggacctcagcaatccaagtcgctacctgtgtaaatgtccaaatgagttcaccggagaccgctgccagaattatgttatggcctctttctataaagcagaagaattatatcagaaaagggtcctcaccattacgggcatttgtattgcactccttgttgtcggaatcatgtgtgtcgtcgcatattgcaaaacgaagaagcagcgcaaaaaactgcatgacagactccggcagagtctgagaagcgagaggaacaacatgatgaacattgccaacggaccacatcatcctaatccccccccagagaatgtgcagctcgttaaccaatatgtgagcaagaacgtcatctcttccgaacacattgtggagcgagaggccgaaactagctttagcacaagtcattatacctcgactgcccatcattctactaccgtgacacagactccttctcattcttggagcaacggacacacagaatccattctctcagagagccacagcgttattgttatgtcctcggtcgagaacagccgtcactcctctcctactggagggcccagaggaaggctgaatgggaccggtggcccgcgcgagtgtaatagctttcttcgccacgcacgggagactcctgatagctatagggattcccctcacagtgagcgatacgtcagcgctatgactacccccgctcggatgagcccggttgactttcatactccctcaagcccaaaatcaccccccagcgagatgagccctcctgtatcctcaatgacagtgtcaatgcctagtatggctgtgtctccgttcatggaagaagagagaccgctcttactcgtgactcctccccgtttgcgggaaaagaagtttgatcaccacccccagcagttctcttcatttcatcacaaccctgcgcacgattctaacagcctgcctgcttcacccctccgcattgtggaggacgaagagtacgaaacaacccaagagtatgagcctgcgcaggagcccgtaaagaagcttgccaattcgagaagggcaaaaaggacaaagccaaatggccacatagctaataggctggaggtggacagcaatacttcctcccagtcttccaacagtgaaagcgagaccgaggatgaacgagttggcgaggataccccgtttctgggcatccagaatcctctcgccgccagcctggaggccactcctgcatttcgtcttgcagattccaggaccaacccagccggccggttttccacacaggaggagatccaggctagattgtcatcggtgatcgcaaaccaggatccaatcgctgtttag

SEQ ID NO: 3951 - DNA, 1263 bp, Artificial Sequence
  Description of Artificial Sequence: Synthetic coding sequence
atgagcgagcggaaggagggccggggcaagggcaagggcaagaagaaggaacgcggtagtggcaagaaacctgaatctgcagctggatctcaatcccctgccctccccccgcgcctcaaagaaatgaagtctcaggagagtgcagcgggatcaaaactcgtgcttagatgtgagacatcgtctgaatattcctccttgaggttcaaatggttcaagaatggcaacgagttaaacaggaagaacaagccccagaacattaagattcagaagaagcctgggaaatccgaactaagaattaataaagcatccctggcagactccggcgaatatatgtgcaaagtgataagcaaactgggaaacgacagcgcctcagcaaacatcactatcgtcgagtccaacgaaatcataacaggaatgcccgcctcaactgaaggcgcttacgtgagcagcgaaagtccaatacgaatctctgtctcaaccgagggcgccaataccagctccagtacttctacctctaccacaggtacctcgcacctggtcaaatgtgccgaaaaagagaaaactttctgtgtgaacggaggcgagtgttttatggtcaaagatctgtcgaatccttcccgctacctgtgcaaatgtccgaatgagtttactggtgaccgctgtcaaaattacgttatggccagtttttataaagcagaagagctgtaccagaaacgcgtgctgactatcaccgggatctgcatcgcgctgttggtggtgggcataatgtgtgttgtcgcgtattgcaagactaaaaagcaacgaaaaaagcttcatgataggctgcgtcaaagtctgcggtccgagcggaataatatgatgaacatcgccaatgggccacaccacccaaatccccctccagagaatgtgcagttggttaatcagtatgtgtccaaaaatgtaatatcctctgagcatatcgttgaacgagaagccgagacatcatttagtaccagccattacaccagcactgctcatcactccactaccgtcacgcagaccccttcgcactcatggagcaatggccacacagagtccattctgtccgagtcacacagtgtgatcgtgatgtcttctgtggaaaactcacgtcattcctctccaaccggcgggccccgcggtaggctcaacggaaccggaggtccgcgggagtgcaactccttcctgcgtcatgccagagagactccagatagttaccgcgatagtccccactctgaaaggtag

SEQ ID NO: 3952 - DNA, 1065 bp, Artificial Sequence
  Description of Artificial Sequence: Synthetic coding sequence
atgctgttcaacctgcggatcctgctgaacaacgccgccttccggaacgggcacaactttatggtgagaaacttccggtgtggtcagcctcttcagaataaggtgcagcttaaggggcgcgatctccttacccttaagaatttcaccggcgaggaaataaagtatatgctatggctgagtgccgatctaaagtttcgcattaaacagaagggagagtatttacccctgctccagggcaagagccttgggatgattttcgagaagagatcaacaagaacccgtctttccaccgagacaggcttcgcacttctcgggggacatccctgcttcttgacaactcaggacatccacctgggtgtcaacgagagcctcacagacaccgccagggtcctgagttccatggccgatgccgtgttggcgcgcgtgtacaaacaatcagacctcgatacattggcgaaagaagcttctatccccatcatcaacgggctgtctgacctgtaccacccgatccaaatactcgcggactatctgacgttgcaggaacattattcctcactcaaaggcctgactcttagctggataggtgatgggaataatattctccactccatcatgatgagcgccgccaagttcggcatgcacctgcaggctgctactccgaagggttacgagcccgacgcttccgtgaccaaactggctgaacaatacgccaaagaaaatggaacaaaactgctgttgaccaacgaccccctggaagccgctcacggcgggaacgtactgatcactgatacatggatttcaatgggtcaggaagaggagaagaagaagaggctacaggctttccagggatatcaggtgacaatgaagaccgctaaagttgctgcaagcgactggactttcctccattgccttcctcgcaaaccagaagaggtggacgatgaggtattctatagtccaagatccttggtctttcctgaggccgagaaccgcaaatggactatcatggccgtgatggtgtccttactgactgactattctcctcagctccagaaaccaaaattctag

SEQ ID NO: 3953 - DNA, 348 bp, Artificial Sequence
  Description of Artificial Sequence: Synthetic coding sequence
atgatccccgccaaggacatggccaaggtgatgatcgtgatgctggcgatctgctttctaacgaagtcagatggtaagtcagttaagaagaggtctgtgtctgaaatccagctcatgcataatctggggaagcacctgaattcgatggaacgggtcgagtggctgcgcaagaagctgcaggacgttcataatttcgtggctttaggtgctccgctggcacctcgggacgccgggtcccaacggccgagaaaaaaggaagacaacgtccttgtcgaaagccacgaaaagagcttaggggaggccgataaagccgacgtgaacgtgcttaccaaggccaaatctcaatag

SEQ ID NO: 3954 - DNA, 348 bp, Artificial Sequence
  Description of Artificial Sequence: Synthetic coding sequence
atgatccccgccaaggacatggccaaggtgatgatcgtgatgctggccatctgtttcctgaccaagagtgacggcaagtcagtgaagaagcgaagcgtgtccgagattcagctcatgcacaatctgggcaagcacttgaacagcatggaaagggtcgaatggttgaggaaaaagctccaagatgtgcacaattttgtggcgctgggggctcctctcgccccccgtgacgcaggctctcagcgccctcgtaagaaagaggataacgtactcgtggaatctcacgagaagtcgctgggcgaggccgataaagcagacgtgaatgtcctgaccaaagccaagtctcaatag

SEQ ID NO: 3955 - DNA, 354 bp, Artificial Sequence
  Description of Artificial Sequence: Synthetic coding sequence
atgagcaccgccgtgctggagaaccccggcctgggccggaagctgtcggattttggccaagaaacctcgtacattgaggataactgcaatcagaacggggctatcagtttgatcttttcattgaaagaagaagttggcgctctggcgaaggttctccgcctgtttgaggaaaatgatgtgaatctgactcatattgagagcagaccaagtaggctaaagaaggacgaatacgaattcttcacccacctggataagcgcagtttgccagccttgaccaacatcattaagatattgcgacacgatattggtgctaccgtgcacgaactgtcacgcgacaaaaaaaaagacacctag

SEQ ID NO: 3956 - DNA, 411 bp, Artificial Sequence
  Description of Artificial Sequence: Synthetic coding sequence
atgagcaccgccgtgctggagaaccccggcctgggccggaagctgtctgattttggtcaagagacaagttatatcgaagataactgcaatcagaatggggccatctcccttatattttctcttaaggaggaggtcggcgccctggcaaaggtgctacggctattcgaggaaaacgatgtaaacctgactcacattgagtcaaggccatctagactaaaaaaggacgaatacgaattctttacgcacttagataaacgctctctgccggcgttaactaacatcatcaagatccttaggcacgatatcggggccacagtccacgaattgtcaagggataagaagaaggataccgtaccctggttcccccggaccattcaagagctggaccgcttcgccaatcagatcctatag

SEQ ID NO: 3957 - DNA, 1359 bp, Artificial Sequence
  Description of Artificial Sequence: Synthetic coding sequence
atgagcaccgccgtgctggagaaccccggcctgggccggaagctgagtgattttggacaggagacgtcttatattgaagacaattgtaatcagaacggagcaataagtctgatattttccctcaaggaggaggtaggtgcccttgcaaaggtacttcgattattcgaggagaacgacgtaaacttgacacatattgagagccgcccctcccgcctaaagaaggatgagtacgaatttttcactcacctggacaaacgttcactgcctgccctcacaaatattatcaagattcttcggcacgatattggagctacagtgcacgagctctcccgcgacaagaagaaggataccgtcccctggttccctcgtacaatccaggaactggacaggttcgctaatcagattctatcctatggtgccgaactggacgctgaccaccctgggttcaaagaccctgtgtatcgggccaggagaaagcagttcgctgatattgcttataactaccgccatgggcagcccattccaagagttgagtacatggaggaagagaaaaagacttggggcacggtcttcaaaacacttaagagcctgtataaaacccatgcctgttatgaatacaatcacattttccccctgctcgagaagtattgcggattccacgaggacaacatcccccaactggaggatgtgtcacagtttctccagacatgtaccggcttcaggttgagacccgtggccggactcctgtcaagccgggattttcttgggggcctggccttcagggtctttcattgtacgcaatatattaggcatggcagcaaacccatgtacacgcccgagcccgacatctgccacgagctgctaggacatgtgccccttttctcagacaggagcttcgcccaattcagccaggagattggacttgcctctctgggggcacccgacgaatatatcgagaaactggctaccatctactggtttaccgttgaattcggcctatgtaagcaaggtgactccatcaaggcatacggcgccgggctgctgagctcgttcggagagttacagtattgcttgtctgagaaacccaagctattgcccctggaacttgaaaaaaccgcaatccagaactacaccgtcactgaattccaacccctctactacgtggcagaatcttttaatgatgcaaaagaaaaagtcaggaacttcgctgccaccattccccgcccctttagcgtgagatacgacccatacacgcagcgaattgaggtcttggacaatacccaacaacttaaaatcctggcagactctatcaactctgaaattggcattctgtgttctgccctgcagaagatcaagtag

SEQ ID NO: 3958 - DNA, 3261 bp, Artificial Sequence
  Description of Artificial Sequence: Synthetic coding sequence
atggcctgcagccccgacgccgtggtgagccccagcagcgccttcttgaggagcggctccgtctatgagccactgaaatccatcaacctgcctaggccagataacgaaactttatgggacaaactcgaccactattaccggatcgtcaagtccaccttgttactgtatcagtcacccacaaccggcctctttccaacaaaaacatgtggtggggatcagaaagccaagattcaggattctttgtattgcgcggctggggcctgggccctggcactggcatatcggagaatagacgacgacaagggcaggacacacgagttagagcacagcgccatcaagtgtatgcgagggatcctgtattgctacatgcgacaggccgataaagtgcagcagttcaaacaggatccacgtcccacaacttgcctgcattccgtgttcaatgtccatactggagacgagttgctttcctacgaggagtatgggcacctgcagattaacgcagtctccctgtacctgctttatctcgtggaaatgattagctcagggctccagattatatacaacactgacgaagtgagcttcattcagaacctggtgttctgtgttgagagggtgtatcgcgtccccgatttcggtgtgtgggaaagaggctccaagtacaacaatggatccaccgagctgcactcgtcctctgtgggccttgccaaggccgccctcgaagccattaatggctttaatctctttggaaaccagggttgcagctggtctgtcatttttgtggacctcgacgctcacaaccggaacaggcagactctgtgcagtctcctgcctcgtgaatctagaagtcacaacactgatgcggccttgctcccttgcatctcctacccagctttcgctctggatgacgaagtgcttttttcacaaactttagacaaagtcgttaggaaactgaagggaaagtacggctttaagagattcttgagagacggataccggacctcattagaggaccccaacagatgttactacaagcccgctgagatcaagttattcgacggcattgagtgtgaattccccatattcttcttgtatatgatgattgacggcgttttcagaggtaacccaaagcaggtgcaggagtaccaggacttgctaacgccagttctgcaccacacgacggagggttacccggtcgtacccaaatattactacgtccctgcggattttgtagaatatgaaaaaaacaatccaggaagccagaaacgtttcccctctaactgcgggcgagacggcaagctcttcttgtggggtcaagccctttacatcattgccaagcttcttgccgacgagttgatctctcccaaggatatcgacccggtgcagcgatacgtgcctctaaaagaccagcgcaacgtttctatgaggttctccaatcagggacctctcgaaaacgacctcgttgtgcatgttgcactgattgccgaaagccaacgtcttcaagtctttctaaatacctacgggattcagacccagactccccagcaggttgaacctattcagatttggcctcagcaggaactggtgaaagcatatctgcaattgggtatcaacgagaaactagggctaagtggacgacccgaccgacccattggatgcctgggaacatccaagatctataggattctgggaaaaaccgtagtctgttatcctattatcttcgacctgtcagacttttacatgtctcaggatgtattcctgctgattgatgacatcaagaatgccctccaattcattaagcagtattggaagatgcacggccggccgctgtttctggtcttaatacgcgaagacaacatcaggggctcccgattcaatccgattctggatatgctcgcagcactcaagaaaggaatcatcggcggggtaaaagtccatgtcgatcggttacagaccctcatctctggtgccgtcgtcgaacagctggactttctacgtatttccgatacagaagagctgccagagtttaagagttttgaggagcttgagccccctaaacattctaaggttaagaggcagtcatccacgccctccgcccccgagctcggacaacagcccgatgtgaacatcagcgaatggaaggataaacccactcacgagattctccagaagcttaatgattgcagctgtcttgccagtcaagctatcctgctggggatcctgctgaagcgagagggcccaaattttatcactaaggaggggaccgtgtcagatcacatcgagagggtgtaccgtcgcgcaggttcacaaaagctgtggagcgtcgtgcgtagagcagccagcctgctgagcaaagtggtggattccctggccccctccatcactaatgtactagtacaagggaagcaggtgacactcggcgcttttggccatgaggaggaggttatctctaatcctctttctccgcgggtgatccagaatatcatatattataaatgcaatacccatgatgaacgcgaggcagtgatccagcaggaactcgtgatacacattggctggatcatcagtaataatcctgaactgttttcagggatgctgaaaattaggatcggctggataatacatgcgatggagtacgaacttcaaattaggggtggagacaagcccgctttggatttataccagctctctccttccgaagtaaaacagctgctgctggatattttacagcctcaacagaatggtcgttgttggctaaaccgacggcaaatcgacggcagcttgaataggacccccaccgggttttatgatcgggtatggcagattctggaacggacccccaacgggataattgtcgctggcaaacacctcccacagcagcccactctctcggacatgactatgtatgaaatgaatttcagcctcttagtggaggatactctggggaacattgaccaaccccagtatagacagatagtggtggagctgttgatggtggtctcgatcgtcctggaaaggaatcctgagctcgagtttcaggataaggttgacctggaccggctggtgaaagaagcctttaatgaattccagaaggaccagagtcgcctgaaggagatcgaaaaacaggatgacatgactagcttttacaacactcccccgctgggaaagcgtggcacctgcagctatttgacaaaagctgtcatgaacttgctgcttgagggcgaggttaaaccaaacaacgatgatccctgtttgatcagctag

SEQ ID NO: 3959 - DNA, 1221 bp, Artificial Sequence
  Description of Artificial Sequence: Synthetic coding sequence
atgaccctggacgtgggccccgaggacgagctgcccgactgggccgctgctaaggaattctatcaaaagtatgaccccaaggacgtcattggaaggggggtgagctccgtcgtacgtcgttgtgtacacagagctacagggcatgaattcgcggtcaagatcatggaggttaccgctgaacgactgtcccctgagcaactggaggaggtccgcgaggcaacccgccgtgaaacccatattctccgtcaagtcgccggacacccacatatcatcactctcatcgatagttacgagagtagttccttcatgttcttagtctttgacctcatgaggaagggggagctgtttgattacttgaccgagaaagttgcactttccgaaaaagagactcggtctattatgaggtcgcttctggaggccgtcagttttctgcacgcaaataacattgttcacagggacctgaaacccgagaacatactgctggacgacaatatgcagattagattatctgattttggattttcttgtcacttggagcccggcgagaaattgagggagctgtgcggaacgcctggctatctcgcccccgagatcctcaaatgttcaatggatgagacacatcccggatacggcaaggaagttgatttgtgggcatgtggcgttattctcttcacgcttctagccggtagcccacctttttggcatagaagacagattctgatgctgcgaatgattatggagggacagtaccaattctccagtcccgagtgggatgacagaagctctacagttaaggacctgatctcacggctgcttcaggtggacccggaggcgcggctgactgccgaacaggctctgcagcacccattctttgagaggtgcgaaggctcccagccatggaatctgactccaaggcagcgctttcgcgtcgccgtatggaccgtgttagccgccgggcgagtggcactgagtacccacagggtgcgtccgctgaccaaaaacgctctcttgagggacccctatgcactgaggtccgtacgtcatctcattgataattgtgcgtttcgactctatgggcactgggtgaaaaaaggggaacagcagaacagagctgctctgtttcagcacaggccgcctggacctttcccaattatgggccccgaggaggaaggtgacagtgccgctatcactgaagacgaggccgttctggtcttaggatag

SEQ ID NO: 3960 - DNA, 3708 bp, Artificial Sequence
  Description of Artificial Sequence: Synthetic coding sequence
atgcggagccggagcaacagcggcgtgcggctggacggctacgcccggctggtgcagcaaactatcctctgttatcaaaaccccgtgactgggcttctttctgcgagccacgagcagaaggacgcatgggttagggacaatatctatagcatcctcgctgtgtggggtcttggcatggcgtataggaagaatgcagatcgagacgaagacaaggcaaaggcttacgaactggaacagaacgtggtgaagcttatgaggggcttgttgcaatgtatgatgcgtcaggtggctaaagttgagaagttcaaacatacccagtcaacaaaggactcactgcacgccaagtacaatacagctacctgtgggaccgttgtgggcgacgaccagtggggtcatctgcaggtggacgctacctcactctttctgttattcctggctcagatgacggcttctggcttgagaattatttttaccctggacgaagtggcttttattcagaatcttgtcttttacatcgaagccgcatacaaagtggcagactatggaatgtgggaacggggcgataaaacaaatcagggcatccccgaattaaatgctagctccgtaggcatggctaaagccgctttggaagccattgacgaacttgatttgtttggagcacacggcggaagaaagtcagtgatccatgtcctgcccgacgaggtggagcactgtcagtctatcttgtttagcatgctgcctcgtgcctctacctcaaaagagattgacgctggtttgctctctatcattagcttccctgcttttgcagtcgaggatgtaaatctggtcaacgtgacaaagaatgagattatatctaagctacaggggagatacgggtgttgcagattcttgagagacggatacaaaactcctcgggaagaccccaaccgactgcattatgaccctgctgaacttaagcttttcgagaatattgaatgcgaatggcctgtcttttggacatattttatcatcgacggagttttctccggggacgctgtccaggtgcaggaatatcgcgaggccctggaaggtatcctgattagaggcaagaacggcattcggctcgtccccgaactgtacgctgttccacctaataaagtcgacgaagaatataaaaaccctcatactgtcgaccgtgtgcctatgggaaaggtgccccacctttgggggcagtcgctttatatcctgagtagcctgctagctgaaggcttcttagccgctggcgagatagacccactgaacagaagatttagcactagtgttaaacccgacgtggtcgtgcaggtaactgtcctagctgagaataatcacatcaaagacctacttcggaagcacggtgtgaacgttcagtcgattgccgacatacaccccattcaggtgcaacctggaagaatactgtctcacatttacgctaagttgggcaggaacaaaaatatgaacctaagtggcaggccttataggcacatcggggtcttaggtacaagcaagctgtacgtaatccggaatcaaatctttaccttcacaccacagttcactgaccaacatcatttctatcttgcactggataacgaaatgatcgtggaaatgcttaggatagaactggcctacctgtgcacctgctggcggatgactgggaggccaacccttacctttccaatatcgaggactatgctaactaatgatggatcagacatacactctgctgttctttcaaccatcagaaaactggaagacggctatttcgggggtgctcgggttaaattaggcaatctgagtgaattcctgactacttctttttatacgtacctgacctttctcgacccagattgcgacgaaaagttgttcgacaacgcaagcgagggcaccttttctccagattctgattccgatctggtgggctatcttgaagacacctgtaaccaggaatctcaggatgagttagatcattatattaaccatctactacagagcacaagcctgagatcatatctgccaccactatgtaaaaacacagaagaccgccacgtttttagcgccatccactctacaagagatattctctcagtcatggccaaggccaaggggctggaagtcccctttgtgccaatgacacttcctacgaaagtactgtctgctcaccgcaagagtctgaacctggttgacagtccacagccactcctggaaaaagttccagaaagcgacttccagtggcctcgcgatgatcatggggacgtggattgcgaaaagctggtcgaacagctcaaggattgttccaatcttcaggatcaagctgacattctctacatcctgtatgttatcaaaggcccatcatgggatactaacttatcggggcaacacggcgttaccgtccaaaacctgcttggggaactgtatggcaaagccggacttaaccaggaatgggggttgatccgctatataagcgggctgttgcggaagaaagtagaagtgctggccgaggcttgcactgatctgctgagccaccagaagcagctaacagtcggacttcccccagaacctagggagaagattatctctgctcctctgcccccagaggagctgactaagctaatttacgaggctagcggacaggatatttctatagcagtactcacgcaggaaatagtggtgtacctggccatgtacgtgagggcacagcccagtctctttgtggagatgctgaggctcaggatcggactcattatccaggtgatggcaacggagttagccaggtctctgaactgttcaggcgaggaagccagtgagtcgctgatgaacctgagccccttcgacatgaaaaacttgctccaccacatactctccggaaaggaattcggggttgagaggtcggtaaggccaatccactcttccacctctagtcccacaatctccatacacgaggtgggacacaccggggtcaccaaaactgagcgctcgggaattaacagattgcggtcagaaatgaagcaaatgacccggcgattttccgccgacgagcaattcttctccgtgggccaggctgcttcaagcagcgctcattcctcaaagtctgcgagaagctctacaccctcttcaccaacagggacaagcagcagtgacagcgggggtcaccacatcggttggggcgaacggcagggacagtggttgagacggaggcgcctggatggcgcaatcaatagggtgcccgtgggcttttaccagcgagtgtggaagattttgcaaaaatgccacgggctgagcattgatggctacgtcctcccgtcatcaacaacccgggagatgaccccacatgaaatcaagttcgccgtccacgtcgagagcgtgttgaatcgagttccgcaaccagaatataggcagctcttggtcgaggctataatggtgctcacactcctgagcgacacggagatgacgtctatcggcggaatcatccatgttgaccagattgtccagatggcgtcgcaactgttccttcaggaccaggtgagcatcggagccatggacacgctggagaaagaccaggccaccggcatatgccacttcttctacgattccgcaccttccggagcttacggcacaatgacttacctgaccagagccgtcgcaagttaccttcaagaactgctacctaacagcggatgccagatgcaatag

SEQ ID NO: 3961 - DNA, 3261 bp, Artificial Sequence
  Description of Artificial Sequence: Synthetic coding sequence
atggcctgcagccccgacgccgtggtgagccccagcagcgccttcctaaggagcgggtctgtttacgagcccttgaaatccataaacctgccgagacccgataacgaaaccctgtgggacaaactggaccattactaccgtatagtgaagtcgacgcttctcttataccagagtccaaccacaggcttgtttccaaccaaaacgtgtgggggcgaccagaaggctaaaattcaggactcgctctactgtgcggcaggagcatgggcactggcacttgcgtatcgccggattgacgacgataagggtcggacccatgaactggagcactcggctattaagtgcatgcggggaatactctactgttatatgaggcaggccgataaagttcagcagttcaaacaggatccgcggcctacaacgtgcttgcattccgtcttcaacgtgcatacgggcgatgagctgttaagctatgaggaatacggccacctgcagataaacgccgtaagcctgtatttgctctacctcgtcgagatgatcagctcagggctgcagatcatctacaatacggatgaagtgtcttttattcagaatcttgtgttttgcgtggaaagagtgtaccgggtccccgactttggagtgtgggaaagaggcagtaagtataacaacggaagcacggaactacacagcagctcggtcggacttgccaaggccgcgctggaagccatcaatggattcaacctttttggcaaccaaggatgctcttggtcggtgatattcgtcgatctcgacgcccacaaccggaacaggcaaactttgtgcagtctactacctcgcgaatctcgctcacataacaccgacgcagcactgcttccttgcatttcttatcccgcttttgctctggacgatgaagtacttttttcccagacgctggataaagtagtgcgcaagttgaaagggaagtacggctttaaaaggttcctgagagatggctacaggacatctctggaggaccctaaccggtgttattataagcccgcagaaattaagctgtttgatggaattgaatgcgagtttcctattttcttcctgtacatgatgattgatggagtgtttcggggcaacccaaagcaggttcaggaatatcaagatctgcttacccccgtgttgcaccatacaaccgagggatatccagtggtgccgaagtattactacgtccccgctgactttgtcgagtacgagaagaacaatccagggtcccagaaacgcttcccatcgaactgcggcagagacggcaaactgttcctctggggtcaggccctctacatcatcgccaaactgctcgcggacgaactgattagtcctaaggatattgatcctgtgcaacgatatgtgcccttgaaagatcagaggaacgtttccatgaggttcagtaaccagggcccactggaaaatgatctggttgtgcacgtcgccctcatcgctgagtcccagcgcctccaggtctttttgaatacctatggaatacaaacccaaaccccacagcaggtcgaacctattcagatatggccacagcaggagctggtgaaagcatatcttcaactgggcattaatgaaaaactgggcctttccggtaggccagacagacccataggttgcctcggaacgtcaaagatctatcgaatcctgggtaaaaccgtggtctgctacccaattatttttgacctgtccgatttttacatgagtcaggacgttttcttgttgattgacgacatcaaaaatgcactgcagtttattaagcagtactggaaaatgcacggtcgtccccttttcctcgtcctcatcagagaagacaatattagaggtagccgatttaacccgatccttgatatgcttgccgcattgaagaaaggcatcattggcggagttaaggtgcacgtagacaggctccaaacactcataagcggtgccgtggtggaacaactggatttcctaagaataagcgacaccgaggagctcccagaatttaaatctttcgaggaactcgagccgccgaagcattctaaagtgaagcggcagtcgtctactccgtccgccccagaattgggacagcagcctgacgtaaatattagcgaatggaaagacaagccaacgcatgagattctgcagaaactcaacgactgttcttgtctcgccagtcaggctattctgctcgggatattgttgaagcgggagggacccaattttattacaaaagaaggcacggtaagcgaccacatagagcgcgtgtaccggagggctggatcccagaaactatggagtgtggtgcggcgggccgcttctctactgagcaaagtggtggacagcctagcaccctctatcacaaacgttctggtgcaaggcaagcaagtaaccctcggcgcattcggccacgaggaggaggtgattagtaaccctctgtcccccagagtgattcagaacatcatctattacaaatgcaacacacatgatgagagggaggcagtgatacagcaggaattggtgatccatatcggttggattattagcaataaccccgaactcttttctgggatgttgaagatccgaatcgggtggatcattcatgcaatggagtacgagcttcagatccgcggaggcgataaaccagccctggatctctatcagcttagcccatctgaagtaaagcagctgctgctggacatacttcagccacagcagaacggaaggtgctggttaaataggaggcaaattgacggttctctgaacagaacccccaccggattttatgacagagtatggcaaatcctagaacgtacccctaacggtatcatagttgccgggaaacatctcccacaacagcctaccctgtctgacatgacaatgtacgaaatgaacttcagcttgctggtggaagatacactggggaacatcgatcagccgcaatatcgacagattgtggtggagctccttatggtggtgtccattgtcctggagcgaaatccagaactggagttccaagacaaggtggaccttgatcgacttgtgaaggaagcctttaacgaattccagaaggatcagtcgagactcaaagaaatagaaaagcaagatgacatgaccagcttttataacacaccaccactcgggaagcggggaacatgttcttatctgaccaaggcggtcatgaaccttttgctggagggcgaggtcaaacctaataacgacgacccttgcctgatttcttag

SEQ ID NO: 3962 - DNA, 3282 bp, Artificial Sequence
  Description of Artificial Sequence: Synthetic coding sequence
atggccggcgccgccggcctgaccgccgaggtgagctggaaggtgttggaaagaagggcgagaacaaagcgaagtggaagcgtgtacgaacccctgaagtcaatcaacctgcctcggcctgacaacgagaccttatgggataagcttgaccattattatagaatcgtcaagtctacactgctcctttaccagtctccaactacaggcctgttcccgacaaaaacttgtggcggcgaccagaaggcaaaaattcaggattccttgtattgcgcggcaggggcctgggcgttggctctggcctatcgaaggattgacgacgataagggacgtacccatgaacttgagcacagcgcaatcaaatgtatgcgagggatactttattgttacatgagacaggccgacaaggtccaacagtttaaacaagacccacgtccaaccacctgcctgcactcagttttcaatgtccatacaggtgatgagctgctttcttacgaggagtacgggcatctgcagatcaatgcagtatcattatacctattatacttagtggaaatgatcagtagtggcctgcagatcatctacaataccgacgaagttagtttcatccaaaatttggttttctgtgttgaaagggtgtacagggtgcctgatttcggcgtgtgggagcggggcagcaagtacaacaatgggtcgaccgagctacactcaagttccgtggggctcgccaaggccgctctggaagccatcaacggcttcaatctgttcggcaaccagggttgctcttggagcgtcatattcgtggatctcgacgctcacaacaggaacagacagaccctatgctcactactgcctagggagagccggtcccacaatactgatgccgcactgcttccctgtatcagctaccctgcttttgccctcgacgatgaagttttattttcccaaacactggacaaagtcgtccggaagctgaaaggaaagtacggattcaagaggttcctcagggatggatacaggaccagcctggaagacccaaatcggtgttactataaaccagctgaaattaaacttttcgacggtatagagtgtgagttccctattttcttcctatacatgatgattgatggagtgtttcgagggaatcctaagcaggttcaggagtaccaggatctgctgaccccggtgctgcaccatactactgaaggttaccccgtggttccaaagtattattatgtgccagccgatttcgtggaatatgaaaaaaacaaccctgggagtcagaaacgcttcccgtccaactgcggacgggatggcaaactcttcctctgggggcaagccctgtacatcatagccaagctgctagcagatgagctaatctccccgaaggacatcgatcccgtacaaaggtacgtaccattgaaggaccagaggaacgtgtcaatgcgcttcagcaaccaaggaccactggagaatgatctggtggtccacgtggcacttattgccgagtctcagaggcttcaagtgtttcttaacacgtatggcattcagacacagacccctcagcaggttgagccaattcagatctggccccagcaggagttagtaaaagcttatttgcagctggggattaacgagaagctggggcttagcggccggcctgaccgccccatagggtgtctgggcacaagtaagatctaccgcatccttgggaaaacagtggtctgctacccaatcatatttgacctgtccgatttttatatgagccaggacgtgttcctgcttatcgacgatatcaaaaatgccttacaattcattaaacagtattggaagatgcatggccgcccactgttccttgttctaatcagagaggataatattaggggctccaggttcaacccaatcctggacatgctggctgccttgaagaagggaatcattgggggagtaaaggttcacgtggatcggctgcaaacactgattagcggagccgttgttgaacagctggatttccttcgtattagtgataccgaagagcttcctgagtttaagagctttgaagagctcgaaccccctaaacatagtaaggtgaagagacagtctagcaccccttcagcacctgagcttgggcagcaaccagatgtgaatatatctgagtggaaggacaagcccactcacgaaatcctacaaaagttgaacgactgtagttgtctggcctctcaggctatcttactgggaatactgcttaagcgggaaggccccaatttcattaccaaagagggaaccgtctcagatcatatcgaacgcgtgtatcggcgagcagggtcacagaagctgtggctggctgtccgatacggtgccgcttttacacagaagttttcctcctccattgcaccccatataaccactttcttagtccacgggaaacaggtgactttgggcgcctttggtcatgaggaagaggtaatttcgaaccctctgtccccgcgggttatacagaacataatttattacaagtgtaatactcatgatgagcgggaagctgttatccagcaggaattggttattcacatagggtggatcatcagcaataatccagaactgttttcagggatgctgaagatcagaattggatggatcatacatgctatggaatacgagctccagataaggggaggagataaacccgcgctcgatctgtaccagcttagcccgagtgaggtgaagcagctattgctggatattctgcagccccagcagaacggcagatgctggctcaatcgcaggcagattgatggttcactgaatagaacgccgactggtttttatgatcgggtctggcaaattctggaaaggactccaaatggcatcattgtcgccgggaaacacctacctcaacagcctactctgtcagacatgacaatgtatgagatgaacttctcactgctggttgaggacactcttggtaacattgatcagccccaataccggcaaattgtcgtggaattacttatggtagtcagcatcgtgctcgaaaggaacccagagttggagttccaggacaaggttgacctggatagacttgttaaggaagccttcaacgaattccagaaagaccagagccgactaaaagagatcgaaaagcaagacgatatgacgagcttctacaataccccccctttgggcaaacgtggtacatgcagctatctgacgaaagccgtcatgaacctcctcctcgaaggagaggtcaagccgaacaatgacgatccctgcctgatttcgtag

SEQ ID NO: 3963 - DNA, 3261 bp, Artificial Sequence
  Description of Artificial Sequence: Synthetic coding sequence
atggcctgcagccccgacgccgtggtgagccccagcagcgccttcctccggagcggatccgtttacgaacctttgaagagcataaacttgccaagaccagacaacgagacgttgtgggacaagctggatcactactacagaattgtaaaatctaccctcctcctgtaccagtccccaaccactgggttgttccctacaaagacatgcgggggagaccaaaaggctaaaatacaggatagcttatattgcgccgccggagcctgggccctagccctggcatatcggagaatagacgacgacaagggccgcacacacgagctggaacatagcgcgattaagtgcatgcgcggcattttatattgctacatgcgacaagccgacaaggtgcaacagttcaagcaggatccacgccctactacctgccttcacagtgtgtttaatgtgcacacaggtgacgagctccttagctatgaggaatatggccatttgcaaatcaatgccgtgtcactgtacctcctgtatctggtggagatgattagtagcggactgcagatcatttacaacacggatgaagtgagcttcatccaaaacctggtattctgtgttgagcgcgtgtatcgcgtgcctgattttggtgtgtgggagcgcggctccaagtacaataatggcagtaccgaactgcattcgagctccgtcgggctcgccaaagctgcactcgaagcgatcaatggattcaatctgtttggcaatcaggggtgtagctggagcgtgattttcgttgatttggatgctcataaccgcaatcgccagactctttgctcacttcttccccgtgagtcgcggtctcacaacacagatgccgcactcttaccctgtattagctatcctgccttcgcactcgacgacgaggtgctgttttctcaaaccctcgataaagttgtgaggaagctgaaaggtaaatacgggtttaaacgctttctgagggacggatacagaacctcgttggaggatcctaataggtgctactacaaaccagccgagatcaaactgtttgacggtatcgaatgtgagtttcctatctttttcctctatatgatgattgatggagttttccgtggtaacccaaagcaggttcaggagtatcaagacctgctcactcctgtcttgcatcacacaaccgagggttatcccgtagtgccaaagtactactatgttccggctgactttgtggaatatgaaaaaaataatccggggagccagaaacgattcccatctaactgcggtcgggatggaaagttgttcctgtggggccaggccctctatattatcgccaaattactggcggacgagttgataagtcctaaagatatcgatccagtccagcgatatgttcctttgaaggatcaaagaaacgtttctatgcgcttcagtaaccagggtcccctggaaaacgacctggtcgtgcacgtggctctcatcgcggagtcgcaacgactccaggtctttctaaatacctacgggatccagactcagacccctcagcaggtcgaaccaatccaaatctggcctcaacaggagctggtgaaggcttacttgcagctgggcatcaacgagaaactgggcctctctggtaggccggaccgacctatcggttgtttgggaacctccaagatctacagaattctgggaaaaacagtggtgtgctacccaatcatcttcgacttatctgatttctacatgtctcaggacgtcttcttgctgatcgacgacataaaaaatgcccttcaattcatcaagcagtattggaaaatgcacggtaggccgttgtttctcgtgctcatccgggaggataacatccgggggagcaggttcaatcctattcttgacatgctcgccgctctgaagaaaggaatcattggaggggtcaaagtgcacgttgacagactgcagaccctgatctctggggccgtggttgaacagctggacttccttaggataagcgacacagaggaacttcccgagttcaagtcatttgaagaacttgagccaccaaaacattctaaggtcaaacgccaatcttcaacacccagcgccccagagctcggacagcagccggacgtaaatatatctgaatggaaagacaagccgacccatgagatcctccagaagttaaatgattgttcttgcctggcatcacaggccatcttgttgggaatattgctgaagagagagggaccaaattttattacaaaggaagggacagtctctgaccatatcgaacgggtgtatcgtcgggccggcagccagaagttgtggctagccgtgaggtacggcgccgcattcacacagaagttcagctccagtatcgcacctcatattacaacatttttggtgcacggcaaacaggtcacacttggggcattcggtcacgaggaggaggttattagtaatccactgagtccacgcgtcatccagaatatcatctattataaatgtaatacacacgacgaaagagaggccgttatccagcaggaactcgtcattcacatcggctggataatcagtaataatcccgagttgtttagtgggatgctcaaaatacgaattggttggatcatccatgcaatggagtatgagctgcagatcagagggggagataagcctgcacttgatctctaccagctgtcaccatccgaggtgaaacagctcctcttagacatccttcagccgcagcagaatggacgatgttggttaaaccgaaggcaaatcgacggttccctgaacaggacccctactggattttacgatcgggtttggcagattttagagcgcacgcctaatggcatcatagtggccggcaagcatctgcctcagcagccaaccctgtcggatatgacaatgtatgaaatgaacttctcattacttgtggaggacacgcttggcaacatcgaccagccacagtaccgacaaattgttgttgagctgttgatggtcgtgagcatcgtcctcgaaaggaatcccgaacttgagtttcaggataaggtcgacctggacagactagtgaaagaggcctttaacgagttccagaaagaccagagccgcctgaaagagattgaaaaacaggatgacatgacctccttctacaatacgcccccactgggtaaaagaggcacttgttcctacctgacaaaagccgtgatgaatcttttgctggagggagaggttaagcccaataacgacgacccctgcctaatctcgtag

SEQ ID NO: 3964 - DNA, 1221 bp, Artificial Sequence
  Description of Artificial Sequence: Synthetic coding sequence
atgaccctggacgtgggccccgaggacgagctgcccgactgggccgccgctaaggagttctaccagaaatatgaccctaaagatgttatcggtcggggcgtctctagtgtggtgcgcaggtgtgtccaccgagccactggacacgaattcgcagttaaaattatggaagtgactgccgaacggctctcacccgaacagcttgaggaagttagagaagcaacgcgtcgggagacacatatcttacgccaggtagccggacacccacatatcattactctaattgacagctacgagagctcttccttcatgttcttagtgtttgacctcatgcgtaagggggagctcttcgattatttgactgagaaggtggcactttcagagaaagagacgaggtccattatgcgctctcttctggaggccgtgtccttcctacacgcgaacaacatagtgcatcgggacctgaaaccagagaacatcttgctcgatgataacatgcagatccgcctaagcgatttcggcttttcgtgtcatcttgagcctggggaaaagctgagggagttgtgcggaacacctggctacctggcccctgagatccttaagtgttctatggacgagacacacccggggtatgggaaggaagttgatttgtgggcctgtggcgtcatactgttcaccctgttggctggaagccccccattttggcaccgcaggcaaatcctgatgctgagaatgatcatggagggccagtaccaatttagcagtcccgagtgggacgaccgctcatccaccgttaaggacttgatctcacgactcctgcaggtggaccccgaagcaagactcaccgctgagcaggcgcttcagcatcctttttttgaacgctgtgaaggatcccagccatggaacctgaccccgcggcagcggttcagggtcgctgtgtggacagtcctcgccgcagggagggtggcactatctacccaccgtgtacggcccctgactaagaatgcgctgctgcgagacccttatgccctcagaagcgtcaggcacctgatagataactgcgcttttagactgtatggtcattgggttaagaagggggaacaacaaaaccgagccgctctcttccagcatcggccaccaggccctttccctataatgggccccgaagaggagggggactctgccgcgatcacagaggacgaagctgtgttagtgctgggttag

SEQ ID NO: 3965 - DNA, 1125 bp, Artificial Sequence
  Description of Artificial Sequence: Synthetic coding sequence
atgaccctggacgtgggccccgaggacgagctgcccgactgggccgctgcaaaggagttctatcaaaaatacgatcccaaggatgtgatcggcaggggggttagctcagtggtaaggcgctgcgtccatagggctactggccacgagtttgccgtgaagataatggaggtgactgctgagagattgtcgcccgaacagttggaagaggtgcgtgaggccacaaggagagagacccacatcttgagacaagttgctggacatccccatatcataacactcatcgattcttacgaatcttcgtcattcatgttcctagtctttgatttgatgaggaaaggagaactgtttgactatctcacagagaaggtggccctcagcgagaaggaaacccgcagcatcatgcggtcactccttgaggccgttagctttctccatgcaaacaatattgtacatcgggacctgaagcctgaaaacatcctactggacgataacatgcagattaggctgtcagacttcggtttttcctgtcatctggaaccaggagaaaagctacgggaactttgtggcacccctggctatctcgctcccgagatcctgaagtgctctatggacgagacccacccaggctacggaaaagaagtagatttatgggcctgcggggtgatcctgtttactctcctggcgggttcccctcctttctggcaccgcagacagatcctgatgcttcgaatgattatggaggggcagtaccagttttcatctccagagtgggatgacagaagctccactgttaaagacctgatcagccgtctgctccaggtggatcctgaggcccgcctgaccgccgagcaggctctgcagcatccattctttgagagatgcgaggggtcccaaccctggaacctgacccccagacagcggttccgagtagctgtctggaccgtgcttgctgccgggcgggtagcccttagcactcaccgagtcaggcctctgactaagaacgccctcttgcgggacccctatgccctgcgtagtgtacggcacttaattgacaactgtgcattccgactctatggtcattggatcaggaagcagtggatcggcaagctgatggcttgcgtatag

SEQ ID NO: 3966 - DNA, 3999 bp, Artificial Sequence
  Description of Artificial Sequence: Synthetic coding sequence
atgcagcaggccccccagccctacgagttcttcagcgaggagaactcccctaagtggaggggactgctggtttcagctcttcggaaggttcaggagcaggtgcatccgactctgtcggccaacgaagaatccctctattacatcgaagagctgatctttcagcttttgaataaactgtgcatggcccagccacgaacagtccaggacgtggaggagcgcgtgcagaaaacatttccacaccccatcgataagtgggccatagccgacgctcagtccgcgatagagaaacgcaaacgtagaaatccattattgctgccggtggacaaaatccacccttccctaaaggaggttctgggctacaaggtggactaccatgttagcctgtatatagtggcagtgctggagtacatctccgccgatattctcaaactagcaggaaactatgtgttcaatattagacattatgaaatatcccaacaagatatcaaggtgtccatgtgcgctgataaggtactgatggatatgtttgaccaggatgatattgggctcgtgtctttatgtgaggacgaacccagcagtagtggggagttaaactactacgacctcgtgagaacagaaatcgctgaagaaagacagtacctgcgagaattaaatatgatcattaaagtcttccgcgaggcatttcttagcgatcggaaactgttcaaaccctcggacatcgaaaaaatcttctctaatattagcgacatccatgagctcaccgtcaagttgcttgggcttattgaagacacagtggaaatgaccgacgaatccagtccacacccacttgcaggctcatgtttcgaagacttagcagaagagcaggccttcgatccttacgagaccttgtctcaggacattttgagtcctgagttccatgaacacttcaacaaactgatggctaggccggctgtggcactgcacttccaaagcattgctgatggattcaaagaagctgtccggtacgtgctgccgcggttgatgcttgtccctgtttaccattgctggcattatttcgaactgctaaagcaactcaaagcctgttctgaggagcaggaggatagagagtgcctcaatcaggctattacggccttgatgaacttgcagggctcaatggaccgcatttataagcagtactctcctcgtcgccgacctggcgaccccgtgtgtcctttctattcacaccaactgcgaagcaaacatctggccatcaagaagatgaatgagatccagaagaatatagacggctgggaaggcaaggacatcggccagtgctgtaatgagttcatcatggagggtcctctgacccggatcggggccaagcacgaacgccatatattcttgttcgacggactcatgatttcatgtaaaccgaatcacggacaaacacgcctgcctggatactcttcggctgaataccggttaaaggagaagtttgtcatgcggaaaatccagatatgtgataaagaggacacatgtgagcataagcacgctttcgagcttgtgtccaaggacgagaactccattatttttgcagccaaatctgcagaggagaagaataattggatggctgcactgattagtttacactataggagcacgctggaccgcatgttggacagcgtgctgttaaaggaagaaaacgagcaaccgctgaggttgccgtccccggaagtgtaccggtttgtggtgaaagactctgaagaaaatatagttttcgaggacaatctgcaaagccgatccggtatacccattatcaagggcggcacggtcgtcaagctgattgagcggctgacttaccatatgtacgctgatcctaatttcgtccggacctttctcaccacctacaggtcattttgtaagccacaagaactgctctctctgcttatcgagcgtttcgagatccccgaacctgagccaacagatgccgataaattggccatcgagaaaggcgagcagccaatctctgctgacctgaaacgcttccgtaaggagtatgtgcaaccggtgcagctgagaatcctgaatgtgttcagacactgggtggagcaccacttctatgacttcgagagagacttggagctcctggagcgactggagagcttcatatccagtgtcagggggaaagccatgaagaagtgggtggagtccatcgccaagataatccgcaggaaaaaacaggcacaggctaatggagtgtcgcacaacatcaccttcgaaagcccccctccacctatcgagtggcacattagtaagcctggccagttcgagacctttgatctgatgacgctgcatcctattgaaatcgcgaggcagctgactttgctggaatccgacctctataggaaggttcaacctagcgaactggtggggagcgtctggacaaaagaagacaaggaaatcaatagccccaacctgcttaagatgatcagacatactactaacctgacattgtggttcgagaagtgtatcgtggaagccgagaattttgaagaaagagtggccgtactgagccgcataatcgagatccttcaggtcttccaagatctaaacaatttcaatggtgttctggaaatagtaagcgcagttaactccgtgtcggtgtaccggcttgatcatacctttgaggcgctgcaggaacggaaacggaagattctggacgaggccgtcgagctgagccaggaccacttcaaaaagtacctcgtgaagctgaagtccattaacccgccttgtgtacctttttttggaatctacctgaccaatatccttaagacagaggaggggaacaacgattttctcaagaagaagggcaaagatctcatcaattttagcaagcgccgaaaagttgctgaaatcactggggagattcagcagtaccagaaccaaccctattgtctgcgcatcgaaccggatatgcggcggtttttcgagaacctgaaccctatggggtctgcaagcgagaaggaattcactgattacttattcaacaagagcctcgagatagaaccaaggaattgtaagcagcctccgcgcttcccaagaaaatccacctttagtctgaaatcccccggtatcagaccaaataccggcagacatggtagcacctccggaactttgcgggggcacccgacccctctcgagcgagagccctgcaaaatatcattcagccgtatcgcagagaccgagttagagtctacagtgtcggcccccacatcacccaatactcccagcactccccccgtaagcgcttcttccgacctcagcgtgtttctggacgtggaccttaatagttcctgcggctctaactccatattcgcgcctgtgctcttacctcacagtaagagcttcttttcatcttgcgggtctctccacaagctgagcgaggaaccgttaatcccacctcccctgcccccacggaagaaatttgaccacgacgctagcaactccaaaggcaacatgaagtcggatgatgatccaccagccattccgccaaggcagcccccaccccccaaggtgaaaccacgcgtgccagtgcccaccggggcatttgacggcccgctgcacagcccaccccctccacctccccgcgatcctctcccagatacacccccccctgtgccgctacggcctcccgagcattttatcaattgcccatttaacttacaacctcctcctcttggacacctgcatcgggactcagattggctccgcgatataagtacatgccctaattcaccatctacccccccatctactcctagcccacgggtacctagaagatgctatgttctgtcatccagccagaataatctcgcccatccgccagccccacctgtgccacctcgccagaattcctctcctcacctgcccaagctccctcccaaaacttacaagagggagctgtctcacccccctctctataggcttccattgctggaaaatgccgagaccccgcagtag

SEQ ID NO: 3967 - DNA, 2442 bp, Artificial Sequence
  Description of Artificial Sequence: Synthetic coding sequence
atggccaagcccctgaccgaccaggagaagcggcggcagatcagcattcgcggtatcgtgggcgttgagaacgtggcggagctgaagaaaagcttcaataggcacttgcatttcacactcgtgaaagaccggaatgtggcaacgactagagattattattttgcattggctcataccgtccgcgaccatttggtcggccggtggataaggactcagcagcactactacgacaaatgccccaaactggggctggatatcgaagaactggaggaaatcgaagaggatgccggcctgggaaatggcggtctcggccggcttgctgcttgcttcctcgacagtatggctacccttggcctggcagcttacgggtacggtatccgttacgaatatggcatcttcaatcagaagattagggacggatggcaggtggaggaagccgatgactggctccggtacggaaacccttgggaaaagtccaggcccgagttcatgttgccagtccacttttacggcaaggttgaacacaccaataccggaactaagtggattgatacacaggttgtacttgctctgccgtatgacaccccagtcccgggttatatgaacaacacagtgaatacaatgaggctgtggagcgcccgcgcacccaatgacttcaaccttcgcgactttaatgtgggtgactacatccaggctgtgttggaccgaaatttagcggagaatatcagcagagttttgtaccctaatgacaattttttcgaaggcaaggagctgcggttgaaacaggaatattttgtcgttgccgcgaccctccaggacatcatcaggagattcaaggcatcaaaatttggctctaccaggggcgccggcactgtgtttgacgcttttcccgatcaggttgctattcagctgaacgatacccaccctgcacttgcaatcccggagcttatgcgcattttcgtagatatcgagaagcttccgtggtctaaggcttgggagttaactcaaaaaacatttgcttataccaatcacacagtcctaccggaggctctcgagaggtggccggtggacctggtggaaaagctgctccccaggcatctggaaatcatttatgagataaaccaaaaacacttggaccggattgtcgctctgttccctaaggacgtggacaggctccgacgcatgtccttgatcgaggaagagggcagcaagcggatcaacatggcccatctgtgcatcgttggctctcacgctgtcaacggcgtggctaaaatacattccgacatcgtaaagactaaggtttttaaagatttctcagagctggagcccgacaagttccagaacaagaccaatggaatcactcctcggcgctggctcctcctgtgcaatcctggattggcagagcttatcgctgaaaagatcggggaagactacgtgaaggacctaagtcagcttacgaaattacacagtttcttgggggacgatgtgtttcttagagaactcgcaaaggtgaaacaagaaaataaattgaaatttagccaattcctcgaaacagaatacaaggtaaaaatcaacccctcttctatgtttgatgtccaggtcaagcggatccacgagtataaacggcagctgttgaactgtctacatgtgataactatgtataaccgtataaagaaagacccgaaaaagctgtttgtgccaagaaccgttattatcggaggcaaggccgcacctggatatcatatggctaaaatgatcataaagcttattacatcagtggcagatgtggtgaataatgatcctatggttggttccaaactcaaagtgatctttctcgagaactaccgggtgtccctggccgaaaaggtgattccagcaactgatctgtctgagcaaattagtacagcagggacggaggccagcggcaccggcaatatgaagtttatgctgaatggcgctttaaccattggcactatggacggcgctaatgtggagatggcagaggaagcgggtgaagagaacctctttatattcggcatgcggatagacgatgtcgccgcccttgacaaaaagggatatgaggctaaggagtactatgaagcacttcctgaactcaagttggttatagaccagattgacaacgggttctttagcccgaagcagcctgacttgttcaaagacatcatcaacatgctgttttaccacgacagatttaaggtgtttgccgattacgaagcttatgtgaagtgtcaggacaaggtctctcagctgtatatgaatccaaaggcctggaataccatggtgctgaagaacatcgcggcctcaggaaaattttctagtgacagaacgattaaggagtatgctcagaatatctggaatgtggaaccaagcgatctgaagatatctctgagtaatgagtccaacaaagtgaacggaaattag

SEQ ID NO: 3968 - DNA, 2433 bp, Artificial Sequence
  Description of Artificial Sequence: Synthetic coding sequence
atggagcacaaggaggtggtgctgctgctgctgctgttcctgaagtcgggtcagggcgagcctttggatgactatgtgaacacccagggcgccagtctcttctctgttaccaaaaaacaactcggagccgggagtatcgaggaatgcgcagctaagtgcgaagaggatgaagaattcacgtgccgcgcattccaatatcacagcaaggaacaacaatgcgtcataatggccgagaaccgaaagtccagcatcatcattcgaatgcgtgacgtggtgttatttgagaaaaaggtttatctgtccgagtgtaaaacgggcaatggtaaaaactatcgtggcaccatgagtaaaacaaaaaacgggataacttgccaaaagtggtcaagcacatctcctcacaggccgaggttctcacccgccacgcatccatctgaggggcttgaagagaattactgcagaaacccagacaacgacccgcaaggcccatggtgttacacaactgatcccgagaaaagatacgactattgcgatattctagagtgtgaggaggaatgcatgcattgctcaggagaaaattatgacggaaagatttctaaaaccatgtctggcctggaatgtcaagcttgggactctcagtcaccccatgcgcacggctatattcctagcaaatttcctaacaaaaaccttaagaaaaattactgtaggaatcccgacagagagctgcgcccctggtgcttcactacagatccaaacaaacgatgggagttgtgtgatatccccagatgcacaaccccgcctccctcaagtggccccacttaccagtgtttaaaagggaccggagagaactaccgcggcaatgtcgcggtcaccgtgtctggccacacatgtcagcattggtccgcacaaactcctcacacgcacaatcgcactccggaaaattttccttgtaagaacctggacgaaaattactgtagaaaccctgatggcaaaagagctccatggtgccatactacaaatagccaggtgcgttgggaatactgcaaaatccctagttgtgactcctcaccagtgagcacagagcagctagcgccaacagctccccccgagctgacccccgtcgtgcaggattgctaccacggagacgggcaatcctaccggggcacgtccagtacaacaactacagggaaaaaatgtcagagctggtcttcgatgactccccatcggcatcagaaaacacctgaaaactacccaaatgccggactcaccatgaactactgcaggaatcccgacgccgacaaaggcccttggtgtttcacaacagacccaagcgttagatgggagtattgcaacctgaaaaagtgtagtggtaccgaagcatccgtcgttgcaccgccacccgtagtgttactcccggatgtcgaaacgccttccgaagaggactgcatgtttgggaatggcaaaggatatcggggcaaacgtgcaaccaccgtcactgggaccccttgtcaagactgggccgctcaggagccccaccggcatagtatcttcactcccgagacaaaccctcgcgccggactggagaagaattattgtcgaaaccctgatggtgatgtgggagggccctggtgctacacaacaaacccccgcaagttgtatgactactgtgatgtcccgcagtgcgctgcaccttcatttgactgtggtaagcctcaagtggaacctaaaaagtgtcccggaagggttgtaggcggttgtgtggcacatccgcactcttggccctggcaggtcagcttgcgcactcggttcgggatgcacttctgcggcggcaccttgatcagccccgaatgggtcctgaccgcagcgcactgccttgaaaagtccccacggccaagttcctataaggtgatcctcggtgcgcaccaggaggtaaatttggaacctcacgtgcaggaaatcgaagtatcccgactcttcctcgaacctacccgcaaggatatcgcactgttgaagctcagctctcccgccgtcattaccgacaaggtgattcctgcctgccttcctagccccaactacgtggtggcagaccgaacggagtgctttatcaccggttggggggagacacagggaaccttcggagctggtctactcaaggaagcacaattgcctgtgattgaaaataaggtgtgcaatcggtacgagttcctgaatggcagggtccagtctacggaactgtgcgcgggccaccttgcaggcggcactgactcttgccagggggattccggaggtccccttgtgtgcttcgaaaaagataaatacatcttgcagggggtgaccagttggggacttggatgcgctcggccgaacaagcctggagtatatgtccgggtgagccggtttgtgacctggatagagggagttatgcggaacaactag

SEQ ID NO: 3969 - DNA, 633 bp, Artificial Sequence
  Description of Artificial Sequence: Synthetic coding sequence
cggttcggcatgcacttctgcggcggcaccctgatcagccccgagtgggttctgactgccgcccactgcctggagaagagccctcgcccatcttcctacaaagtcattttgggagcccaccaggaggtgaatctagagcctcacgtgcaggagatcgaagtgtccaggctgttcctcgagcctacgcgaaaggacatcgctctgctgaaactctcgagtcctgctgtgattacagacaaggtaatcccagcttgcctgccgtcccccaactatgtggtcgctgaccgcacagaatgtttcattacaggctggggtgagacacagggcacctttggagcagggcttctgaaggaagcgcagctgccggtcattgagaataaggtgtgtaatcggtatgagttcctcaacggccgagttcaatcaaccgagttatgcgccggccatctggccggcggcaccgacagctgtcagggagacagcgggggacccctggtttgtttcgagaaagataagtacattctccagggggtgacctcatggggtctgggttgcgctcgaccaaataaaccaggtgtgtatgtgcgcgtgagcaggttcgtgacatggattgagggtgtgatgagaaataattag

SEQ ID NO: 3970 - DNA, 411 bp, Artificial Sequence
  Description of Artificial Sequence: Synthetic coding sequence
atggagcacaaggaggtggtgctgctgctgctgctgttcctgaagtccggccagggcgagcccctcgatgactacgtaaacactcagggggcttctctgttttcagtcaccaaaaagcagcttggcgcagggtctatcgaagagtgcgccgctaagtgtgaggaggatgaagagtttacttgtagagctttccagtaccactctaaggagcaacaatgtgttatcatggcggaaaataggaagtcgtctattattattagaatgagggacgtcgtgctgtttgaaaaaaaagtctatctttctgaatgtaaaactggcaatggcaagaactatcgggggaccatgtcaaaaacaaaaaacggcattacctgccagaagtggtccagcacttccccccatcggcctagatag

SEQ ID NO: 3971 - DNA, 945 bp, Artificial Sequence
  Description of Artificial Sequence: Synthetic coding sequence
atgggcatcggccggagcgagggcggccggcggggcgccgccctgggagtcctcctcgcattgggtgcagctttgctcgccgtgggttctgcttccgaatacgactacgtctcatttcagagtgatattggtccataccagtccggccgcttttacactaaacctccccaatgcgtcgacattccggccgacttacggctgtgccataacgtaggctataagaagatggtgcttcccaatctgttggagcacgagacgatggccgaagttaagcagcaggccagcagctgggttcctctgctgaataaaaattgtcatgccgggactcaagtttttctttgcagtcttttcgcacccgtgtgcctcgacagacctatctacccatgcagatggctgtgtgaagccgttagagattcatgtgaacctgtgatgcagtttttcggtttctactggccggagatgctgaagtgtgataagtttccagagggagacgtgtgtatagcgatgacaccccccaatgcaacagaggcctccaagcctcagggcaccaccgtctgccctccatgcgataatgagcttaagtccgaggcgattatagagcacctgtgtgcttcagagttcgcactacggatgaagataaaagaggttaagaaggagaacggcgataagaagattgtgcccaagaaaaaaaaacctctcaaactcggcccaataaagaaaaaggacctcaaaaagctggtcctgtacctgaaaaatggagcggattgtccctgccaccaactggataatctttctcatcattttctaattatgggacggaaggtgaaatctcagtaccttctgaccgcgattcataaatgggacaagaagaataaggagtttaagaactttatgaagaagatgaagaatcacgaatgtcctacctttcagtcagtgttcaagtag

SEQ ID NO: 3972 - DNA, 882 bp, Artificial Sequence
  Description of Artificial Sequence: Synthetic coding sequence
atggacgccatgaagcggggcctgtgctgcgtgctgctgctgtgcggtgcggtcttcgtgtcaccctcacaggagatccacgcaaggttccgtcggggagctcgaagctaccaggtaatctgcagagatgagaagacccagatgatctaccagcagcatcagagctggctgcgacctgtcctcagaagtaatagggttgagtattgctggtgtaactcggggagagcccaatgccactcagtgcccgtgaagtcctgtagcgagcccaggtgcttcaatggaggtacgtgccagcaggccctctacttttctgacttcgtctgccaatgtcctgagggcttcgccggaaaatgctgcgagattgataccagggcaacatgttatgaagatcaagggatttcgtaccgcggaacgtggagtaccgctgagtctggggcagaatgcactaattggaacagttctgccctggcacaaaaaccctattccggccgccgacctgatgctatccgcctcggtttgggcaaccataactactgtcggaaccccgacagggatagcaaaccctggtgttatgtcttcaaggccgggaagtactcaagtgagttttgttccaccccagcatgtagcgaggggaacagcgattgttatttcgggaacggaagcgcgtatcgagggacacactctctgacagagagcggagccagttgcctgccttggaactcgatgattctcatcggcaaggtgtacaccgctcagaacccgagcgcccaggccctcggcttaggcaagcacaattactgccgctgtaggaccggccgaagcgtttcctctccagccaccgctagtatgaggccttgtctcttgagcatccgatccggatag

SEQ ID NO: 3973 - DNA, 1551 bp, Artificial Sequence
  Description of Artificial Sequence: Synthetic coding sequence
atggacgccatgaagcggggcctgtgctgcgtgctgctgctgtgcggggctgttttcgtgtcgccatctcaggaaatccacgcccgatttagacggggtgcaaggtcctatcagggctgtagcgaaccaaggtgcttcaatggaggtacttgtcagcaggctctgtatttcagcgactttgtatgtcaatgtccagagggctttgctggcaagtgctgtgagatagataccagagctacgtgctacgaggaccagggaatctcctacagggggacctggagtacagcagagtcaggggcagagtgtacgaactggaactcgtccgccctcgcacagaagccctactcaggccggcgccctgacgccatcagactgggtttggggaaccacaattactgtcgaaatcctgatcgggactctaaaccttggtgttatgtgttcaaagccggtaagtactctagcgaattctgtagcacgccagcttgcagtgaaggaaattcagattgctatttcgggaatgggtccgcttaccggggtacacatagtcttacagagtcaggagcgtcatgcttgccttggaactctatgatacttatcggtaaggtgtacactgcacagaatcccagtgcccaagctctgggactgggcaaacataattactgtcgtaatccagacggggatgccaagccctggtgccatgtactgaaaaatcgccggctgacatgggagtactgcgacgttccctcgtgtagcacgtgcggcctgcgtcagtatagccagcctcagttcaggatcaagggaggcctgttcgctgacatcgccagtcacccttggcaagctgccatcttcgctaaacacagaagaagcccgggtgagcgctttctgtgtggagggattctgatcagttcttgctggatcttgtccgcagcccattgtttccaggaacgcttccctcctcaccaccttacagtgattttgggcagaacttacagggtggttccgggcgaggaggaacagaagtttgaggtggaaaagtatatcgtgcacaaggaattcgacgatgatacctacgacaacgatatcgctctgctccagttgaaaagtgattcaagtcgctgtgcccaagagtcctccgtggtacggacagtgtgtctgcccccagctgatctccaacttccagattggacagagtgcgaactttcaggatacggtaaacatgaagctctctccccgttctattcagaacgcctgaaggaggcccatgtacgactgtaccccagcagccggtgtaccagccagcatctgctaaatcgcacagtaacagataatatgctgtgtgccggagatacgcgctccggaggtccgcaggctaatctgcacgatgcatgtcagggggactccgggggtcctttggtctgcctcaatgacggcagaatgaccctggtggggatcatcagttggggcctgggatgcggccagaaagacgttccaggcgtatacacgaaagtcactaactatttagactggattagagacaacatgcgtccatag

SEQ ID NO: 3974 - DNA, 1689 bp, Artificial Sequence
  Description of Artificial Sequence: Synthetic coding sequence
atggacgccatgaagcggggcctgtgctgcgtgctgctgctgtgcggagcagtgtttgtgagccctagtcaagagatccatgctcgatttcgcaggggagctcgctcgtatcaagtcatttgcagggatgagaaaacccaaatgatctatcaacagcatcaatcctggctgcggccggtgcttcgaagtaatcgggtcgagtattgctggtgtaatagcggcagggcccagtgtcactcagtgcctgtcaaaagctgctcagaaccgagatgtttcaacggagggacctgtcaacaggccctgtatttcagcgacttcgtatgtcagtgccctgagggctttgccggtaaatgctgtgaaatcgacacacgcgcgacgtgctacgaggatcagggaatcagttacagggggacctggagcaccgcggaatctggcgctgagtgtaccaattggaattccagcgcactggcccagaaaccttacagcggaagaaggcccgatgcgattcgcctggggctggggaaccataattactgcagaaacccagacagagatagcaaaccgtggtgctatgtctttaaggccggtaagtacagctccgagttttgctccacgcctgcgtgtagcgagggcaacagcgattgctacttcggcaacggaagcgcctacaggggaactcacagccttactgagtcgggagcttcatgcctaccatggaactccatgatcctgatcggcaaggtgtatacagcccagaatccaagtgcccaagcactcggcctagggaagcataactattgtcggaatcccgacggtgatgcaaaaccctggtgtcacgtgttgaaaaacaggcggctcacctgggaatattgtgatgtcccttcttgctctacatgcggactcaggcagtacagccagccccaattccgcattaaggggggcctgtttgctgacatagcttcccacccctggcaggccgccatcttcgccaagcaccgccgcagcccaggcgaaagattcctatgcggcggaatcctcatttccagttgctggatcctttccgccgctcactgttttcaggagcgcttccccccccatcatctgactgtaatcctgggccgaacatatagggtcgtgccaggcgaagaggagcagaagttcgaagtagagaagtatatcgtccataaagaattcgatgacgatacctacgacaacgacattgccctgttgcagctgaagagcgactccagccgctgcgcccaggagtctagtgtcgtgaggaccgtgtgtctgccccctgctgacctccagctgcctgattggacagagtgtgagctgtctgggtacgggaagcacgaggccctgagcccattctacagtgaacgtctgaaggaagcccatgtgcgcttatatccatccagccgatgtacctcgcagcatctgctgaacaggaccgttaccgataatatgctttgcgccggagacacacggtccggaggccctcaggccaatctgcacgacgcgtgtcagggcgactctggcggaccgcttgtctgtcttaatgacggccgtatgactctggtgggcatcatctcatggggtctcggctgcggccaaaaggatgtccccggcgtgtacacgaaagttaccaactacttagattggattagggacaacatgagaccctag

SEQ ID NO: 3975 - DNA, 1311 bp, Artificial Sequence
  Description of Artificial Sequence: Synthetic coding sequence
atggacgccatgaagcggggcctgtgctgcgtgctgctgctgtgcggggcggtgttcgtgagcccttcacaggaaatccacgccagatttcggaggggtgccagatcctatcaagtgatttgcagggacgaaaaaacgcagatgatttaccagcaacaccagagctggttgcggcccgtgttgcggagcaaccgggtggaatattgttggtgtaattcaggtcgagctcagtgccattccgttccagtaaagcgaaactctgactgttactttgggaacggcagcgcttacaggggaacccacagtcttacagagagcggagcatcatgcttaccatggaactctatgatcctgattggtaaggtctacaccgcccagaacccaagcgctcaagcactcggtcttggcaagcataattattgcaggaacccggatggggatgctaagccctggtgtcacgtgctgaagaacaggaggcttacgtgggaatattgcgacgtgccaagctgttctacctgcggcttaaggcaatatagtcagccacaatttcgcatcaagggtggcttgtttgccgacatagcttcccacccgtggcaagctgctatcttcgccaaacaccgtcgatcccctggggaaaggtttctatgcgggggaatcctgatcagctcatgctggattctttccgccgctcattgctttcaggaacgattccctccccaccatctcactgtgattctgggcagaacctacagagtggtgcctggggaagaagaacagaagttcgaagtcgaaaagtacatcgttcataaagagtttgatgatgacacgtacgacaacgatatcgcccttcttcagctgaaatcagattcaagcagatgtgctcaggaatcatcagttgtaagaaccgtctgcctcccacccgcagatctgcagctccccgattggaccgagtgtgagctgtctgggtatgggaagcacgaagccctgagccctttctacagcgaacggcttaaagaggctcacgtcaggttgtacccctcttccagatgcacaagccagcatcttctgaatcgcacggtgacagataacatgctgtgtgccggcgacactcggtctggtggtccccaagcgaatctgcacgatgcctgtcaaggggattcgggagggccactggtttgtttaaacgacggacgcatgacactggttggcattattagctggggtttgggctgcggccagaaagatgtgccaggcgtgtacaccaaggtgactaactacctggactggattcgggacaatatgagaccttag

SEQ ID NO: 3976 - DNA, 1500 bp, Artificial Sequence
  Description of Artificial Sequence: Synthetic coding sequence
atggacgccatgaagcggggcctgtgctgcgtgctgctgctgtgcggcgcagtgtttgtttccccgagtcaggagattcacgcaaggttccgcagaggggcgagaagctatcaggtaatatgtagggatgaaaaaacccagatgatatatcagcaacaccagtcctggctgagacctgtgcttaggagcaatagagtggagtactgctggtgtaattcaggtcgcgcccagtgtcacagcgtccctgtgaagtcttgtagtgagcccagatgtttcaacggcggcacatgtcaacaggcactgtactttagtgacttcgtatgtcagtgtcccgagggctttgctgggaagtgctgcgaaattgattctaaaccttggtgttatgtattcaaggcaggtaagtactcgtctgaattttgttcaacaccagcttgctctgagggcaattccgactgctactttggaaacggaagcgcctatcgaggtactcactcccttaccgaaagtggcgcatcctgtctgccctggaactccatgattctgatcgggaaggtgtacacagcacagaatccaagcgcacaggcactgggacttggaaaacataactattgccgcaaccctgatggggatgctaagccctggtgtcatgttctcaaaaatcgcagactcacatgggagtattgtgacgtgcctagttgctccacatgtggcctgagacaatatagtcaaccccagtttcgcatcaagggtggtctgtttgccgacatcgctagccacccatggcaggccgcaatctttgccaagcaccgaagatctcccggggaaaggttcctttgcggcggaatcttaatcagcagctgttggatactctctgctgcacactgcttccaggagcgctttccaccccaccatttgacagtcattctgggcagaacttatcgggtggtccccggcgaggaggagcagaagttcgaggtggagaaatacattgtccataaagagtttgacgatgatacctatgacaacgacatcgccctcctgcagcttaagtctgatagcagtcgatgcgcccaggagtcgtcagtggtacgaacagtttgtctcccaccggctgaccttcagcttcccgactggacggagtgcgaactgagcgggtacggcaaacatgaagcactgtcgcccttctattcagagaggttgaaggaggcgcatgtaagactgtacccgagcagccggtgtacctcacaacatctgctgaacagaaccgtaacagacaatatgctgtgcgccggagatactcggagcggcggcccccaggccaacctgcacgacgcctgtcagggcgactccggcgggccattagtgtgcctgaacgacggacgtatgacactggtgggaataatatcttggggacttggttgcggtcaaaaagacgtgcccggagtatacacgaaggttaccaattatttagactggatccgggataatatgcggccatag

SEQ ID NO: 3977 - DNA, 537 bp, Artificial Sequence
  Description of Artificial Sequence: Synthetic coding sequence
atggacgccatgaagcggggcctgtgctgcgtgctgctgctgtgcggggctgtgtttgtgtcccctagccaggagatccacgctcggttcaggcgcggggccagaagctatcaggtcatatgtagagacgaaaaaacacagatgatatatcaacagcaccagtcctggctgcggccagtcctgagaagcaacagggtggaatactgctggtgcaatagtggccgagcccaatgtcatagcgtgcctgtcaagtcctgctctgaacctaggtgtttcaatgggggcacttgccaacaagccctgtacttttctgattttgtttgtcagtgcccagagggatttgccggcaagtgctgtgaaatcgatacccgcgccacctgctatgaagaccagggtatctcttacagaggcacgtggtcaacagccgagtctggcgccgagtgcactaattggaactcaagtgccctcgcccaaaagccctacagcgggaggaggcctgacgcgatcagactcggactgggaaatcacaattactag

SEQ ID NO: 3978 - DNA, 474 bp, Artificial Sequence
  Description of Artificial Sequence: Synthetic coding sequence
atggacgccatgaagcggggcctgtgctgcgtgctgctgctgtgcggtgctgtgttcgtttcaccttctcaggaaattcatgcaagattccgccggggggcacgaagctatcaagtgatttgtcgcgacgaaaagacgcaaatgatctaccaacagcaccagagttggctgcggcctgttctccgttctaatcgcgtggaatattgttggtgcaatagcggacgggcacagtgccactccgtgcccgtaaaatcttgcagcgagccccggtgtttcaacggagggacctgccaacaagccctctatttctccgattttgtgtgtcagtgtccggaaggattcgccggcaaatgttgcgagatcgatacaagagccacatgctatgaggatcaaggaatctcgtaccgggggacgtggtcaaccgccgagtcaggcgcagagtgtaccaattggaatagcagcgccttggcctag

SEQ ID NO: 3979 - DNA, 1422 bp, Artificial Sequence
  Description of Artificial Sequence: Synthetic coding sequence
atggacgccatgaagcggggcctgtgctgcgtgctgctgctgtgcggggcggtgtttgtttccccatcacaggaaatacacgcaaggttccgtaggggagcccgttcttatcaagtgatttgcagggacgaaaaaactcagatgatctatcagcagcaccaatcctggctgcgaccagtcctccggagtaatcgcgtggagtactgttggtgtaattcgggaagagctcagtgccactccgttcccgtgaagtcctgttccgagcctcgttgtttcaacgggggaacgtgtcaacaggctttgtacttttctgacttcgtatgccaatgccctgagggttttgctggaaagtgttgcgaaatcgggaactcagattgctattttggaaatgggagcgcttaccggggcacgcacagtctcacggagtctggtgcctcttgcctgccatggaactcaatgattcttattggaaaagtatatacagcacaaaacccatcggcccaggcccttgggctggggaaacacaattactgtcgaaacccagacggcgatgcaaagccatggtgccacgtactgaagaataggcgacttacttgggagtactgtgacgtacctagttgctcgacatgtggcctaaggcagtactctcagcctcagttcagaatcaaaggggggttatttgccgatatcgccagtcacccatggcaggctgcgatttttgccaaacatcgtagaagcccaggggagcggtttttgtgtggcggaattcttatctcctcctgctggattcttagcgccgcccactgctttcaggaaagatttcccccccatcaccttacagttattctcggaagaacataccgcgttgtgcccggcgaggaagaacagaagttcgaagtggagaagtatatcgtccacaaagagttcgacgacgacacatatgataatgatatagccctccttcagctgaaatccgattcttcccggtgtgcgcaggagagcagcgtggtgaggactgtgtgcctgccccccgcagatctgcagcttcccgactggacagagtgcgaactaagtggatatgggaaacatgaggctctatccccattctactctgaacgtctgaaagaagctcatgtgagactgtatccttcgagtaggtgcaccagccagcatctcttaaatcgcacagttactgataatatgctctgcgctggtgacactcgatcaggtgggccacaggcaaatctccacgacgcctgtcaaggggattcagggggtccactggtctgcctgaatgatggcagaatgaccctggttggcattatctcctggggactgggatgcggtcaaaaggatgtgcctggcgtctacaccaaagtgactaattaccttgactggatacgcgataacatgcgcccatag

SEQ ID NO: 3980 - DNA, 1083 bp, Artificial Sequence
  Description of Artificial Sequence: Synthetic coding sequence
atggccggccacctggccagcgacttcgccttcagccccccccccggtgggggaggtgatggcccgggcggacctgagcccgggtgggtggatcctagaacctggctaagcttccagggaccgccaggggggccgggcataggccccggggttggaccaggcagcgaagtgtgggggatcccaccatgccctcccccttatgaattttgcggcggcatggcctactgcgggccacaggtcggagtggggctcgtgcctcaagggggtctggagacgtcccaacccgagggggaagccggcgtaggcgttgagagcaactccgatggtgcctcccccgagccctgtaccgtcaccccaggcgccgtcaagctggagaaggagaagctggaacagaaccccgaggagtcacaggacataaaagccctgcaaaaggaactcgagcagttcgccaaattgttgaaacaaaagaggataactctcggttacacccaggccgatgttggactcaccctgggagttctgttcgggaaagttttttcacagacaaccatttgcagatttgaggctctccagctgagtttcaagaatatgtgcaagttgcgtcctctcctgcagaaatgggtggaggaggcagacaataacgaaaacctgcaagagatttgcaaagccgagacactggtacaggctcggaaaaggaagcgcacatccattgagaatcgggtgcgcggtaacctggagaatctgtttctccagtgtccaaagcccacactacagcagatatcgcacatcgctcagcagctcggtctcgaaaaggatgtggtccgcgtttggttctgcaacagacgacaaaagggaaagaggtcgtccagtgactacgctcagcgcgaagatttcgaagctgccggctcacccttcagcggcggcccagtatcttttccattagccccagggccacattttgggacacccggctacggcagtccgcatttcaccgctctttacagctccgtgcccttcccagagggagaagcgttccccccggtgtctgtgaccacccttgggtcccctatgcatagtaattag

SEQ ID NO: 3981 - DNA, 798 bp, Artificial Sequence
  Description of Artificial Sequence: Synthetic coding sequence
atgcacttctaccggctgttcctgggcgccacccggcggttcctgaatcctgagtggaaaggtgaaatcgacaattggtgtgtgtatgtgctgacctctcttttgccctttaagattcagtcacaggacattaaggccctgcagaaagaactcgagcagttcgctaagctgcttaagcaaaaaagaatcacactaggctacacacaagcagatgtgggactcaccctgggcgtcctttttggaaaggtgttctcacagacaacaatttgtaggtttgaggccctccagttgagctttaagaatatgtgtaagctaaggcccctgctccagaagtgggtggaggaggccgacaataatgaaaaccttcaggagatctgcaaggcagaaacactggtgcaggctcggaagagaaagcgaactagcatagaaaacagagtgcgtggaaacctagaaaacctctttctccaatgtcccaagccaaccctgcagcagatctcccatatcgcacaacagcttggtctggaaaaggatgtggtccgggtgtggttttgtaaccggagacagaaaggcaagaggagctcatctgattacgctcagagagaggatttcgaagccgcagggtcccctttctcaggaggcccggttagcttccctctcgctcctggtcctcacttcggaactcccggatatggtagcccacactttacagcactctatagttcagtcccatttcctgagggggaagcgtttccccctgtttcagttacaacattaggttctcccatgcacagcaactag

SEQ ID NO: 3982 - DNA, 1083 bp, Artificial Sequence
  Description of Artificial Sequence: Synthetic coding sequence
atggccggccacctggccagcgacttcgccttcagccccccccccggcggagggggagatggcccgggtggacccgagcccggctgggtggaccccagaacatggctctcatttcaaggaccccctggaggacctggtatagggcctggggtaggacccgggagtgaggtgtggggtatcccaccctgtccgcccccttatgaattttgtgggggcatggcctattgtggcccacaggtaggtgtaggtctggtcccccaaggggggttggaaacctcccagcccgaaggagaggctggagtgggagtcgaatctaactctgatggcgcctctcctgaaccgtgtaccgtgactcccggtgcagtgaagctggagaaggagaagctcgagcaaaacccagaggagtcacaggatattaaagctcttcagaaagagttagaacagttcgctaagctccttaagcaaaaacgcatcactttgggttatacacaggcggacgtgggtctgacccttggagtgctgtttggaaaggtgttctcccagacaacaatttgtcgctttgaggcccttcagctgagtttcaagaatatgtgcaagctaagacctttgctacagaagtgggtggaggaagcagacaataatgaaaacctgcaagaaatctgcaaagccgagacgctggttcaggctcgcaaacgcaagcgaacaagcattgagaatagagtgagagggaacttggagaatctgttcctgcagtgccccaagccaaccctccagcaaatctcacacattgcccagcagctaggtctggaaaaagacgtagttagggtgtggttctgcaaccgccggcagaaaggcaagcgcagcagctctgattatgctcagcgggaggacttcgaggccgctggtagcccattttcgggaggtccagtgtcatttcctctggcgccagggccacacttcggtacacccggttatgggagcccccatttcaccgccctgtacagctcagtcccattccccgagggtgaggccttccctcccgtgtccgtaactactctggggagcccaatgcacagcaactag

SEQ ID NO: 3983 - DNA, 798 bp, Artificial Sequence
  Description of Artificial Sequence: Synthetic coding sequence
atgcacttctaccggctgttcctgggcgccacccggcggttcctgaaccctgagtggaaaggcgagattgataactggtgcgtctatgtcctgacctccctgctaccatttaagattcaaagccaggatattaaggcactccaaaaggaactcgagcagttcgcaaagcttttgaagcagaagcggatcactctcggctatactcaggccgacgtcggacttaccttaggggtcctcttcggtaaggtgttctctcagacgacaatctgtcgatttgaagccctgcagttgagcttcaaaaacatgtgtaagctacgccctctacttcagaaatgggtggaggaagcagacaacaacgagaacctgcaggagatctgcaaagctgaaaccctagtccaggcaaggaaacgaaagaggacctctatcgagaaccgcgtccggggcaatctcgagaatctgttcctccagtgccccaaacccactctgcagcagataagtcacatagcgcagcagctcgggctcgagaaagacgtggtgcgtgtctggttttgtaatagacgccagaaggggaaacggagttcctctgattacgcacaacgggaagacttcgaggctgcaggcagtcccttctcaggagggccagttagctttcctttagctccagggccgcattttgggactccaggttacggctcaccacatttcactgccttgtattccagtgtgccgttccccgaaggtgaggcattcccccccgtgtcagtgacaacactaggatcccccatgcacagcaattag

SEQ ID NO: 3984 - DNA, 798 bp, Artificial Sequence
  Description of Artificial Sequence: Synthetic coding sequence
atgcacttctaccggctgttcctgggcgccacccggcggttcctgaatcccgaatggaagggggagatcgacaactggtgcgtgtacgtcctgacctcgctacttccatttaagatccaatcacaggacattaaggccttgcagaaagaactggagcagttcgctaagttactgaaacagaagagaattacattgggatacactcaggctgatgtcggcctcactctgggggtgctgttcggtaaggtgttctcacaaactactatctgtaggtttgaggccctgcaactgtccttcaagaacatgtgcaagctgagaccacttttgcagaagtgggttgaagaggcagacaataacgagaacctgcaggaaatctgcaaggcagaaacacttgtacaggcgagaaagcggaagaggacctctatagagaaccgggtaagggggaacttagaaaatctatttttgcaatgtcctaaacccactctgcaacaaatatcacacatagcccagcagctaggactggaaaaagacgtcgtccgtgtctggttttgcaaccgccggcagaagggcaagcgatcctcaagtgactacgcgcagcgtgaggacttcgaagcagctggatcaccattctcgggagggcctgtgtcatttccccttgcaccagggccccatttcggtaccccgggctacgggtcaccgcactttaccgcactgtattcctctgtgcccttcccagaaggcgaggcgtttcctcccgtctccgtgaccactctggggtctccaatgcacagcaattag

SEQ ID NO: 3985 - DNA, 1083 bp, Artificial Sequence
  Description of Artificial Sequence: Synthetic coding sequence
atggccggccacctggccagcgacttcgccttcagccccccccccggcggtggcggtgatggccctgggggtcctgaacccggatgggtcgacccacggacttggctaagcttccagggacccccaggaggaccaggaatcggccccggcgtcggtcccgggagtgaggtctggggaatccctccgtgcccgcctccttatgaattttgcgggggcatggcctactgtggtccccaggtgggggtgggactggtcccccagggcgggctggagacgtcacaacctgaaggagaagcgggtgtcggagttgaatctaactccgatggcgcgtcaccagaaccctgcaccgtgacccctggggctgtgaagttagaaaaagagaagcttgaacagaatccagaggaaagccaggatataaaagctttgcagaaggaacttgagcagtttgccaaacttctgaagcagaagaggataacactcggttatacacaggcagacgttggacttaccctcggtgttctcttcggtaaggtcttttctcagactacaatctgtcgatttgaggccctgcagttgtctttcaagaacatgtgtaaactgaggcctctcttacagaaatgggtagaagaggccgacaacaatgagaatctgcaggagatttgcaaggcggagacgctcgttcaggcacggaagcggaaacgaacatcaattgagaaccgggtccgaggtaatttggagaacctgttcctgcaatgccccaaacctacactccagcaaatttctcacattgctcagcagctcggcctggaaaaagatgtagtgcgggtttggttctgtaatcgcagacaaaagggcaagcgttccagctcagattatgcccagcgagaagattttgaagcagcggggtctcccttttctggagggcccgtatcattccctctagcccctgggccacattttggcaccccaggctatggcagcccacacttcaccgccctgtatagtagcgtcccatttccagaaggggaggccttcccccctgtgtctgtgactaccctgggtagccccatgcatagtaactag

SEQ ID NO: 3986 - DNA, 1083 bp, Artificial Sequence
  Description of Artificial Sequence: Synthetic coding sequence
atggccggccacctggccagcgacttcgccttcagccccccccccggaggggggggggacggcccagggggtccggaaccggggtgggttgacccacgtacctggctttcatttcaagggcctccgggagggcccgggatcgggccgggtgtgggcccgggctcggaagtgtgggggatacccccatgccctccaccctacgaattctgcggcgggatggcctattgcgggcctcaagtgggcgtgggcctggtgcctcagggagggcttgagacttcccagccagagggtgaagccggcgtgggggtggaatctaatagcgatggagcttccccagaaccatgcacagtgacccccggcgcagtgaagttggaaaaggaaaagttggagcagaaccccgaggagagccaggacataaaagcactgcaaaaagagttggagcaatttgccaagctcctgaagcagaagcgcataaccttgggttacacccaggccgatgttggactgactctgggcgtcctgtttgggaaggtgttcagccaaactactatctgtagatttgaggccctgcagctctccttcaagaacatgtgtaagttgaggcccctgctgcagaagtgggtggaagaagcagataataatgagaatctgcaagagatctgcaaggcagagactttagtgcaagcacgaaagagaaaacgcacctcgattgaaaacagggtgagaggtaatttagaaaacctcttcttgcagtgccctaaacccaccctgcagcagattagccacattgcacaacagctggggctggaaaaggatgttgtgagagtgtggttctgtaaccggcgtcagaagggtaaaaggagctcatctgactacgcacaaagagaagattttgaggccgctgggagtcccttcagtggagggcctgttagctttccactcgcccccggaccccactttggcaccccggggtacggctctccacacttcaccgcattatattcaagcgtgcccttccctgaaggcgaggcgttccctccagtgtccgtgacaactcttggcagcccgatgcattcaaattag

SEQ ID NO: 3987 - DNA, 798 bp, Artificial Sequence
  Description of Artificial Sequence: Synthetic coding sequence
atgcacttctaccggctgttcctgggcgccacccggcggttcctgaacccggaatggaagggtgagattgataactggtgtgtgtacgtgctgacatcattgctgccgtttaagatacaaagccaggatattaaggctcttcagaaagaattagagcaattcgcaaaattgctgaagcagaagcgcattactctgggctacacccaggccgatgtgggcctaactctcggcgttttgtttgggaaggtttttagccagactaccatctgtcgatttgaggctctgcagctgagctttaagaatatgtgcaagttaagacccttattgcaaaaatgggtagaggaagccgacaacaatgagaatttacaggaaatttgtaaggcggaaaccctggtccaagccaggaagagaaagaggacgtctattgaaaatagagttcgcggcaacttggaaaacctatttttgcagtgcccaaagccaacacttcagcagattagtcacatagcccagcaactgggtctcgaaaaggatgtggtcagggtgtggttctgcaatagacgccaaaaggggaaaaggtcttcctcagattacgctcagagggaggatttcgaggccgccggtagccctttttcggggggccccgtctcgtttcctttggcacctggcccccactttgggacccctgggtacggttccccacactttaccgcattgtactccagtgttcccttccccgagggagaggccttcccgcccgtaagcgtgacaactctcgggtcccctatgcatagcaactag

SEQ ID NO: 3988 - DNA, 1083 bp, Artificial Sequence
  Description of Artificial Sequence: Synthetic coding sequence
atggccggccacctggccagcgacttcgccttcagccccccccccggaggtgggggggacggtcccggtgggccggagcctgggtgggttgacccgcggacttggctgtcttttcagggcccaccaggtggacctggcatcggacctggtgtgggacccggctctgaggtgtggggaattcccccttgcccccctccctatgagttttgcggcggaatggcttactgcggcccccaggtcggcgtggggttggttccacagggcggactggaaacctcccaaccagaaggggaggctggagtgggtgtggaatctaatagcgatggggcttctcccgagccttgcacagtaaccccaggtgcagttaagctcgagaaagaaaaattggaacagaatcctgaggaatcacaggatataaaagctctgcaaaaggagctggaacaattcgcaaaactcctcaagcagaagcggataactctcgggtacactcaggctgacgtcggcctcacgctcggggtgctgtttggtaaagtgttcagtcagactaccatctgtcgcttcgaggctcttcaactgtctttcaagaacatgtgtaagctacggcccctactgcagaagtgggtggaagaagcagataacaatgagaacttacaggagatatgcaaggctgagacgctagtgcaggctaggaagagaaaacggacctctattgagaacagggtccgggggaacctggaaaatctgttcttgcagtgccctaagccaacattacagcagatctcacatattgcccaacagctgggcctggaaaaagacgtagtgcgggtgtggttctgcaatcgacggcagaaaggtaagcgaagcagttctgactatgctcagagggaggatttcgaagccgccggtagcccgtttagtggaggccctgtatccttcccacttgcacccggcccccatttcggaaccccaggctatggttctccacacttcacagctctttactcctccgtgcctttccccgaaggggaggcattcccacccgttagcgtgactactctagggtctcctatgcactctaattag

SEQ ID NO: 3989 - DNA, 369 bp, Artificial Sequence
  Description of Artificial Sequence: Synthetic coding sequence
atggccggccacctggccagcgacttcgccttcagccccccccccggtggcggcggagatggtccgggcgggccagagcctggctgggtggatcctcgcacctggctttccttccaaggccctcccggtggaccaggcattggtccaggggtaggacccggctccgaagtatggggtatccctccttgccctccaccttatgaattctgtggcgggatggcatactgtggcccccaggtcggggtgggactggtgccacagggtgggttggagacttctcagcccgagggcgaagccggcggaggcgaacagctgaggtggggcctgccaggtgctcttcatagacacccctggtgccgagaagcttag

SEQ ID NO: 3990 - DNA, 798 bp, Artificial Sequence
  Description of Artificial Sequence: Synthetic coding sequence
atgcacttctaccggctgttcctgggcgccacccggcggttcctgaacccagaatggaagggagagattgacaattggtgtgtctatgtgctcaccagcctactgccatttaagatacagtcccaagacataaaagctttgcagaaggagttggagcagttcgccaaattgttaaaacagaaaaggataacattggggtatacccaagccgatgttggtctcacactgggcgtcctgttcggcaaggtattcagccagactacaatttgcaggtttgaggccctgcagctgtccttcaagaatatgtgcaaattaaggccgctcttacagaaatgggtggaagaagctgacaataatgagaacctccaggaaatctgtaaggcagagacactcgtgcaggctcgcaaacgaaaacgcactagtattgaaaacagagttcgcggcaacctggagaacctgttcctgcagtgcccgaaacccaccctccagcagatctcacatatcgcacaacagttgggcttggaaaaagacgttgtgagagtttggttctgcaaccggcggcaaaagggaaagcgctcctcatccgactatgcccagcgggaggattttgaggcagccggctccccattctccggaggacccgtgagctttcccctcgcgccgggccctcacttcgggacccccgggtatggaagccctcactttaccgctctctacagctccgtgccatttccagagggcgaagcctttcccccagtgagcgtcacaaccctgggaagcccgatgcattccaattag

SEQ ID NO: 3991 - DNA, 1083 bp, Artificial Sequence
  Description of Artificial Sequence: Synthetic coding sequence
atggccggccacctggccagcgacttcgccttcagccccccccccggagggggtggagatggtccaggggggccggaaccaggctgggtggatccgcgtacctggcttagcttccagggccctcccgggggtcccgggatcggtcccggagttggccctggctctgaagtatggggaattcccccttgccctcctccttatgagttctgtggcggcatggcctactgtgggcctcaagtcggcgtggggctggttccacaggggggattagagacaagccagcccgaaggcgaagctggcgttggcgtggagtccaacagcgacggggcctccccagagccttgcacagttacaccaggcgccgtcaagctggagaaagaaaagctggaacagaacccagaggagtctcaggatattaaggccctgcagaaagaacttgagcagtttgcaaaactgctgaagcagaagcggatcacccttggctacactcaggccgacgtcggactgacactcggtgttttgttcgggaaggtgttttctcagacaacgatttgtaggtttgaagctctgcagttgagttttaagaacatgtgtaaacttaggcctttgctgcagaagtgggtagaggaagcagataataacgaaaatctgcaggaaatatgtaaagctgagaccctagtacaggcccggaaaaggaagcgaacaagtatcgaaaacagagtacgcgggaatttggagaatctgtttttgcagtgcccaaagcctactttacaacaaattagtcatattgctcaacagctgggactggaaaaggatgttgtacgggtgtggttctgcaatagaaggcagaaaggcaagagaagctcctccgactacgcccagcgggaagactttgaggcagccggatctccatttagcggtggacccgtgagctttcctttggcgcccgggccccatttcggcactcctggatacggctcgccacatttcacagcactctactcctctgtgccattccctgagggggaggcctttcctcccgtatccgtgacaacattgggtagcccaatgcactccaactag

SEQ ID NO: 3992 - DNA, 372 bp, Artificial Sequence
  Description of Artificial Sequence: Synthetic coding sequence
atggccggccacctggccagcgacttcgccttcagccccccccccggtggtgggggagacggaccgggtgggccggagcctggatgggtagacccccgtacctggctgtcatttcagggaccacctggcggccctgggatcgggccaggagtcggacccggctcagaggtctgggggatccccccctgcccccccccgtatgagttttgtggcgggatggcctactgtggcccccaggtgggtgtggggctggtgccacaaggcggactggagacgtcccaacccgaaggagaggccggagtgggagtcgagacacctatgggacccccccggtcccccgccccccaccccttcccttttccacttttgtag

SEQ ID NO: 3993 - DNA, 558 bp, Artificial Sequence
  Description of Artificial Sequence: Synthetic coding sequence
atggccggccacctggccagcgacttcgccttcagccccccccccggcggtggaggtgatggccccgggggaccagaacctggatgggtagatcctcgcacatggctgagttttcaaggcccccccgggggccctggcatcggacccggcgttggtcccgggtccgaagtttggggcatccccccatgtccccccccatacgaattttgtgggggaatggcatactgcggccctcaggtcggggtcggacttgtgcctcagggtggcctggaaacgagccagcccgagggtgaagccggtgtaggggttgagtctaattccgatggcgctagcccagagccctgcaccgttacaccaggagctgtgaaactggagaaggagaagctggaacagaaccccgaggaatctcaggacataaaagccctgcagaaagaattggaacaattcgccaaactgctgaagcaaaagaggatcaccctggggtacactcaggcagacgtccatcccggcggctccatctgggagggcattcaacctaatgaccacttgcccctgtag

SEQ ID NO: 3994 - DNA, 372 bp, Artificial Sequence
  Description of Artificial Sequence: Synthetic coding sequence
atggccggccacctggccagcgacttcgccttcagccccccccccggaggagggggggacgggcctggggggcccgaaccgggctgggtggaccccaggacttggctctcttttcaggggccgcctggagggcctggaatcggacccggagtcggtcctgggagcgaagtgtggggcatccctccttgccctccgccctacgagttctgtggtggcatggcctactgtggcccccaggtgggggtggggctggttccccagggcggccttgagacaagccagccagaaggtgaagcaggagtcggagtggagaccccaatgggccccccacgaagcccagcgccacatccttttccctttccactgttgtag

SEQ ID NO: 3995 - DNA, 558 bp, Artificial Sequence
  Description of Artificial Sequence: Synthetic coding sequence
atggccggccacctggccagcgacttcgccttcagccccccccccggggggggcggcgatggtcccggaggtcccgaacccggctgggtcgatccccgcacctggctgagcttccagggtccacctggcggtcccgggattgggcctggcgtggggcccgggtcagaagtgtggggcattcccccctgcccccctccatacgaattttgcggagggatggcctattgcggcccgcaggtgggcgtcggtcttgtcccccagggcgggctggaaacaagtcaacctgaaggggaagccggcgtcggagttgaatctaactcagacggtgcatctcctgagccatgtactgtgactccgggcgccgtcaaattagaaaaggagaagttggagcagaatcccgaggagtcgcaggatatcaaagctctgcagaaggaactcgaacaattcgccaagcttctgaagcaaaagcgtattacacttggctacacccaagcagacgtacaccctggaggctcaatttgggaggggattcaaccgaatgaccacctgccattgtag

SEQ ID NO: 3996 - DNA, 372 bp, Artificial Sequence
  Description of Artificial Sequence: Synthetic coding sequence
atggccggccacctggccagcgacttcgccttcagccccccccccggcggcgggggcgacggaccgggaggacctgagccagggtgggttgatcctcggacctggctgagtttccaggggcccccaggcggcccaggaatcgggcctggggtgggtccgggatctgaggtctggggaataccgccctgcccaccgccttatgagttttgtggaggcatggcatattgtggaccacaggtgggggtaggcctggtaccacagggcgggttggagacgtcacaaccagaaggagaagctggcgtgggagtggaaacaccgatgggtccaccacgctcacccgccccacatccgttcccttttcccctgctgtag

SEQ ID NO: 3997 - DNA, 558 bp, Artificial Sequence
  Description of Artificial Sequence: Synthetic coding sequence
atggccggccacctggccagcgacttcgccttcagccccccccccggcggggggggggatggccccgggggacctgaacccggatgggtcgatcctaggacctggctaagttttcagggacctcccggagggcccggtatcggacccggagtcggtcctgggagcgaagtgtggggaatacctccttgtccaccaccttacgagttctgtggcggcatggcctattgcggtccacaggtgggcgttgggctggtgcctcagggtggtctcgagacatctcagcccgaaggcgaggccggagtcggagtggagtcgaatagcgacggcgcttctcccgagccttgcaccgttacacccggggcggtgaagcttgaaaaagagaagctggagcagaacccagaagaatctcaggatattaaggccctgcagaaagaattagaacaattcgcaaaattactgaagcagaaacggatcacgctggggtacacccaggccgatgtgcacccaggtggcagcatttgggaggggatacagcccaacgatcatctccctttgtag

SEQ ID NO: 3998 - DNA, 558 bp, Artificial Sequence
  Description of Artificial Sequence: Synthetic coding sequence
atggccggccacctggccagcgacttcgccttcagccccccccccggcggaggaggggacgggcccggaggcccggagcccgggtgggtggaccctagaacgtggctctccttccaagggcctcctggtggaccgggaatcggtcctggagtcggacccggtagcgaggtttggggcatccctccctgcccaccaccctacgaattctgtggaggcatggcgtactgtgggccacaggtaggcgtaggactagtgccccaggggggtctggagactagtcagccagagggagaggctggggtaggcgtggaatcaaactccgacggggctagcccagagccttgcactgtaactcccggagcggtcaagctggaaaaggagaaactggaacagaatccagaggaatcccaggacattaaagcgctgcagaaagaactcgagcaatttgccaagctgcttaagcagaagaggatcaccctggggtatacccaagctgacgtgcacccgggcgggagtatttgggagggaattcagcccaacgaccatctgcccttgtag

SEQ ID NO: 3999 - DNA, 372 bp, Artificial Sequence
  Description of Artificial Sequence: Synthetic coding sequence
atggccggccacctggccagcgacttcgccttcagccccccccccggtggaggaggtgacggcccgggcggccccgagcctggatgggttgacccccggacttggctgagctttcaagggcccccaggtggccccggaatcgggcctggggttgggccgggatctgaggtgtggggcatccccccgtgtcctccaccatatgagttctgtggaggtatggcgtactgcggcccccaggtcggcgtgggtctggtgcctcagggcggattggaaacaagccagcccgaaggcgaagcaggcgtgggcgtagagacccccatgggcccacctaggagccccgctccccacccttttcctttccctctcctctag

SEQ ID NO: 4000 - DNA, 372 bp, Artificial Sequence
  Description of Artificial Sequence: Synthetic coding sequence
atggccggccacctggccagcgacttcgccttcagccccccccccgggggggggggcgacgggcccggaggccccgagccaggttgggtagatccccgtacctggctgagctttcagggcccaccaggaggcccaggcattggcccaggggtggggcctggttctgaggtctggggaatacccccctgccccccaccatatgagttttgcggcggaatggcttactgcggacctcaggtgggcgtgggcctggtgccgcaaggaggcctcgaaacatcccaaccagaaggagaagccggagtgggggtcgaaacccctatgggcccccctagaagtcccgcaccgcacccatttccttttcccctgttgtag

SEQ ID NO: 4001 - DNA, 2079 bp, Artificial Sequence
  Description of Artificial Sequence: Synthetic coding sequence
atgggcaccgtgagcagccggcggagctggtggcccctgcccctgttgctgctgcttttgctcctcctgggtcccgcaggtgctagagctcaggaagacgaggatggcgactacgaagaactagtcttggcactgagatccgaggaggacgggttggccgaagcgccagagcacggcacaacggcaacattccatcgatgtgcaaaagacccttggcggctccctggaacctacgtggtggtgctgaaggaggaaactcacctgagccagtccgaaagaacagccaggaggttgcaagcacaagctgctagaaggggctaccttactaagattctgcacgtgtttcacggtcttctgcccggctttcttgtcaagatgtcgggcgacctcctcgaactggcccttaagttaccccacgtggattacatcgaagaggactcatccgtgttcgcccagtctattccatggaatctagagaggatcacacctcctcggtaccgtgccgacgagtaccagccccccgatgggggcagtctcgtggaggtctacctgttggataccagcattcaatccgaccacagagagattgaggggcgggtcatggttacagacttcgaaaacgtgccggaggaggatgggacccgctttcatcgccaggcttccaagtgtgacagccacggcacacatttggcaggagtggtcagtggtagggatgccggagtggcaaagggcgcctcaatgagaagtctgagagtcttaaattgtcagggtaagggcaccgtgagtggcacactgatcgggttagagttcatccggaagtctcagctggtgcagcctgttggcccactcgtcgtgctcctgccactagccggcggatattctcgggtcctgaacgctgcttgccagcggctggcaagagccggggtcgtcctcgttacagccgctggtaattttcgggacgacgcctgcctgtattctcccgcatctgcccccgaggtgatcactgtcggagcaacgaacgcacaggaccagccagtgaccctgggaaccctgggtaccaattttggccgctgcgtggacttgtttgcccccggcgaagatataattggagcctctagcgactgtagcacttgttttgtcagtcagtcaggtacctcccaggcagcagcccacgtagccggaatcgctgccatgatgctctccgcagaaccagaactcacactggccgagctaagacagcggctgattcactttagcgctaaggatgtaatcaacgaagcttggttccctgaggaccagagggtcctgacaccaaatctagtcgcggccctcccaccctctacacatggggccgggtggcaactattttgcaggaccgtgtggtcagcgcactccggccccacgcgcatggccacagcagtagcccgatgcgccccggatgaagagctactctcctgcagctcattcagtcggtccggcaagcgcagaggggagaggatggaagcccaggggggaaagttggtgtgtagagcacacaacgcttttggcggagagggggtgtatgcaattgcccgatgttgcctcctccctcaggcgaattgttctgtccacacagcgcctccagcggaagcgagcatggggactcgagtacattgccatcaacagggacacgtgctgacgggctgctcatcacactgggaggtggaggacctgggaactcataagcccccggtgcttcggccccgcggacagcccaaccagtgcgtggggcaccgagaagccagcattcacgctagctgctgtcacgcccctggtttggaatgcaaggtgaaagagcacgggattcctgctccccaggagcaggtcacagtggcctgcgaggaggggtggaccttaactgggtgttccgcgcttccaggcacctctcacgtcctcggggcctacgccgtagacaacacatgcgtggtgcgatcccgggacgtgagcacgacgggaagcactagcgaaggggccgtgacagctgttgcaatttgctgtaggtctaggcacctcgctcaggccagccaggagctccagtag

SEQ ID NO: 4002 - DNA, 618 bp, Artificial Sequence
  Description of Artificial Sequence: Synthetic coding sequence
atgggcaccgtgagcagccggcggagctggtggcccctgcccctgctgctgttacttctactccttctcggccctgccggggccagagcccaggaggacgaggatggcgattatgaagagctggtgctggctcttagatctgaggaggatggcctggccgaggcgccagaacacgggaccactgcaaccttccacagatgcgccaaggatccatggaggctgcctggcacgtatgtggttgtcttgaaggaggagactcatctgtcccagagtgaacgaaccgctcgacgtctgcaagcgcaggctgccaggcgcggatacctaacgaaaatccttcatgtgtttcacggattgctccctggttttctggttaaaatgagcggcgatcttctggagctggcgctgaaactccctcatgtcgattacattgaagaagatagctctgttttcgcccagagcataccatggaatttggagcggataacaccgccccggtacagagcggacgaataccagccgccagcctatctcgaggaccactgtggcggacaccggggggccgtgcaaatggctttgcagaaaactcaggagaccctcgggcaggagcaattcgattag

SEQ ID NO: 4003 - DNA, 801 bp, Artificial Sequence
  Description of Artificial Sequence: Synthetic coding sequence
atggtgaccgacttcgagaacgtgcccgaggaggacggcacccggttccacagacaggcaagcaagtgcgacagccacggaactcatcttgcaggtgtcgtcagcggtagggatgcaggggtggccaagggagcaagtatgcggagcttaagggtgctgaactgccagggcaagggcactgttagcggcaccttaatagggcttgaattcatcaggaagtctcagctggttcagccagtaggccctctcgtcgttttgctgccactggccggcggatattcccgcgtactcaatgctgcatgtcagcgactggctagggccggcgtagttctggtcactgccgctggcaacttccgggacgatgcctgtctgtactctcctgcctccgcccccgaagtgattaccgttggcgcaactaacgcccaggatcaacccgtgacacttggcacactcgggaccaatttcgggaggtgtgttgatttatttgctccaggcgaagatatcataggtgcatctagcgactgtagcacgtgtttcgtgtctcaatccggtaccagccaggcagcagcccatgtggccggcatagccgccatgatgctaagtgctgaaccagagctgacactggccgaactcaggcagcgcctcattcatttttccgccaaggacgtaattaatgaagcctggtttcctgaggatcagcgagtgggaagctgttttgctgggttatacgggcagcatacccgcggtctccacggctggcctcagccttcccccgcagcccctcagatgagaagctgttag

SEQ ID NO: 4004 - DNA, 3972 bp, Artificial Sequence
  Description of Artificial Sequence: Synthetic coding sequence
atggaggacggcggcctgaccgccttcgaggaggaccagcggtgcctgagccaatccctcccacttcctgtctccgccgaaggacccgcagcacagaccacagctgagccttctcgatcttttagcagtgctcatcggcaccttagccgaagaaacggactttcgagactgtgccagtccaggacagccctttctgaggaccgctggtctagctactgcttgtccagccttgcagcacagaacatctgtacatcgaaattacactgtcccgcggcaccagagcatacggatccttccgaaccacggggatcagtttcatgttgctccctgctacggggcctcagtagcggatggtcttcgccactgctgccagcgccggtttgcaatcccaacaaggcaatcttcaccgtggatgccaagactacagaaatcctggtggccaatgacaaggcttgtggactactgggttactcatctcaggatctgattggacagaaactgacccaattctttctgagatcggatagcgatgttgtcgaggccctgagtgaggagcatatggaagctgacgggcacgcagcggttgtattcgggactgttgtggacatcatcagtcggtctggggaaaaaattccagtgagcgtatggatgaaaagaatgcgccaggagcgcagactttgttgtgttgtggtcttggaaccagttgagcgggtatctacctgggtggctttccagagtgatggcaccgtgacatcctgcgattccttgttcgcccatctccatggctatgtatcgggtgaggacgtggctgggcagcatatcactgatctaatcccatccgtccaactgccgccatctgggcagcatattccaaagaatctgaaaattcagaggtcagtcggccgcgcacgggatggaacgacattccctctctccctgaaactgaaatcccagccgagttctgaggaagcgactactggcgaggcagctccggtatccggatatcgcgcatctgtctgggtgttctgtactatcagcgggttaattaccttgctgccagacgggactattcacggcatcaaccacagtttcgctctgaccctgtttggctatggcaagacggaactccttggcaaaaacatcacttttctgatccctggcttctacagctatatggacctcgcttataactctagcttacagcttcccgatctggcttcatgccttgacgtgggcaatgagagcggctgtggagaacggacgctcgacccttggcagggccaggaccccgccgaaggcggccaggaccccaggatcaacgttgttttggccggtggtcatgtagtcccaagggacgagatacgaaagctaatggagagccaagacatattcacaggcactcagaccgaactgatagccggcggccagctgttgtcatgcttatccccacagcccgcacctggcgtggataacgtcccagaggggtctcttccagtgcatggtgaacaagccctgcctaaggaccagcagattaccgccctcggaagagaggaacccgtcgctatagaaagcccaggccaggacctcctgggagagagtcgtagtgagcctgtcgacgttaaacccttcgcgtcatgtgaagatagcgaagcacctgtgccggccgaggacggaggcagtgatgcagggatgtgtgggctgtgccagaaagctcagcttgaacgcatgggggtcagtggacccagcggttccgacttgtgggccggggctgctgtcgcgaagcctcaagcaaaaggccaactggctggtggctctctgcttatgcattgtccctgttacggtagcgagtgggggctgtggtggcgtagccaggacttggccccttcgccaagtggaatggctggcttgtcgtttggcacgcctactctggatgagccatggctgggggtggagaatgatcgggaggaactgcagacctgcctgatcaaggaacagctgagccaactgtctttagccggggcattggacgttccgcatgcagagctcgttcccaccgaatgccaagctgtcacagcgccggtgtcatcatgtgacctcggggggcgagacctgtgtgggggatgcaccggatcgagctctgcctgctacgccctggccaccgatctgcccgggggcctggaagctgtggaagctcaggaagtggacgttaatagtttttcttggaacttgaaagagctgtttttttctgatcagactgatcagaccagctcaaactgctcctgcgctactagcgagttaagggagacaccttccagcctcgctgttgggtctgaccccgacgttggttcactgcaagagcaaggcagctgcgtcctcgatgaccgagaactgctcctgctcacaggtacgtgcgtcgacctcgggcagggccggcgcttccgcgaaagttgcgtcggacacgacccaactgaaccactggaagtatgtctggtgtccagtgagcattatgccgctagtgatagagagagcccaggacatgtcccctctactctggatgccggtcctgaggacacttgccctagcgctgaggagccccgtttaaatgttcaggtcacctcaacacccgtgatcgtcatgagaggcgccgctggtcttcagagagagatccaggagggcgcctacagcggaagctgctaccacagagacggactgcgcttgtccattcagttcgaggtgcgaagagtggagctgcagggtcccacccccctgttctgttgttggcttgttaaagatctcctgcatagccaaagggattctgccgcccgcaccaggctgttccttgctagcttaccaggctcgactcactccaccgccgcggaactaacagggccgtcactggttgaggtgctccgtgccagaccttggttcgaggaaccacccaaagctgtggagttggagggcctggccgcatgcgagggggaatacagccaaaaatactcaacaatgtctccacttgggtccggcgcctttggattcgtgtggaccgcagtggataaggaaaaaaacaaggaggtagtggtcaaatttatcaagaaagaaaaagtgcttgaagactgttggattgaggaccctaagctgggaaaagtgactctcgaaatcgcaatcttgagtagagttgagcatgcaaacattataaaggtcctggatatcttcgaaaaccagggctttttccagctggtcatggagaagcacggctctggcctggacttgtttgcttttattgaccgtcatccccgcttagacgagcccctggcgtcatatatcttccgccagctggtgagtgcagtgggctatctgcgactgaaggacattattcaccgggacattaaggatgagaacatcgtcattgctgaagacttcactatcaagctcattgattttggatctgctgcttacctcgagcgcggtaagttgttctatacattttgcggcacaatcgagtattgcgctcccgaagttttgatgggcaacccatatagaggccctgaactggagatgtggtcactgggggtgaccctgtatacgctggtgttcgaagagaacccgttttgtgaattagaggagactgtcgaagcggcgatccatccaccttatctcgtatcaaaggagctcatgagcctggtgtctggattgctgcagcccgtcccagagcgccggacgaccctggagaagttggttaccgatccttgggttactcagcccgtcaacttagccgattatacatgggaagaggtgttccgagtcaacaagccggagtccggagtcctttcagccgccagcctggaaatgggcaataggtcacttagtgacgtcgcccaggcccaggagctctgcggtggccctgtgccgggcgaagcccccaacggacaagggtgtctgcaccccggggaccctagacttctgactagctag

SEQ ID NO: 4005 - DNA, 1488 bp, Artificial Sequence
  Description of Artificial Sequence: Synthetic coding sequence
atgtggcagctgaccagcctgctgctgttcgtggccacctggggcatcagtggtacccccgcacccctggacagcgtgttcagttcgtcagaaagggcacaccaggtattgcgaatcagaaaaagagccaattcatttctagaggaactccgccacagctcccttgagagggagtgtattgaagagatttgtgattttgaagaagcaaaggaaatatttcagaacgtcgacgataccctggccttctggtccaagcacgtggacggcgaccagtgccttgtgctgccactggagcatccttgcgctagcctctgttgcggtcacggaacctgtatcgatggcataggctcttttagctgtgattgcagatcgggatgggagggccgcttttgccagcgcggagagggcgaaagatggatgctagccggaggaggagccggcctgggaccgggatgggggagaggtacctctacatcttgtcctcgacccccactgcctgctgaagttagctttctgaattgttcactcgataatggtgggtgtacacattattgcctggaggaggtcggctggcggaggtgcagttgtgcaccagggtataagctgggcgatgacctgctgcagtgccacccggccgttaaattcccatgtggacggccttggaagcgcatggaaaagaagcgcagccatctcaaacgagataccgaagaccaggaagatcaagtcgatccacgcctcatcgatggtaaaatgacgaggaggggagacagcccgtggcaggtggtcctgctggacagcaagaagaaactggcatgtggcgccgtgctgatacacccatcatgggtgctcactgcagcacattgcatggatgagtctaagaagttactggtgcgactcggcgaatatgacctccgtcggtgggagaagtgggaacttgacctggatatcaaggaagtgttcgtgcatcctaactattcgaaatccacaactgacaacgacatcgctctgctgcatctggcgcagccagcaacacttagccagacgatcgtgcccatctgtctgcctgacagtggtctcgctgagcgggaattaaaccaggctgggcaggaaaccctggttaccggctggggttatcactcctcgagagagaaggaagcaaaaagaaaccggacctttgtgttgaacttcattaaaatcccggtggttccccataacgaatgcagcgaggtaatgtcaaacatggtgtcagagaatatgttatgtgccggcattctcggagaccgccaggatgcttgcgagggtgacagcggggggccaatggtcgccagcttccacggtacctggttcctcgtgggtttggtctcatggggagaaggttgcggactcctgcataattacggtgtttacaccaaggtcagccgctatctcgactggattcatggccatatccgagacaaggaggcacctcagaagagttgggccccttag

SEQ ID NO: 4006 - DNA, 1386 bp, Artificial Sequence
  Description of Artificial Sequence: Synthetic coding sequence
atgtggcagctgaccagcctgctgctgttcgtggccacctggggcatctcaggcactccagcgcctctcgacagtgtcttcagcagcagtgagagagctcatcaagtgctgcgtattcgcaaaagggccaatagcttcctcgaagaactgcgacatagcagtctggagcgcgagtgtatcgaagagatctgcgacttcgaagaggccaaggagatatttcagaacgtagacgataccttagccttttggtcaaagcatgtggacggcgatcagtgtcttgtgctgcccttggaacacccatgcgctagcttgtgctgtgggcacggaacatgcatcgacgggattggctctttttcttgcgattgccgatcaggctgggagggccgcttttgccaaagagaggtgagctttctgaactgtagtctcgataatggcggctgcacacattattgcctagaggaagtgggctggcggcggtgttcctgcgcccctggatacaaactgggagacgatctgttacagtgtcatcctgcagtgaaatttccttgtggaaggccttggaagaggatggaaaagaaaaggtctcatctcaaaagagatactgaggatcaggaggaccaggtcgatccacgtttgatcgacggcaagatgaccagacgaggtgactccccatggcaagtcgttttgttggattccaagaagaagctcgcctgtggcgcagtattgattcacccctcatgggttctgaccgctgcacattgtatggatgagagcaaaaaactgctggtgagacttggcgagtacgacctacggcgatgggagaagtgggagctggacctcgacattaaagaagtgttcgtgcatccaaattacagtaagtctacgaccgacaatgacatcgcgctgctgcacctggctcaacccgccacacttagccaaacaattgtgcccatttgcctgcctgatagcgggctggctgagagggagttgaaccaggccggccaggagaccctggtgaccggttggggctaccactcttctagagaaaaggaggcaaagcgcaatcgaacatttgtgttgaactttatcaagatcccagtagtgcctcacaacgagtgctccgaagtgatgagtaatatggtgtcggagaatatgttgtgtgcgggtattttaggagatcggcaggatgcttgtgaaggggacagtggagggccgatggtcgctagctttcatgggacctggtttctggttggcctcgtgtcttggggggaagggtgcgggcttctccacaattacggcgtgtatactaaggtgagccgatatcttgactggatccacggacacatccgagacaaggaagcgcctcagaaatcttgggccccctag

SEQ ID NO: 4007 - DNA, 351 bp, Artificial Sequence
  Description of Artificial Sequence: Synthetic coding sequence
atgtggcagctgaccagcctgctgctgttcgtggccacctggggcatatctgggacacctgcccctctggatagtgtgttctctagtagcgagagagcgcatcaggttctgcggatacgtaaaagggccaattcttttttggaagagcttcggcattcgagcttagagcgagaatgtattgaggaaatttgtgactttgaagaggctaaggagatttttcaaaatgtggacgacacactggccttttggtctaagcacgtggacggagaccaatgtctcgtattacctttagaacatccttgtgcctccctatgctgtggacacggcacctgcatagatggtatcggctag

SEQ ID NO: 4008 - DNA, 381 bp, Artificial Sequence
  Description of Artificial Sequence: Synthetic coding sequence
atgtggcagctgaccagcctgctgctgttcgtggccacctggggcatctctggcacccccgcccctcttgattcggtgttcagtagctcagaacgagcccaccaggtcctccggataagaaagcgtgcgaattcattcctggaggaactgagacatagttcgctggagcgcgaatgcattgaagagatatgtgattttgaagaggcaaaggaaattttccagaatgtggatgacaccctggctttctggtccaaacatgtggatggcgatcaatgcctcgtcttgccactagagcatccttgcgcgagcctatgttgcggccatggcacatgcattgatggaattggttcattcagctgcgactgtaggtctgggtggtag

SEQ ID NO: 4009 - DNA, 1551 bp, Artificial Sequence
  Description of Artificial Sequence: Synthetic coding sequence
atggccgccggccggcggacctgcagcatcagcaccacccggccctgcgcaagcgcctctaggatgtggcagctcacatctctgctgctcttcgtagcaacttgggggatttctggtacccctgcccccctcgacagtgtcttcagcagttctgagcgagcacaccaggtgcttcggatcagaaaaagagcaaattcgttcctcgaggagttaagacacagttcactggagagggaatgcatcgaggaaatctgcgatttcgaggaggccaaggaaatctttcagaatgtggatgacactctcgcattctggagtaagcacgtggacggtgaccagtgcctcgttttgcccctggagcatccatgcgccagcctgtgctgcggacacggcacgtgcattgacggcatcggtagcttctcttgcgactgccggtcagggtgggaggggcgcttctgtcagcgcggagagggtgagcgctggatgcttgcaggtgggggggcagggctcgggcccggctggggtcggggtacctcaacatcctgcccacggccacccctgccagctgaagtctcgtttctaaactgttccctagacaacggggggtgcacacattattgtctggaagaagtgggttggcgccgatgtagctgtgcccccggctataagctcggtgacgatctgctccaatgtcaccccgcagttaagttcccttgcgggcggccatggaagagaatggagaaaaaaagatctcacttaaaacgggatactgaggatcaggaggaccaagtggaccccaggctgatcgacggaaagatgactcggaggggggacagtccctggcaggtggtgctgcttgacagcaaaaagaagctcgcgtgtggtgccgtgttgatccacccctcatgggttcttaccgccgctcattgtatggatgagtcaaaaaagctgctcgtgagactgggcgagtacgatctgcgacggtgggaaaaatgggaacttgacttggacattaaagaagtctttgtccatcccaattattccaagtcaaccaccgataatgacatcgccctactccacctcgcccaaccggcgacactgtctcagacgatcgtgcccatctgtctgccagacagcggtctggcggagcgagaacttaatcaagcggggcaagaaacattagtgacaggctggggataccactcttcccgagaaaaagaggccaagagaaaccggacctttgtgttgaatttcataaagataccggtcgtgccccataatgaatgctcagaggtcatgtccaacatggtcagcgagaacatgctttgcgccggcatcctgggagatagacaggacgcatgcgagggcgatagcgggggacccatggtcgcgtcttttcatggcacgtggttcctggtggggctggtgtcctggggcgagggatgcggccttctgcataactacggtgtgtacacaaaggtgagccgatacttggactggattcatggtcacatacgcgacaaagaggcccctcagaagtcttgggctccatag

SEQ ID NO: 4010 - DNA, 1263 bp, Artificial Sequence
  Description of Artificial Sequence: Synthetic coding sequence
atgtggatgacccactggcccagcggccccagcaccagcaccgtgacttcagcctggagctgcccctggagcaccagagcccccgcgtgcgcggcgggcaccgctcgcgctagcactgcctccgccgcatccgcggctactgccgccgctgccggaagagctgcgtctgctagcgccgtccgcggtaggggaggctgttggaggggtggagctggcttaggacccggttggggccgtggcacttcaacctcatgcccacggccaccgcttcctgctgaggtgagcttcttgaactgctccttagacaatggcggttgcacccattattgtcttgaggaggtggggtggcgcaggtgtagttgtgcacccgggtacaagctcggcgatgacctgttgcaatgtcatccagctgttaagttcccttgtgggagaccttggaaaaggatggagaaaaaaaggtcacatttgaagagggacacggaggatcaagaagatcaggtggatccgagacttatcgacggcaaaatgacccgccgtggagactcaccttggcaggtggtgctcctggattccaagaagaagttagcctgcggcgccgttctgatccacccttcatgggttctgaccgctgctcactgcatggacgaatctaaaaagcttctcgttcgactgggggaatatgaccttagacgctgggagaaatgggaactggacctggatattaaggaggtgtttgttcatcctaattactcaaaatccacaaccgacaacgacattgcccttctccacctggcccagcctgctaccctgagccaaaccatagttcccatatgcctgccggacagcggccttgctgagcgggaactcaaccaggcgggccaggaaaccctggttaccggctggggttaccacagcagcagggaaaaagaggccaagcgcaatcgaacctttgtgctgaatttcatcaagattccggtggtgccacacaacgaatgttctgaagttatgtcgaatatggtatcagaaaacatgctgtgcgcgggtattctgggggaccggcaggacgcatgtgagggcgatagtggtggcccaatggtcgcaagcttccacggtacttggttcctggtcggcctggtgtcctggggagaaggctgcggcctgctacacaattatggcgtgtacactaaggttagtcgttacctcgactggattcatggacatataagggataaggaagcacctcagaaatcttgggctccgtag

SEQ ID NO: 4011 - DNA, 354 bp, Artificial Sequence
  Description of Artificial Sequence: Synthetic coding sequence
atgccccggctgttcttcttccacctgctgggcgtgtgcctgctgctcaaccaattcagtagggcagtggccgacagctggatggaagaggtgataaagctgtgcggccgcgaactggtgcgcgcccaaattgctatctgtggcatgagcacttggagcaagagatccctgtcccaggaagatgctcctcaaactccaaggccagttgccggagactttatccagacagtatctctaggaatcagccctgatggaggtaaagccttaaggaccggctcatgttttacccgggagttcttaggcgctctctccaagttatgccatcctagctcaacgaaaattcaaaagccctag

SEQ ID NO: 4012 - DNA, 558 bp, Artificial Sequence
  Description of Artificial Sequence: Synthetic coding sequence
atgccccggctgttcttcttccacctgctgggcgtgtgcctgctgcttaaccagttctcccgcgccgtcgctgatagttggatggaggaagtgattaagctgtgtggaagagagctggtcagagcacaaatcgcaatttgtgggatgagcacctggtccaaaagaagccttagtcaggaagatgcacctcagactccacgaccagtcgcagagatcgtgccctctttcattaacaaggacaccgagacgatcaatatgatgagcgaatttgtggctaacctgccccaagaactgaaactgactttgtcagaaatgcagccagccttgccacagctccagcagcacgtgccggtgctgaaagactctagcctcctgttcgaagagttcaagaagctgattcggaatcggcagtctgaagccgccgacagcagcccgtccgaactgaaatacctgggcctggacacacacagtcgcaagaagaggcagctctactccgcactggctaataaatgctgccatgtgggttgtacaaagcggagtctggcacgtttttgctag

SEQ ID NO: 4013 - DNA, 1047 bp, Artificial Sequence
  Description of Artificial Sequence: Synthetic coding sequence
atgaacggcaccgagggccccaacttctacgtgcccttcagcaacgctaccggggtcgtgaggtcacctttcgagtacccccagtactacctcgccgagccatggcagttctccatgctcgctgcatacatgttcctgctcatcgttcttggattccctataaacttcttgactctgtatgtgaccgttcagcacaaaaagctgagaactcccctcaactacatcctcttgaacctggctgtggccgacctgttcatggtacttggtgggttcaccagcactctgtacacatcgctccatggatatttcgtatttggccccaccggctgtaacctcgaaggcttcttcgcaacgcttgggggcgagatcgccctctggtctctggtagttctcgccatcgagcggtatgtagttgtctgtaagccaatgtcgaactttcgatttggggagaaccacgctattatgggagtagctttcacatgggtcatggcactggcttgcgcggcgcctcctctggctggctggagccggtatattcctgagggcctccagtgttcttgcgggatcgactactacacactgaagccagaagtcaataatgagtcattcgtaatttatatgtttgtggtgcacttcactatccctatgatcataatattcttttgttacggccagctggtcttcaccgtcaaggaggctgctgcccagcagcaggaaagcgccaccacacaaaaagcggagaaagaagtcacacgcatggtgattataatggtgatcgcctttctcatatgctgggttccgtacgcttccgtcgctttttacattttcacgcaccagggttccaacttcggacctattttcatgacaatccccgctttcttcgctaaaagtgctgccatttataaccctgtcatttatatcatgatgaacaaacagtttcgtaactgcatgttgaccacaatctgctgcggaaagaatcctctgggggatgacgaggccagtgccacggtcagcaagactgaaacgtcacaggtggcgccggcatag

SEQ ID NO: 4014 - DNA, 1257 bp, Artificial Sequence
  Description of Artificial Sequence: Synthetic coding sequence
atgcccagcagcgtgagctggggcatcctgctgctggccggcctgtgttgcctcgttccagtgagcttggccgaggatccgcagggggacgccgctcagaaaactgacaccagtcaccacgaccaagatcaccccacattcaacaaaatcaccccaaatctggccgagttcgccttcagtctttatcgccagttggcccatcagtcaaattccacaaacatctttttttctccagttagtatcgctaccgccttcgctatgctgtctctgggcacaaaagctgacactcatgacgaaattttggaaggcttgaattttaacctcactgagattcccgaggcgcagattcacgaggggttccaggagcttctgcgcacactgaatcagccagactcacagctacaactgacaaccggaaatgggctgtttctttctgaaggccttaaacttgtggataagtttctggaggacgtgaaaaaactgtaccattctgaggcctttacagtgaatttcggagacactgaggaggctaaaaagcagattaatgactacgtggaaaagggcactcaaggcaaaatagtggacctggttaaggagttggatagagataccgtgtttgctttggtcaactacatcttcttcaagggtaagtgggaacgcccattcgaggttaaggacactgaggaggaagactttcatgtcgaccaggtgacaactgtcaaagttcccatgatgaagagattgggtatgttcaatatccagcattgtaaaaagctctcctcctgggtgctgctgatgaaatatctgggtaatgctaccgcaatattttttctacccgacgaagggaaactgcagcacttagagaatgaactgacacacgatatcatcactaagtttcttgagaacgaagaccgtaggtctgcttcccttcatctgcctaagttgtcaataacggggacgtacgacctaaaatctgtcctgggccagctaggcatcacaaaggtcttcagcaatggagctgacttgagcggagtgaccgaggaagccccactgaaactgagtaaagctgtccataaagccgtgctaaccatcgacgaaaaaggcaccgaggctgcaggggcgatgttcctcgaagccattcctatgagcattccgcctgaggtgaagtttaataagcccttcgtctttctcatgatcgagcagaacactaaatccccattgtttatgggcaaggtcgtaaacccaacccaaaagtag

SEQ ID NO: 4015 - DNA, 1257 bp, Artificial Sequence
  Description of Artificial Sequence: Synthetic coding sequence
atgcccagcagcgtgagctggggcatcctgctgctggccggcctgtgctgtctcgtgccagtgtctctagccgaggacccccagggagatgccgctcagaaaacagatacatcccaccacgaccaggaccaccccacctttaataaaattaccccaaacctagcagagttcgcattcagcctgtacaggcagctcgctcatcagtccaattccaccaatatttttttttctcctgtgagtatcgccaccgccttcgccatgctcagcttaggaacgaaggccgatacccacgacgagatcctggaggggttgaactttaacctcacggagataccagaggcacagattcatgaaggctttcaggagcttctcaggacccttaaccagccagactcccaacttcagttgactaccgggaatggactgtttctcagtgaggggctcaaactcgtggataagttcctggaagatgtgaagaaactgtaccactcagaggcatttactgttaactttggtgacacagaagaggctaaaaagcagatcaatgactatgtggaaaaaggaacacagggaaaaattgtagatcttgttaaggagctggacagggatacagtgtttgcactcgtgaattacattttctttaagggcaaatgggaacggcccttcgaggtgaaggatactgaagaagaggatttccacgttgaccaggtgacaactgtcaaggttcctatgatgaaaaggctaggtatgttcaacatccaacactgcaagaaactcagtagttgggtgttactaatgaagtacctgggtaacgctactgccattttttttctgcctgacgaaggcaaactgcagcatcttgaaaacgagttgacacatgatattattactaagttcctggaaaatgaggatcggaggagcgcgtcattgcatctgccaaaactctcgatcactggcacctatgacctcaagagcgtgctgggtcagctcgggatcactaaggtcttcagcaatggcgcagacctctcaggcgtcacagaagaggcaccacttaaattatctaaagccgtccacaaggccgtcctcacaatcgatgaaaaagggactgaggcagccggggctatgttcctggaagcaatccccatgagcatcccaccagaagttaagtttaataaaccctttgtcttcctgatgattgaacaaaacactaagagtccactgttcatggggaaagtggtgaatcctactcagaagtag

SEQ ID NO: 4016 - DNA, 1257 bp, Artificial Sequence
  Description of Artificial Sequence: Synthetic coding sequence
atgcccagcagcgtgagctggggcatcctgctgctggccggcctgtgctgcctggttcccgtgagcctggccgaagacccacagggcgacgctgctcaaaagacagacacatctcaccacgaccaggaccacccaaccttcaacaaaattactcctaacctagccgagtttgctttctccctgtatagacagcttgcacatcagagcaactcaacaaacatttttttctcaccggtttctatagcgacggccttcgcaatgctgagtctggggacaaaagcggacacacacgatgaaattctggagggtctgaattttaacctcaccgaaattccagaggcccagatccacgaaggttttcaggagctgctgaggactttgaaccaacccgacagccagctacagctgactaccgggaatggcctctttctttccgaggggctgaaattagtggacaagttcctggaagacgttaaaaaactatatcacagcgaggcttttaccgttaacttcggcgacacagaggaggctaagaagcaaatcaacgattacgtcgagaaaggcacacagggcaagatagttgatctcgtaaaggagcttgatagagacactgtatttgccctagtgaattacatatttttcaagggcaagtgggagaggcctttcgaggttaaagatactgaagaggaggactttcatgtggaccaggtgacgacagttaaggtgcctatgatgaagagactgggcatgttcaatatccaacactgtaagaaactcagttcctgggtcctccttatgaagtacctgggcaacgctacagccattttctttctccctgacgagggaaaattacagcacctggagaacgaactgacacacgacatcatcaccaagttcttagagaacgaagacagaaggtcagcctcactgcatctccccaaattgtctataaccggtacctacgatcttaagagcgttcttggtcagctagggatcaccaaagtattcagtaacggagctgaccttagcggtgtcaccgaggaggcgcccttgaaattgtcaaaagccgtgcacaaggccgttcttaccattgatgaaaaggggacggaagccgctggtgccatgtttttggaggcaattcctatgtccatcccacctgaggtgaaattcaataaaccttttgtttttctcatgatcgagcaaaataccaaatcacccctcttcatgggcaaggtcgtcaatcccacgcagaagtag

SEQ ID NO: 4017 - DNA, 1080 bp, Artificial Sequence
  Description of Artificial Sequence: Synthetic coding sequence
atgcccagcagcgtgagctggggcatcctgctgctggccggcctgtgttgcttagtccccgtgagcctggcagaggatccccagggggacgccgcacagaagactgatacgagccatcacgatcaggatcaccccacgttcaacaaaataaccccaaatcttgccgagtttgctttctctctgtatcgccagttagcccatcagagcaattccactaacatctttttctcccctgtgtctattgcaaccgcattcgctatgctctctctgggaaccaaggccgacacacacgatgaaatcctggagggtttgaacttcaatcttacagaaatacctgaggcccaaattcatgaaggttttcaggagcttctcaggaccctgaaccagccagactcacagctgcagctcactactgggaacgggctgtttctgtctgaggggctgaagcttgtggataaattcctggaggatgttaaaaaattatatcactctgaagcctttaccgtgaatttcggggacacagaggaagctaagaaacagataaacgactatgtggagaagggaacccagggaaagatcgttgacttagtaaaagagctagaccgggacaccgtattcgctcttgtgaactacattttttttaaagggaagtgggagcggccttttgaggtgaaggataccgaggaagaggatttccatgtagatcaggtgaccaccgtgaaagtaccgatgatgaaacgcctgggaatgtttaatattcagcattgcaagaaactgtccagctgggtgctgctcatgaagtacctgggaaacgccaccgccatttttttcctaccagatgaaggcaagcttcaacacttggagaacgaactgacgcacgatatcataacaaaattcctggagaacgaggacaggaggtctgccagcttacatctgccaaaactgagcattactggcacatatgatctcaagtccgttctcgggcagctgggaataacaaaggttttcagcaatggcgccgatctctcgggcgtcaccgaggaagcccctctgaagctgtctaaagtgagatctccctag

SEQ ID NO: 4018 - DNA, 1257 bp, Artificial Sequence
  Description of Artificial Sequence: Synthetic coding sequence
atgcccagcagcgtgagctggggcatcctgctgctggccggcctgtgctgcctggtcccggtgtccctggccgaagacccccagggagacgctgcacaaaagaccgacacttctcatcacgatcaggatcatcccaccttcaataagataacacctaacctggccgagttcgccttctcgctgtataggcagttagcccaccagtctaactccaccaacatctttttcagtccagtgagcatcgccactgccttcgccatgctctccttgggaactaaggccgacacccacgacgaaatccttgaggggttaaattttaatctaactgaaatccccgaggctcagatccacgaaggctttcaggaactcttaagaacccttaatcaacctgattcacagctgcagctcacaactggcaacgggctcttcctatctgaaggactgaagttggtggacaaattcctagaagatgttaagaaactctatcactctgaagcatttaccgtcaacttcggtgatacggaggaagcaaagaagcagatcaatgattacgtggagaagggcacccagggtaagattgtggacctcgtaaaagagttagatagagataccgtattcgccttggtcaactatattttcttcaagggcaagtgggaaagaccgttcgaggtgaaggacacagaggaagaggacttccacgttgaccaagttacaactgtgaaagtccctatgatgaagcggctcggtatgtttaacattcagcactgtaaaaagttatctagctgggtcctgctaatgaaatatctcgggaacgccacagcaatcttcttcctgccggacgagggaaaactgcagcaccttgagaatgaactgactcatgacatcattaccaaattcctcgagaatgaggaccggcggtccgctagtctgcatcttccgaagctgtcaattaccggaacctacgacctcaagtctgtactggggcagctaggcattactaaagtattttctaatggagctgacctgtcaggagtgactgaagaagccccactgaagttatctaaggctgtgcacaaggccgtgttaacgatagatgagaagggcaccgaagccgccggtgccatgttcctcgaggctattccaatgagtattcccccagaggtcaagtttaacaaaccattcgtattcctcatgatcgaacagaacacaaagtccccactgttcatgggcaaagtggtcaatccaacccagaaatag

SEQ ID NO: 4019 - DNA, 1257 bp, Artificial Sequence
  Description of Artificial Sequence: Synthetic coding sequence
atgcccagcagcgtgagctggggcatcctgctgctggccggcctgtgctgcttagtgcctgtttctttggccgaggatccgcaaggcgatgccgctcaaaagaccgatacctctcaccacgatcaggaccatcctacgttcaataagataacccctaacctcgcagagttcgccttttccttataccgtcagttggcccatcagagtaattccactaacatcttcttctcacccgtcagcattgctacggcctttgctatgttaagtcttggtaccaaagctgacacacacgacgaaatcctcgaaggtttgaattttaacctgaccgagatcccagaggcccaaatccacgagggattccaagaattacttagaactctgaatcagcctgatagtcagctgcagctgacaacaggaaatgggcttttcctctctgaagggctgaagttagtcgataagttcttggaggatgtgaaaaaactgtaccattccgaagctttcactgtcaatttcggagacaccgaggaggccaagaagcagattaatgactatgtggagaaaggcactcagggaaagatcgtcgatttggtgaaggagcttgacagggacaccgtgttcgcactcgtgaattatatcttctttaagggaaaatgggagcgtccttttgaagtgaaagatactgaagaagaagactttcatgtagaccaggtgactacagttaaagtccccatgatgaaacgcctcgggatgttcaatatccaacattgcaagaaactctcaagctgggtccttctcatgaaatatttgggaaatgccacagcaatattcttcctacctgatgaggggaaactgcagcaccttgagaatgaattgacacatgatattatcactaaattcctggagaacgaggaccgacgatccgcaagcctccacttgcccaaactctcaattaccggtacgtatgacctgaagtcagtgctgggacagctggggatcacaaaagtgtttagtaacggggccgatctgtccggcgttactgaggaggcccccctcaagctgtccaaggccgtccacaaagccgtgttgactatcgacgagaaagggaccgaggcggccggcgcaatgttccttgaggccatccccatgagcatcccgccggaggtgaagtttaataaaccgtttgtgttcctgatgatcgagcagaataccaagagccccctattcatgggaaaggtcgtaaatcccacacaaaaatag

SEQ ID NO: 4020 - DNA, 1257 bp, Artificial Sequence
  Description of Artificial Sequence: Synthetic coding sequence
atgcccagcagcgtgagctggggcatcctgctgctggccggcctgtgctgcctagtgccagtctcgcttgcagaggatccacagggcgatgcggcccaaaagaccgatacgtcacatcatgaccaagaccatcctacatttaacaagattaccccaaacctcgccgagttcgcctttagcctgtaccgccagctggcccatcagtctaatagcaccaacatcttcttctctcctgtgagcatcgcgactgcattcgccatgctctccctgggcacgaaagcggatacacacgatgaaattctggaagggttgaactttaacctaaccgaaatccctgaagcgcagatccacgagggatttcaggagttgctgcgaacactaaatcaaccggattcccaattgcagctgaccacaggcaatggtctattcctgagcgaggggctgaagctcgtggacaaatttctcgaagatgtaaagaagctgtaccactccgaagcttttacagtgaactttggcgacacagaagaggctaagaaacagataaatgattacgtggagaaggggacccaaggcaagattgtggacttggtgaaggaactggacagggacactgtgttcgctttggtgaattacattttttttaaggggaaatgggagcgcccgtttgaggtgaaagacaccgaggaggaagacttccatgtagatcaggtgactaccgtgaaagtacccatgatgaaacgactggggatgtttaacatacaacactgcaaaaaacttagttcatgggtactgctgatgaaatacttggggaacgcaacagctatcttctttcttcctgatgaagggaagcttcagcatcttgagaatgagctaacacacgacatcatcacaaaatttctggagaatgaagaccgccgctcagcttctctccacttgccaaagttatctattactgggacgtacgatctgaaaagtgtactgggccaactcggtatcactaaggtattttctaacggcgccgacctgtccggtgttactgaagaggccccgctcaagttgagtaaggccgtccacaaggccgtgctgaccattgacgagaaaggcacggaggcggcgggggccatgtttttagaggctatccccatgagtatccctccggaagtgaaatttaataaaccatttgtcttcctgatgatcgagcagaacacaaaatcaccgttattcatggggaaggtggtaaacccgactcagaagtag

SEQ ID NO: 4021 - DNA, 1257 bp, Artificial Sequence
  Description of Artificial Sequence: Synthetic coding sequence
atgcccagcagcgtgagctggggcatcctgctgctggccggcctgtgctgtctggtgccagtgtcactggccgaggatccgcagggagatgccgcccagaaaacagacaccagccaccatgaccaggatcacccaactttcaacaaaataaccccaaatctcgctgaattcgccttcagcctctaccgacagctggcgcatcagtctaacagtaccaatatctttttctcccccgtgagcatcgcaacagcgttcgccatgctgtcacttggaactaaggctgacactcacgacgagattctggagggccttaacttcaatttgactgagatccccgaggcccagatccatgaaggcttccaagaactcttaaggacgctgaaccaaccagactcccagctccagctgactacaggcaacggcttattcttatcagagggtctcaagctagttgataaatttctagaagacgtgaaaaaactctaccactccgaagcttttaccgtgaattttggggacactgaggaagctaagaaacagattaacgactacgtggagaagggcacacagggaaagatagtggatttagtcaaggagcttgaccgagatacggtgttcgccctcgtcaactacatcttcttcaagggaaagtgggagagaccattcgaagtcaaggataccgaagaggaagactttcacgtggatcaagtgaccacagtgaaggtgccaatgatgaagcggctcggaatgtttaatatccagcattgcaaaaaattatcatcttgggtgttgctaatgaaatacctgggcaacgccacggctatattcttcctccctgacgaaggaaaactgcagcatttggagaatgagctgacgcatgacattattacaaagttcctggaaaacgaagaccgccgcagtgccagcttgcacctgccaaagctctccatcacgggcacgtatgacctcaaatctgtcctggggcagctaggcattaccaaagtgttcagcaatggcgctgatctcagtggagtaacggaggaggcgccccttaagctgagcaaggccgtacacaaggccgtccttaccattgatgagaaaggtactgaagcagcaggagcgatgtttctggaggccatccccatgtccataccccccgaagtcaaattcaataaacctttcgtttttctgatgattgagcagaacacaaagagtccacttttcatgggaaaggtggtcaaccctacccaaaagtag

SEQ ID NO: 4022 - DNA, 1257 bp, Artificial Sequence
  Description of Artificial Sequence: Synthetic coding sequence
atgcccagcagcgtgagctggggcatcctgctgctggccggcctgtgctgcctcgttccagtaagtttagccgaagatccccagggagacgctgctcagaagactgatacctcccaccacgatcaggaccaccccacatttaacaagattacgcccaatcttgccgagttcgcgttttctctgtatcgacaactagcccaccagagtaactcgaccaacatatttttctcacccgtctccatcgcaacggcttttgcaatgctgtctctcggaactaaagctgacacccatgatgagattctcgaagggctgaatttcaatctcactgaaattcctgaggcacagattcacgagggatttcaagagctgctccgcactctaaatcagcccgacagccagctgcagctcactacaggaaatggactattcctcagcgagggacttaagctggtggacaaattcctggaagatgtgaagaaattgtatcattctgaagcatttacagtcaatttcggcgatactgaggaagctaagaaacagatcaacgactacgtagaaaaaggcactcagggcaagattgtggatctggtgaaggaacttgaccgggatacagtatttgctctcgttaactacatttttttcaaaggcaagtgggagcgaccctttgaagtgaaagataccgaggaggaggacttccatgtggatcaggtcactacggtgaaagtgcctatgatgaagagacttggtatgtttaatattcagcactgtaaaaagctcagctcttgggtgctgttgatgaaatatctcggaaatgctaccgcgattttctttctgcctgatgaaggcaaactgcagcacttggagaatgagctgacacatgacattatcaccaagttccttgaaaatgaggatcgccgcagcgccagcctgcacctcccaaaactgagcataacaggtacttatgatctcaaatccgtgttgggacagctcggcatcactaaggtcttcagcaacggggctgatctcagcggagttaccgaggaggcaccactgaaactcagtaaagcggtgcacaaggccgtgctgaccatcgacgaaaaggggaccgaagcagccggggctatgttcttggaggccatccccatgagtattccgcccgaggtgaagtttaataaacctttcgtgttcctgatgattgagcaaaacaccaaatccccactttttatgggcaaagtggtgaaccctacccaaaaatag

SEQ ID NO: 4023 - DNA, 279 bp, Artificial Sequence
  Description of Artificial Sequence: Synthetic coding sequence
atgcccagcagcgtgagctggggcatcctgctgctggccggcctgtgttgcctcgtgccagtgtctctcgctgaagatccacaaggtgacgccgcccagaagacagacactagccaccacgaccaggatcatccaaccttcaataaaattacccccaatttggctgagtttgccttttccctgtaccgacagctggcacaccagtctaactctacaaacatattctttagtccagtcagtattgccaccgccttcgccatgctgagcttgggaacatag

SEQ ID NO: 4024 - DNA, 471 bp, Artificial Sequence
  Description of Artificial Sequence: Synthetic coding sequence
atgcccagcagcgtgagctggggcatcctgctgctggccggcctgtgttgtcttgttcctgtctcccttgccgaggatccccagggagatgcagcacagaaaacagataccagtcatcacgaccaagaccacccgacctttaacaagattaccccgaaccttgctgagttcgcattttctctttacaggcaattagcacaccaatccaacagcacaaatattttctttagccccgtgtctattgcaactgcattcgcaatgctcagtcttggaaccaaggccgatacccacgatgaaatccttgaaggccttaatttcaacttgacagagattcctgaagcacaaatccacgaggggttccaagagctcctcaggactctcaatcagccagactctcagcttcagttgactaccggtaacgggctatttctgtcagaaggactcaaactggtcgacaaattcctcgagtag

SEQ ID NO: 4025 - DNA, 354 bp, Artificial Sequence
  Description of Artificial Sequence: Synthetic coding sequence
atgcccagcagcgtgagctggggcatcctgctgctggccggcctgtgctgcctggtgcccgtgtctttagccgaagatccccagggcgacgctgctcagaagaccgatacaagccatcatgatcaggaccatcccactttcaataaaatcacacccaacctggccgaatttgccttcagcctatatcggcagctggcgcaccagtccaacagcacgaacatctttttcagtccggtatccatcgccacagctttcgccatgctctctttaggtacaaaagcggacacccatgacgagatcctggaaggtcttaattttaacctgaccgagatccccgaggcccaaattcactag

SEQ ID NO: 4026 - DNA, 69 bp, Artificial Sequence
  Description of Artificial Sequence: Synthetic coding sequence
atgcccagcagcgtgagctggggcatcctgctgctggccggcctgtgctgcctggtacccgtgtcctag

SEQ ID NO: 4027 - DNA, 435 bp, Artificial Sequence
  Description of Artificial Sequence: Synthetic coding sequence
atgcccagcagcgtgagctggggcatcctgctgctggccggcctgtgctgcttggtcccagtcagcctcgcagaagatccacagggcgacgccgctcaaaagacagacacatctcatcatgaccaggatcatcccacttttaataagattacccccaatttggccgaatttgctttctctttgtaccggcagttggcccaccagtccaactcaaccaacatattcttttctcctgttagcattgccaccgcttttgcgatgttgtcccttgggactaaggccgacacccatgacgagatcctcgaaggcctgaatttcaaccttaccgagattcctgaggctcagattcatgaaggatttcaggagctcctccggacccttaatcagccagacagccagctccaactgactactggaaatggcctgttcttgtag

SEQ ID NO: 4028 - DNA, 780 bp, Artificial Sequence
  Description of Artificial Sequence: Synthetic coding sequence
atgtacagcaacgtgatcggcaccgtgaccagcggcaagcggaaggtatatctcctgagccttctgctaatcggattctgggattgtgtgacttgtcacggtagtcctgtagatatctgcaccgctaaacccagagatatcccgatgaatccaatgtgtatctaccggtctccagaaaaaaaggcaacggaagatgaaggaagtgaacaaaagatccctgaggctactaatcgacgagtctgggagctctcaaaagccaatagccgctttgcaaccaccttttatcaacacctggcagattctaagaacgacaacgataacattttcctgtcccctctcagtatcagcacagccttcgcgatgaccaagctgggcgcatgcaacgatactcttcaacagttaatggaggtcttcaagtttgacactatctctgagaagacatccgatcagatccattttttttttgcaaaattgaattgcaggttataccggaaggccaacaagagctctaaactggtcagcgctaacaggctgttcggagataagagcctgactttcaacgatttatatgtgtctgacgcttttcacaaggctttcctagaagtcaacgaggaaggttctgaagctgccgccagcacagctgtcgtgatcgcagggagaagcctgaatccgaatcgcgtcaccttcaaggcaaatcgtcctttccttgtctttattagggaagtgccactcaacacaatcatcttcatgggacgggttgccaatccttgcgtgaaatag

SEQ ID NO: 4029 - DNA, 1395 bp, Artificial Sequence
  Description of Artificial Sequence: Synthetic coding sequence
atgtacagcaacgtgatcggcaccgtgaccagcggcaagcggaaggtgtacctgctgtccctcctactaattgggttttgggactgcgtcacctgtcacggcagcccagtggacatctgcacagcaaaacctagggatatccccatgaacccaatgtgcatataccgttccccagagaagaaggcaaccgaggacgaaggcagtgagcagaaaatacctgaagctactaaccggagagtgtgggagctgtccaaagcgaacagtcgtttcgctactacattttatcagcaccttgccgactcaaaaaatgataatgataacatttttttatcccctctgagtatttcgacggcctttgctatgactaagctcggggcttgcaacgacactctccagcagttaatggaggtgtttaagtttgatactataagtgaaaagacctccgatcagatccatttttttttcgctaagctgaactgcagactctaccgaaaggcgaacaagtctagcaagctggtgtcagcaaatagactgtttggcgataagtccctcacatttaatgagacataccaggacatctctgagctggtgtatggcgcgaaactacagcccctggatttcaaggagaatgccgaacagtcccgagccgccattaacaagtgggttagtaataaaacagagggaaggatcaccgacgtgatcccctcggaagcgatcaatgaacttacggtgctggttctggtcaacacaatctactttaaagggctgtggaagtcgaagttctctccggagaatacaagaaaagaattgttttacaaggcagatggggagtcttgcagtgcctccatgatgtatcaagagggaaaatttaggtaccgcagagtggctgagggtactcaagttctggagcttcctttcaagggcgatgatatcaccatggtgttaattcttcccaagcctgagaagagcctggcaaaagtggagaaggagttaactccagaggtgctgcaagagtggctggacgaacttgaagagatgatgctcgtagttcatatgcccagattcaggatcgaggacgggttctcactgaaagaacagttgcaggacatgggactcgtcgaccttttttccccagaaaaatcaaaactgccgggtatagttgccgagggcagagacgatctgtacgtgagtgatgcatttcacaaggctttcttagaagtgaacgaagagggctctgaagctgcggctagtacagcggtggtcatcgctggacgatcccttaatccaaatagagtgaccttcaaagctaaccggccgtttcttgtcttcatccgcgaagtccccctgaacacaatcatctttatggggagggtggccaacccctgcgtgaaatag

SEQ ID NO: 4030 - DNA, 1476 bp, Artificial Sequence
  Description of Artificial Sequence: Synthetic coding sequence
atggccctgctgtggggcctgctggtgctgagctggagctgcctgcagggtccgtgttcagtttttagccctgtgagcgccatggaacccctgggccggcagctgacatcaggccccaatcaagaacaggtcagtccgctcaccctattgaagctcgggaatcaggagcccgggggacaaaccgccttaaagtctccgccaggagtgtgcagtcgtgatcctactccagaacagacccatcgcctggcacgcgcaatgatggcattcacagcagacttattttctctggtcgcacagacatccacctgccccaatctgatcctctccccactatcagttgcacttgccctgagccacctggcactgggtgcacagaaccacactctccagcggttgcagcaagtgttacatgctgggtctggaccttgtctcccacaccttctgtctagactctgccaagatttaggtcccggagcattcagactagccgctcgcatgtatctccaaaagggtttcccgatcaaggaggacttccttgagcaatccgaacaattatttggggcaaagccagtgagcctgactggcaagcaggaagacgacctggccaacatcaaccagtgggtcaaagaggctactgagggcaaaatccaggagtttctgagtggcttgccagaggacacagttctgctgctgctgaatgctattcactttcagggattctggagaaacaagttcgacccgagtctgacacaacgggatagctttcatttggatgagcagttcactgtgcccgtcgaaatgatgcaggcacggacttacccgctgcgttggttcctgctcgagcaacctgaaatccaggtggcccattttcctttcaaaaacaatatgagcttcgtggtgttggttccgacacattttgaatggaacgtctcccaagtgttggctaatttgagttgggacactctgcatccacctctagtgtgggagagacctaccaaggttagacttccgaagctctatctgaaacatcagatggacttggtggccacgctgagccagctcgggctgcaggaactcttccaggccccagacctgcgcgggatcagcgaacagtctcttgttgtcagtggggtgcagcaccagagcaccctcgaactctctgaagttggggtagaggctgctgcagccacctcaatcgcaatgtccagaatgtcactctctagtttcagcgtgaatcggccattcctgttctttatcttcgaggacactacgggactaccactgttcgtcggctcagttaggaatcccaaccctagtgcaccaagagagctaaaggaacagcaggactccccgggtaataaggatttcctgcagtcactcaaaggttttcccaggggtgacaaactcttcgggcctgatttgaaactggttcctcccatggaagaagattacccacagttcggtagtcctaagtag

SEQ ID NO: 4031 - DNA, 1476 bp, Artificial Sequence
  Description of Artificial Sequence: Synthetic coding sequence
atggccctgctgtggggcctgctggtgctgagctggagctgcctgcagggtccttgctccgtcttctcccccgtcagtgctatggaaccgttagggcgccagcttacctccggtcctaatcaggaacaggtgtcaccattgactcttctgaaattgggcaatcaagaacctggcggacagaccgccttgaaatctccccccggggtttgcagtagagatccaacccccgagcagacccaccgactagctagagcaatgatggcttttactgcagatctgttttcccttgtggcccaaacttccacatgtcctaacctcattctgtcccccctgagcgtagccctcgcgctgagccaccttgcccttggagcgcagaatcacacactgcagaggctgcaacaggtcctccatgcgggcagtggtccttgcctgcctcatctgctgagccggctatgtcaggatctgggacctggggcattccgtctggccgctcggatgtacctgcagaagggctttccaattaaagaggacttcctcgaacagtcggagcagctgttcggcgcaaagccagtctctttgactggtaagcaggaggatgacttggcgaatatcaatcagtgggttaaagaggccaccgaaggaaagattcaggagttcctctccggtctgccggaagatacagtgctcttgttgttgaatgccatccatttccaaggattttggaggaataagtttgacccaagcctgacccagcgcgactcctttcacctggacgaacagttcacagttccggttgaaatgatgcaggcaaggacatatcccctccgttggttcttactggagcaacccgaaattcaggtcgcccacttcccattcaagaataatatgagcttcgtcgtcctggtgcccacccattttgagtggaacgtgagccaggtgctggctaatctgtcatgggataccctccatcctcctctagtgtgggagagaccaactaaggtgaggctgcccaagctgtacctgaagcaccagatggatctcgtggcgaccctctctcagctgggcctacaggaactgttccaggccccggatttgagggggatcagcgagcagtctcttgtggtgagcggtgtgcaacatcagagcacactcgaactgtctgaggtgggcgtagaagccgctgcagcaacaagcatagccatgagccgtatgagtttgagctcgttcagcgtcaacagaccgtttctcttcttcattttcgaggacacaaccggcttgccactgtttgtcgggagtgttcgcaatccaaacccaagcgctccgagggagctgaaagagcagcaggattccccaggaaacaaagacttcctccaatccctgaagggcttccctaggggtgacaagctgtttggacctgatcttaaactggtccctcccatggaagaggattacccccagtttggaagcccgaaatag

SEQ ID NO: 4032 - DNA, 1284 bp, Artificial Sequence
  Description of Artificial Sequence: Synthetic coding sequence
atggccctgctgtggggcctgctggtgctgagctggagctgcctgcaggggccttgttccgtgttctcgcccgtctccgccatggagcccctgggccggcaattgacatccggtcctaaccaggagcaggtcagtccattgactctcctgaagttgggcaatcaggtgcaacccggagcccaaaatcataccctgcagcgtttgcagcaggtccttcacgccggctcgggaccgtgcctaccacacctgttgagccgactgtgtcaggacctaggacctggcgcatttcgactcgccgctagaatgtatctgcaaaagggcttccccattaaagaagatttcctggagcagagtgaacagctgttcggagccaagcctgtgtcacttacaggtaaacaagaggacgacctggctaatattaatcagtgggtgaaggaagcaaccgaggggaaaatccaggaattcctgagcggacttcctgaggacacggtgcttctcctgctgaacgccatacactttcaaggcttttggcgcaacaaatttgaccccagcctgacccagcgcgactccttccacctcgatgaacagttcacggtgcccgtagagatgatgcaggccagaacatatccacttaggtggtttctcttagaacagcccgaaattcaggtggcacactttccgttcaagaacaatatgagttttgttgttttggtgccgacacatttcgagtggaacgtcagccaggtgctagccaacctctcctgggatacccttcatccccccctggtgtgggaaagacccactaaggtccggcttccaaagttgtatctcaaacaccagatggacctggtcgcaaccctgagtcagttgggtctccaggaactattccaggcacccgatttacgcgggatctcagaacaaagcttggttgtgtcaggcgtgcagcaccagagtaccctggagttgagcgaggtcggggtggaggcagccgcggccacatctatcgcgatgagccgcatgtcattgtcatcattctccgtaaaccggcccttcctgtttttcattttcgaagacactaccgggttaccccttttcgtgggctctgtccgtaatccaaaccccagcgccccacgggagttgaaagagcagcaagacagcccagggaacaaagacttcctgcaatctcttaaagggttccccagaggtgacaagcttttcggacctgacctgaagctggttccaccgatggaagaggactaccctcagttcggaagtcctaagtag

SEQ ID NO: 4033 - DNA, 768 bp, Artificial Sequence
  Description of Artificial Sequence: Synthetic coding sequence
atggccctgctgtggggcctgctggtgctgagctggagctgcctgcaaggaccttgctccgtattttcccctgtgagcgccatggagccgctaggtagacagctgacgagcgggcctaaccaggagcaggtgtctccgctgaccctcttaaaattggggaaccaggaacctggggggcagaccgcactgaaatccccccccggagtttgtagccgagacccgacacccgagcagacccaccgcctcgcacgcgcgatgatggccttcactgctgacctctttagtttggtggcgcagacatccacgtgcccaaatctgatcctttctcccctttcggtggcattggcactcagccacctcgctctgggagctcagaatcacacactgcagcgactccagcaggtgctgcacgctgggagtggaccatgcctgccccacttgttgagtcgtctttgtcaggacttaggtcctggggcgttcaggctggcagccaggatgtatttgcagaaggggttcccaatcaaggaggatttcttagaacaaagtgaacagttgttcggcgctaaacccgtgtctttaacaggcaaacaagaagatgatttggccaatataaaccagtgggtcaaggaagcaacggaagggaagatccaggagtttctctcaggccttccggaagacacagtcctgctgctgctgaatgctattcatttccagggattttggcgcaacaagtttgacccatcccttacacagagagattccttctag

SEQ ID NO: 4034 - DNA, 1503 bp, Artificial Sequence
  Description of Artificial Sequence: Synthetic coding sequence
atggccagccggctgaccctgctgaccctgctgctgctgctgctggcgggcgaccgtgcttcttctaatccaaatgccacatccagcagtagccaggatccagagtctctccaagatagaggcgaggggaaggtagcaacaaccgtgattagtaaaatgttattcgtcgaacccattctcgaggtctcctctttacctacaaccaactccacaacgaattcagccaccaagataactgccaatacaacggacgagcctaccacccagcccaccactgagcccaccacacaacccacaatccaacccacccagccaactacacagctaccgaccgactcccctacgcaacctactactggtagcttctgccctggcccagttacactgtgctcagatctggaaagccattctactgaagccgttctgggcgatgcgctagtggatttctccctgaaactctaccacgcctttagtgcgatgaaaaaagtagaaaccaacatggccttttcccccttttcaatcgcttccctgttaacgcaggtgctactcggcgccggagaaaatactaaaaccaacctagaatccatcctgagttaccctaaggactttacatgcgtccatcaagcccttaagggattcactaccaaaggagtgacatctgtgagtcagatctttcactcaccagatctggctattagagataccttcgtaaatgctagccgcacactctatagttcctctccacgggttctttctaacaacagtgacgctaatttggaactcataaacacatgggtggctaaaaacaccaacaataagatctctcgcctgctggattcacttccttccgataccagactggttctcttaaatgccatctacctttctgctaagtggaagaccacattcgaccccaagaagactcgtatggagcccttccactttaaaaattctgtcatcaaggtgcctatgatgaattctaagaagtacccggtggctcactttattgatcagacgctcaaggccaaggtgggacagcttcaactctcacataaccttagcctggtgattctggtgccccagaatctaaaacacagacttgaggacatggagcaagcattgagcccatccgtgtttaaggcaatcatggaaaagcttgagatgtctaagtttcagccaacccttttgaccttgcctaggattaaggtgactactagccaggatatgttgtccatcatggaaaaactggagtttttcgacttctcctacgatctgaacctgtgcggtctgaccgaagatccggatcttcaggtttcggctatgcagcaccagacagtgctggagcttactgaaactggagttgaagctgccgctgcatccgcgatctcagtggccaggaccctcctggtgtttgaggtccagcagccgttcctgtttgtcctctgggaccagcagcacaaatttcctgtgttcatgggtagggtgtacgatcctagggcatag

SEQ ID NO: 4035 - DNA, 1518 bp, Artificial Sequence
  Description of Artificial Sequence: Synthetic coding sequence
atggccagccggctgaccctgctgaccctgctgctgctgctgctggccgggttcctggagccccaagaccgagcctccagtaaccctaacgcaacctcctcctcctcccaggacccagaatccctgcaggatcgtggcgaaggcaaagttgctaccacagtaatatccaagatgttgttcgtggagcccatcctcgaggtgtcatccctgccaacaacgaattctactactaatagcgccaccaaaattactgccaacaccaccgatgaacccaccacccagcctacgacagagcctactacacagccgacaattcagccgacacagccaactacgcaactcccgacagacagtcccacacagcctaccacaggatctttttgtcccggccctgttaccctgtgctcggatttagaatcccacagcaccgaagcggttttaggagacgcgcttgtagacttcagcctgaaactgtaccatgcattcagtgccatgaagaaggtcgagaccaacatggccttcagtccgtttagtattgcctctctgttgacccaggtgctgttgggagccggggagaataccaaaaccaatctcgagtctattctctcttacccaaaagatttcacttgcgtgcaccaagccctcaaaggcttcaccaccaagggtgtcacgtctgtcagtcaaatcttccacagcccagatcttgcaattcgggacacttttgtgaacgcaagcagaaccttatattctagctcgcctagagtgctctccaacaattccgacgcgaacctcgagctgatcaacacctgggtggcgaagaatactaataacaaaatttctaggctgctggactcattgccctccgacacgcggttggttctcctaaacgccatctacctatccgccaaatggaaaacaacctttgatccaaagaagacacgcatggagccatttcatttcaagaacagcgtaatcaaagtgccaatgatgaacagtaaaaagtaccccgtggcccatttcatcgaccagactctcaaggcgaaggtggggcagctacaactgtcacataacctctccctcgtaatcctggtgccacagaacctcaagcataggctggaggatatggaacaggcccttagccccagcgtgtttaaggccattatggaaaaactcgaaatgtctaagttccagccaactctgctcacgctgccccgcatcaaagtgacaacgagtcaagatatgctcagcattatggagaaactggagttcttcgatttcagttacgaccttaatctgtgtggactaaccgaagacccggacctacaggtgagcgcgatgcagcaccagacggtgctggaactgacggagacaggtgtcgaggcggctgcggcgagcgccatcagtgtggcacgaacccttctcgtgttcgaagtccagcagccattcctctttgtgctctgggaccaacagcacaaatttcccgtgtttatgggcagggtctacgatccaagagcatag

SEQ ID NO: 4036 - DNA, 1347 bp, Artificial Sequence
  Description of Artificial Sequence: Synthetic coding sequence
atgctgttcgtggagcccatcctggaggtgagcagcctgcccaccacgaactcgaccactaactccgcaacaaaaatcactgccaatacaacagatgagcccaccacacagcccacgacagaaccaacaacccagcccaccatccaacctactcaacccactacacagctgcctactgacagccctacccaacctacaactggcagcttctgtccagggccagtaaccctatgctctgacctcgaatcacactcaaccgaggccgtcttgggggacgccctggtcgacttttcacttaagttgtaccacgcattcagtgctatgaagaaggtagagaccaatatggccttttctccctttagtatcgcctcgcttcttactcaagtgctgctgggcgctggagagaatacgaagacgaatttggagtccattttatcataccccaaggactttacttgtgtgcatcaggcattgaagggttttacgactaagggggtgacttccgtgtctcagattttccacagccctgatcttgccattcgcgatacgttcgtgaatgcaagtagaactctgtacagctcttccccaagggtgcttagcaataattccgatgcaaacttggagttgatcaacacatgggtagcaaaaaataccaacaacaagatctcaagactgcttgatagcctgccctctgacacccgcttggtgctattgaatgcaatctacctaagcgctaagtggaaaacgacctttgatcccaaaaaaactcggatggagcccttccatttcaaaaatagcgtcattaaagtccccatgatgaactcaaaaaaataccctgtcgctcattttatagaccaaactctgaaggccaaggtgggacagctgcaactcagccataatctgtcgttagtgattttggtgccccagaatttaaagcacaggctcgaagacatggagcaagccctgtccccatctgtgtttaaagcaattatggagaagctcgagatgtccaagttccaacccacgttactgaccttgccccgcatcaaagtaacaaccagccaggacatgctcagtattatggagaagctggaatttttcgatttctcttacgaccttaatctgtgcggactcaccgaagatccagaccttcaggtgtccgcaatgcagcaccagacagtgcttgaactgacagaaaccggtgtcgaagctgccgctgccagcgccatcagcgtcgcccgtactctcctggttttcgaagtacaacaacccttcttattcgttttatgggatcagcaacacaaattccccgtctttatgggcagagtttatgaccctagggcctag

SEQ ID NO: 4037 - DNA, 483 bp, Artificial Sequence
  Description of Artificial Sequence: Synthetic coding sequence
atggccagccggctgaccctgctgaccctgctgctgctgctgctggcaggtgatcgggcaagctccaacccaaatgccacatcctcctctagtcaggaccctgagtcactgcaggaccggggagagggcaaggttgccacaacagtaatttcaaaaatgctgtttgtagagccaatactggaggtatcttccctgcctactacaaacagtacaactaacagcgccaccaagataaccgccaacaccacggacgaacccaccacacagccgactacggagcctacaacccagccgaccatacagcctacacagcccaccacccagctgcccaccgattctccaacgcagccaacaaccggctccttctgtcccggcccggtgacactgtgctcagaccttgagtcccactctaccgaggcagtgttaggcgacgctctggtagacttctctttgaaactctatcacgccttttccgccatgtag

SEQ ID NO: 4038 - DNA, 402 bp, Artificial Sequence
  Description of Artificial Sequence: Synthetic coding sequence
atggccagccggctgaccctgctgaccctgctgctgctgctgctggccggagacagggcctcttccaaccccaacgcaaccagcagctcttcccaagaccctgagagtcttcaggatagaggcgaaggcaaggtcgcaactactgtcatttccaaaatgctgttcgtagaacccatactggaggtgagctccctccctactacaaattctactacaaacagtgctactaaaatcactgccaacacgacagatgaacccacgacacagccaaccactgaacccaccacacagccaacgatccagccgacacagccgacaacacaactaccaaccgactcccctactcagccagggtacgccctgaaccacggagaaattggcatcttgagattctttctctag

SEQ ID NO: 4039 - DNA, 3405 bp, Artificial Sequence
  Description of Artificial Sequence: Synthetic coding sequence
atgcccgtgttccacacccggaccatcgagagcatcctggagcccgtggcccagcagatctcacatctggtgattatgcatgaggaaggagaggtagatggcaaagccatacccgatttgactgcccctgtggccgccgtgcaggcagccgtttctaacctggtccgtgtgggtaaggagacggtgcaaacaacagaagatcagatccttaagcgcgacatgccgcccgcattcattaaggttgagaatgcatgcaccaagttggtgcaggccgcccagatgctgcagagcgatccttacagcgtgcccgccagggattatctcatagacggcagccgcggcatactgagcggcacttcagacctattgttgacttttgatgaggctgaagttaggaagattatccgagtgtgcaagggaattctggaatacctgacagtggccgaggtcgtcgagaccatggaggacctggtgacctatactaagaacctggggcctggcatgacaaagatggctaagatgattgatgagcgccagcaggagctgactcatcaggagcacagagtcatgctggtgaacagcatgaataccgtgaaagaactgttaccggtgttaattagcgccatgaagatctttgtgaccaccaagaatagtaagaatcagggcatcgaagaggccctgaagaacagaaacttcacggttgagaaaatgtctgctgagatcaacgaaatcatcagagttctgcagctgaccagctgggatgaggacgcctgggcttctaaagatacagaggccatgaagcgtgctctggcctctatcgacagcaagctgaaccaggcaaagggctggttacgcgatccaagcgcctctccgggagacgcaggagagcaggcaatccgtcagatattggacgaagccggaaaggtcggcgaactgtgcgcaggaaaggagcgaagggaaatcttgggcacttgcaagatgctgggccagatgacagatcaggtagccgatcttcgggctcggggacagggcagttcacctgtcgcaatgcagaaggctcagcaggtgagccagggacttgacgttctcacagctaaggtggagaacgccgcccggaaacttgaagcgatgaccaatagtaaacagagcatcgcgaaaaagatcgatgcagctcagaactggctcgctgatcccaacggagggccagagggagaggagcagattagaggggctttggccgaggcgagaaagatcgccgagctttgcgacgatcccaaggagagggacgacatcttgcgtagcctaggggagatcagcgccctgacaagtaagttagccgacctgcgtagacaggggaaaggcgactcacctgaggctcgcgctctcgcaaagcaagtggcgacggccctccagaatctgcaaaccaagaccaatagggcagtagccaacagccggcccgctaaagccgctgtgcacctggagggcaagattgaacaggctcaacggtggattgacaaccccacagtggatgatcgtggcgtgggacaagcagccattaggggactggtagcagagggccaccgcctcgcaaatgttatgatggggccttatcgacaagatttgttggcaaagtgcgatagggttgaccaattgaccgcccaactcgccgatctagccgcgagaggagaaggcgagagtccacaggcgcgggctttagctagccagcttcaggactctcttaaagatctcaaggcaagaatgcaggaggcaatgactcaggaagtgtcggatgtgtttagcgacaccaccacacctatcaaactcctggctgttgccgctaccgcgccaccagatgccccaaaccgggaagaggtgtttgatgaaagggcagccaatttcgaaaatcacagtggcaagttaggggccaccgcggagaaggccgcagcggtgggcacagcgaataagtctactgtcgaaggcattcaggcctccgtcaagaccgctcgggaactgacaccgcaggtagtgtctgcggcccggatcctcttgcgcaatcccggcaatcaggccgcgtatgaacactttgagaccatgaaaaatcaatggatagataatgtggagaagatgacaggtctggtggacgaggccatcgacacgaaatccttactggacgcctccgaagaagctatcaagaaagacctagacaaatgtaaggtggccatggctaacattcaaccgcagatgctggtggccggggccactagcattgcacgacgcgccaatcggatcttactggtggccaagagggaggtggaaaattcagaggaccctaaatttagggaggccgtcaaggcagctagcgacgagctgtctaagaccatttcacccatggtgatggacgcaaaagccgttgcaggaaacatttctgacccgggcttgcagaaaagctttctagactccggctatagaatattaggcgcagttgcgaaggtaagggaggcttttcaaccgcaagaacctgattttcctccccctcctccagatctggagcagttgagactgacagacgagttggcgccccccaagccgccgttacccgagggcgaagtccccccccccaggccccccccacccgaagagaaggatgaggagtttccggaacagaaggcaggggaagtgataaaccagcctatgatgatggcggcaagacagcttcatgatgaggcacgcaagtggtcttcgaaaccaggtattccagccgctgaagtcggcatcggagtagtggccgaagctgacgccgcagacgccgcaggattcccagtgcctcccgacatggaagatgattatgaacctgagctcttgctaatgcctagtaatcagcccgtcaatcagccaattctggccgcggctcagagcctacaccgtgaagctaccaagtggagtagcaaggggaatgacatcattgcggccgccaagagaatggccctgttaatggccgaaatgtctaggctggtgcggggtgggtccggcacgaagcgggcgctgatccagtgcgccaaggacatcgctaaagcctctgacgaggtaactcggctggctaaggaggtcgcgaaacagtgtaccgataaacgcatcagaacaaacctgctccaggtttgcgaaagaataccaaccatttcgacacaattaaaaattctctctacggtgaaggctactatgctcggacgcaccaatataagtgacgaagagagcgagcaagctaccgaaatgttggtgcataacgcacagaacctgatgcaatccgtaaaggagacggtccgggaggccgaagccgcaagcatcaagatacgaaccgacgctgggttcactctgaggtgggtgcggaagaccccttggtaccagtag

SEQ ID NO: 4040 - DNA, 1335 bp, Artificial Sequence
  Description of Artificial Sequence: Synthetic coding sequence
atgtgcctgtgcagcggccggaagaccatcctggagatctaccccggccagttccaaccgtccttgtgtcataagtttatagctctgtctgacaaggaagggaaactattgaggaactatactcaaaatatcgacaccctagagcaggtcgcagggattcaacggataatccaatgccatggatcttttgccaccgcatcttgcctgatttgcaagtataaagtcgactgcgaggcagttagaggcgacattttcaaccaggttgtgccaaggtgtcctcgatgtccggctgacgagcctttagcgataatgaagcccgaaatcgtctttttcggcgagaatctccctgaacagtttcacagagcaatgaaatacgataaagacgaggtggatctgctgatcgttataggaagttccttgaaggtgcgacctgtggccctgataccgtcttctatccctcacgaagtcccacaaatcctcataaatcgggaaccgctaccacacctacattttgatgtggagctgttgggcgactgtgatgtcattattaacgaattatgccacagactggggggtgaatatgcgaagctctgctgtaacccagttaaactgtcagagatcaccgagaaaccgccacgcacgcaaaaagaattggcttacctttcggaactccctccaacacccctgcacgtctccgaggatagcagttcgcccgaaagaacttcacccccagatagttcagtgatcgtcactctcctggatcaggcagccaagtccaacgacgacttggacgtgtcagagagtaaaggctgcatggaagaaaagccccaagaggtgcagacatcacgcaatgttgagagtatcgccgaacagatggagaatcctgatctgaagaacgtcggatccagcaccggagagaagaatgaaaggacatccgtggcaggaaccgtgaggaagtgctggcctaacagagtagctaaggagcaaatttcccgccgactagatggcaaccaatatctctttctgccgcctaatagatatatatttcacggagccgaggtgtactctgacagcgaggatgatgtcctatccagcagctcctgtgggagtaatagcgactccgggacttgccagagcccttccttagaggagcctatggaggatgagtctgaaatcgaggagttttacaatggtttggaagatgaaccagatgtgcctgaaagagccggtggagccggattcgggaccgacggtgacgaccaggaagcaatcaatgaagccatcagcgtgaaacaggaggtaactgacatgaattacccttcaaacaagagctag

SEQ ID NO: 4041 - DNA, 1335 bp, Artificial Sequence
  Description of Artificial Sequence: Synthetic coding sequence
atgtgcctgtgcagcggccggaagaccatcctggagatctaccccggacagtttcagcctagtctttgccacaagttcatcgccttatccgacaaagagggaaaactgttaagaaactatacgcagaatatagacactctggaacaggtggcgggaatccagagaatcattcagtgtcacggttcgttcgcaactgctagttgtctcatctgcaagtataaagtggattgcgaggcagtgaggggtgatatatttaatcaagtcgtgccacgctgccctaggtgccctgccgacgaaccattagcgatcatgaaacccgaaatcgtatttttcggagagaatctcccagagcagttccacagggcaatgaagtatgataaggacgaggtcgatctgctgatagtcatcgggtcctctctaaaagtccgccctgtggctctgatcccttcttctatcccacacgaggtgccgcagatcctgataaatagggagcccttgccccacctgcacttcgacgttgagttattgggagattgtgacgtgatcattaatgagctgtgccataggctcggaggagagtacgctaagctttgttgtaacccagttaaactatccgagataaccgagaagccaccaaggacccagaaggaactcgcgtatctctccgaattgcctccgacgccactccacgtgagtgaagacagttcttcacctgaaaggacctccccccctgattctagcgtgattgttactcttcttgatcaggcagccaaatcgaacgatgatcttgatgtaagtgaatccaaaggctgcatggaggaaaagccccaagaggtgcagacatcacgcaacgtcgagtcaatcgctgagcagatggagaatccagatctaaagaacgtaggcagcagcacaggcgagaagaatgaacggacttctgttgccggaactgttcggaagtgttggcccaaccgagtcgcaaaggagcagatctcgagaaggttggatgggaatcaatacctgttcttgccacccaacaggtacattttccatggcgcagaggtctattctgatagcgaagatgacgtgttgagctccagttcatgtggctcgaattcggacagcggaacgtgtcagtccccctctttggaagagcctatggaggatgaatcagagatagaggagttttacaatgggcttgaagatgaacccgatgtgccagagagggcgggcggcgctggattcgggactgacggggatgaccaagaggccataaacgaggctataagcgtgaaacaggaggtgacggacatgaactatcctagtaacaagagctag

SEQ ID NO: 4042 - DNA, 1359 bp, Artificial Sequence
  Description of Artificial Sequence: Synthetic coding sequence
atgttcgacatcgagtacttccggaaggacccccggcccttcttcaaatttgccaaggaaatctatccaggacagtttcagccatctctgtgtcataagtttattgccctgagcgataaggaggggaagcttcttagaaactacactcagaacatcgacacgctagagcaggtggcagggatccagcgcatcatccagtgccacggaagttttgctacggctagctgtttgatctgtaagtacaaagttgattgtgaagcggtgcgcggagatatctttaaccaggtcgttcctcgatgtccacgatgccccgctgatgaaccactggcaattatgaagcctgagattgtgttctttggagagaatttgccggaacaatttcaccgcgcgatgaagtacgacaaggacgaggtggatctcctaattgtgattggctcctcgcttaaggtccgtccagtagcactcataccgtcttccatcccgcatgaagttccgcaaatcttaatcaaccgtgaaccacttccccatttacacttcgatgtggagctgctgggggattgcgacgtaataattaatgaactctgccaccggctcggtggagagtatgcaaaattgtgctgtaatcccgtgaagttgtccgaaataacggaaaaacctcctcggacccagaaagagctggcatatctctctgaattgcctccaacacccctgcacgtatctgaggatagctccagcccagaaagaacatcacccccggactctagtgtaatagtgaccctcctcgatcaggccgccaaaagcaatgatgatttggacgtttcagagtccaaaggctgcatggaggagaagcctcaggaagtgcagacctcccgaaacgtggagtcaatagccgagcaaatggagaatccggatctcaaaaatgttggtagctctaccggcgaaaaaaacgagcggacaagcgtcgcagggacggtgcgaaagtgttggccgaatcgcgtggctaaagagcagatctctcgccgtctggacggcaatcagtatttgtttctgccacctaacaggtacatcttccacggggcggaggtatacagcgattccgaggacgatgttctgagctcttcttcctgcggaagcaattcagactctggtacgtgtcagtcaccatcactggaggagccaatggaggatgaatcagaaattgaggagttctataacggtctggaagacgagcccgacgtgcctgagcgcgcgggcggggcaggattcggaactgatggcgatgaccaggaggccattaatgaagccatctccgtgaaacaagaggtgacagacatgaactaccccagtaataaaagctag

SEQ ID NO: 4043 - DNA, 987 bp, Artificial Sequence
  Description of Artificial Sequence: Synthetic coding sequence
atgagcgtgaactacgccgccggcctgagcccctacgccgacaagggaaagtgcggccttccagaaatatttgaccctccagaggaattagagaggaaggtctgggagcttgctcggctggtgtggcagtccagctcagttgtgtttcatacaggagcagggatctccaccgctagcgggatcccagatttccgcggaccacacggggtctggaccatggaagagagggggctggcaccgaagttcgacacaacattcgaatctgcaagaccaactcaaacccatatggccctcgtgcagctggaacgggtgggtttgctcaggtttctggtatcccagaatgtcgacggattgcacgttagaagtggatttccaagagataagcttgctgagcttcacggcaatatgttcgttgaggagtgtgctaaatgtaagactcagtacgtaagggacaccgtggtgggtacaatgggactgaaggccaccggaaggctctgcaccgtggcaaaggcccgtggacttagggcttgccggaacgccgacctgagtattacactcggaactagcttacagattcgaccatcagggaacctccctttggcaaccaagaggcgggggggtcgcttggtaatcgtaaacctccagcccactaagcacgacagacatgcggacctcaggatccatggctacgtggatgaagtgatgactcgcctgatgaagcacttgggtctggaaatcccagcatgggacggcccaagggtcctagaaagggctctccctcctctaccaaggccacctacacccaagctagaacctaaagaagagagccctacaagaataaatggaagcatcccggcaggacctaaacaggagccctgcgcacagcacaacggttctgagccagcctccccaaagcgcgaacggccaactagtccggctcctcaccggccccctaagcgggtaaaggctaaggcagttccatcatag

SEQ ID NO: 4044 - DNA, 1068 bp, Artificial Sequence
  Description of Artificial Sequence: Synthetic coding sequence
atgagcgtgaactacgccgccggcctgagcccctacgccgacaaggggaaatgcggactgcccgaaattttcgacccgccagaagaattggagcggaaagtgtgggagctggcccgactcgtgtggcaatcctctagcgtggtattccataccggggctggcatcagcactgcatcagggatccccgactttaggggcccacacggagtgtggacaatggaagagcgtggtctggcccctaagtttgatacaactttcgagagcgccaggccgacacagacccatatggcactggtgcagttagagcgagtcggcctcctgcgtttcctcgtgagccagaatgtggacgggctgcacgtgcgcagcggtttccctcgtgacaagttggccgagctgcacggaaatatgttcgtcgaagagtgtgccaaatgtaagactcagtacgttcgggacactgtggtgggtacaatggggctgaaggcaacagggagactgtgcacagtcgcaaaggcaagagggctgcgagcatgccgcggagagcttagggatacaatcctcgattgggaagactctcttcccgacagagacctggcgcttgcagatgaagctagcagaaatgcagatcttagtatcaccctgggcactagcctgcaaatccggccgagcggcaatcttcccttggccaccaagcgacgcggcggccggcttgtaatcgtcaacctgcagcccactaagcacgaccggcacgctgatctgcggatccatggatatgtggacgaggtcatgactcggctgatgaaacacctcggtctggagattccggcctgggacgggcctcgcgtcttagagcgcgctttgcctcctctgccgcggccaccgactcccaagctggagccaaaggaggagagtcccactcggatcaacggatccatccccgctggacccaagcaggaaccttgcgcacagcacaatggcagcgagcccgcttcacccaagagagaacggcccacttctccggccccccaccgccctccgaaacgcgtaaaggccaaagctgttccttcctag

SEQ ID NO: 4045 - DNA, 852 bp, Artificial Sequence
  Description of Artificial Sequence: Synthetic coding sequence
atggaggagcggggcctggcccccaagttcgacaccaccttcgagtctgccagaccaacacagactcacatggctctcgtccaactggagcgcgtgggacttcttcgattcctggtgagccaaaatgttgacgggctgcacgtgcggtcgggatttccgcgagataaacttgctgaacttcatggcaatatgtttgttgaggaatgcgctaagtgcaaaacccaatacgtgcgcgacactgtggtgggtacgatggggcttaaggccaccggcaggctttgcacggtggcaaaagcaaggggattgcgagcatgcagaggcgagcttagagataccattctggactgggaagattccttgccagatagagacctggctcttgcagacgaggctagccgcaacgctgatttatctatcactctcgggacctctctacagatacggccttccggcaacctccccctggcgacaaaacgccgggggggtagacttgtgattgtcaatctgcagcctaccaagcacgaccgacatgctgatctcaggatccacgggtacgtggatgaagtaatgacacgcttgatgaagcacctaggactggagatacctgcctgggatggacctcgggtgctcgaacgcgctctcccccctcttccgagaccacctactcctaagctagaaccaaaagaggaaagtcccactcgaatcaacggaagcatccctgccggtcctaagcaggagccatgtgcccagcacaacggatctgagccagcatcccctaagcgagaaagaccaaccagcccagccccacatagacctccaaaaagggtgaaggctaaggccgtgccttcttag

SEQ ID NO: 4046 - DNA, 1575 bp, Artificial Sequence
  Description of Artificial Sequence: Synthetic coding sequence
atgaccgaggacaaggtgaccggcaccctggtgttcaccgtgatcacagctgtgttgggctctttccagttcggatacgatatcggggtgattaacgctccccagcaggtcatcattagtcattatcggcacgttcttggggtcccattggatgatcgcaaggccatcaacaattacgtcatcaactcaacagatgaactccctacaatcagttactccatgaatcccaaacccactccatgggccgaggaagagactgttgccgccgcgcagttgatcacaatgctttggagcctgagcgtttcaagtttcgccgttggtggtatgacagcttccttcttcggcggctggctcggggacactctgggtcgaattaaggcaatgctggtggccaatattcttagcctggtgggagccctgctgatgggatttagcaaattgggacccagtcacattctcatcatcgcaggtcggtccataagtggactgtactgtggcctgatcagtggtctggtccctatgtacatcggcgaaattgcccccaccgcgctgaggggagctctggggaccttccaccagctggccattgtcaccgggatcctcatttcccaaattattggattggagttcatcctcggcaactatgatctgtggcatattctgctgggcctgtcaggcgtccgcgctatcctgcagtcactgttacttttcttttgtcccgagagtccccgttacctttacataaagcttgatgaggaagttaaggccaagcagtcactcaagagactacgagggtacgatgacgtgactaaggacatcaacgagatgcgcaaggagcgcgaggaagcatcaagcgagcagaaagtaagtattatacagctcttcactaatagtagctacaggcaaccgatcctcgtcgcccttatgctccacgtggctcagcagttcagcggcattaatggcatattctattacagtacctccatcttccagaccgccggcatctccaagccagtctacgccacaatcggggtcggagccgtgaacatggtttttacagcggtgtctgtcttcctggtagagaaagcgggacgccgttcactgttcttgatcgggatgtccggtatgttcgtgtgcgcgatcttcatgagtgtaggcttggtgcttctcaataagtttagttggatgagctatgttagcatgatcgccatctttctgtttgtatcttttttcgagattggccctggaccaattccttggtttatggttgccgaattcttctcacaggggccgaggccagccgcactggctatcgctgcattctccaattggacctgcaattttattgtggccctatgcttccagtacattgccgatttctgcgggccgtatgtgttctttctcttcgcgggcgtccttctcgcatttacacttttcaccttctttaaggttcctgaaacaaaaggcaagtctttcgaagaaatcgcagccgagtttcagaaaaagagtgggagcgcccatagacccaaagcagctgtggaaatgaaattcctgggggcaacagaaactgtttag

SEQ ID NO: 4047 - DNA, 1218 bp, Artificial Sequence
  Description of Artificial Sequence: Synthetic coding sequence
atgcacctgaaccggatcaaggccatgctggtggccaacatcctgagcttggtgggcgccctcctcatgggattttctaaactgggtccttcccatatccttataattgcgggtcggagcatctctggactctattgcggtctgatcagcggcctggtacccatgtacatcggcgaaatcgctcccacggcgctccggggggctttaggcaccttccatcagctggcaatagttacaggaatactcattagtcagataatcggtctcgaatttatccttggtaattatgacctttggcatatactcctgggactgtcgggtgttcgcgctatcctccagagcctgttgctgtttttctgccctgaatcaccccggtacctctacatcaaattggacgaggaagtgaaggcaaagcagagcctaaagaggctgcgcggatacgatgatgtgaccaaggatattaacgaaatgaggaaagaaagagaggaggctagcagtgagcagaaagtcagcatcattcagctgtttactaacagcagttatcgccagcctatcttagtggcactgatgctgcacgttgcacagcagttctccggcatcaatggaatattttattacagcacgtctattttccaaaccgcgggtatcagcaagcccgtttatgccacaattggagtaggcgctgttaatatggtgtttacagcagtgagcgtgttcctggtagaaaaggctggtagacggtcgctttttctgatcggcatgagtggcatgttcgtgtgcgctattttcatgtccgttggccttgtactacttaataagttcagttggatgtcttatgtttccatgatagccatcttcctattcgtcagcttcttcgagattgggccaggccccattccttggtttatggtggcggaatttttcagccaaggtccgagacccgctgctctggcgattgcagcattcagcaactggacttgtaactttatcgtggccttgtgctttcaatacatagctgatttctgcggaccctacgttttctttctgtttgctggagtgttactggcattcacgctcttcacctttttcaaagtgccagagacaaagggcaagagtttcgaggaaatagccgccgagttccagaaaaaaagcggatcagcccaccgcccaaaggcagccgtggaaatgaagtttctgggagcaaccgagaccgtgtag

SEQ ID NO: 4048 - DNA, 1290 bp, Artificial Sequence
  Description of Artificial Sequence: Synthetic coding sequence
atggccgcccagggctacggctactaccggaccgtgatcttcagcgctatgttcggggggtatagcctttactatttcaacaggaagaccttctcttttgtcatgcccagcttggtggaggagatccccctggacaaagacgatctgggattcatcaccagcagccagagcgctgcctacgccatttctaagttcgtgtccggtgtgttgtccgatcaaatgagcgcaaggtggctgttcagcagcggtttgttgctggtgggcctggtgaacattttcttcgcatggtcctcaaccgttccagttttcgcagcactatggtttctgaacggcctcgcgcagggccttggctggccaccgtgcgggaaggtgctcagaaaatggttcgaaccctcacagttcgggacttggtgggctatccttagtacctccatgaacctggcaggaggtctggggcccattttggcgaccattctcgcccagtcctactcatggcggtctacacttgctctcagcggcgcactgtgtgtcgtggtctcgttcttatgcctgctgctgattcacaacgaaccagcagatgtaggccttcgaaacttggacccgatgcctagcgaggggaaaaaaggatcgttgaaggaagagagcaccctgcaggaactgctcctctccccctacttgtgggttttaagcacaggctatctggtggtgtttggagtaaagacttgctgcacagactgggggcagttttttttaattcaggaaaagggacagtctgccctcgtgggctcctcttatatgtccgcactcgaagtgggcgggctggtcggcagcatcgctgccggctacttgtctgacagagcaatggccaaggcgggcctgagcaattatggcaatccccggcacgggcttctactctttatgatggccggaatgaccgtctccatgtatcttttcagggtgaccgtgacttccgactcccctaaattatggatccttgttctaggagcagtgtttggtttctcttcctatggacctattgccctgtttggggtgattgctaacgagagtgcaccccccaacctatgtggcacatcccatgccattgtcggcctgatggcaaacgtgggcggatttctggccggcttgcctttcagtaccatcgctaaacattactcgtggtccacagcgttctgggtggctgaggtaatctgtgcagcatccactgccgccttcttcctgttaaggaatattaggaccaaaatgggccgtgtttccaaaaaggctgagtag

SEQ ID NO: 4049 - DNA, 1356 bp, Artificial Sequence
  Description of Artificial Sequence: Synthetic coding sequence
atggccgcccagggctacggctactaccggaccgtgatcttcagcgccatgtttggcggctactctttgtattacttcaataggaaaaccttctcgtttgtgatgcccagtcttgtggaagagattcccctggacaaagacgatctggggtttatcacctcctcccagtccgccgcttacgccatttcaaagtttgtgtctggggtgttgtctgatcagatgtcagcgcggtggctcttctccagtggtctcctgcttgtgggcctggtgaatatcttctttgcctggtcctcaacggttccggtttttgccgccttgtggttcttgaatggactggcacagggcctcgggtggcccccgtgtggcaaggtactccgtaaatggtttgaacccagccagtttggcacctggtgggccatcctatcaacgtctatgaatttggctggtgggttgggacccattctggccacaattctggctcagtcatactcctggaggtcaacgctggctttgtctggagctttatgcgtcgtagtgtcatttctgtgtctgctcctaatccacaatgaaccggcagatgttggattacgcaatctcgacccaatgcccagcgagggcaagaagggttccctcaaagaggaatccacactgcaggagctgctgctctccccctatctgtgggtgctgagtacaggttacctggttgtctttggcgtgaaaacctgttgtacagattggggccagttcttcctgatccaggagaaaggtcagtccgccctggtcggaagcagctacatgtcagccctggaggtagggggcctcgtaggctctatagccgcgggatatttgtctgatcgagccatggcaaaggccggattgtctaattatgggaatccacgacacggcctcttgctgtttatgatggccggtatgactgtgagtatgtatctgttcagagttacagtcacatccgattcccccaaggacgtggcgttctggacattggcgttacatcccctagctgagttgaccggatttacggaacatgagttatggattctggtacttggagccgtatttggattttcctcctatgggccgatagccctttttggcgttatcgctaatgagtccgctccccctaatctctgcggaacatcacatgccattgtcggtctgatggcaaacgtcggaggcttcttagccgggctccccttctccaccatcgctaaacactacagctggtccactgcattttgggtggctgaagtgatttgtgctgcatctaccgcagccttcttcttgttaagaaatatcagaacaaagatggggcgcgtatctaagaaagccgagtag

SEQ ID NO: 4050 - DNA, 1716 bp, Artificial Sequence
  Description of Artificial Sequence: Synthetic coding sequence
atgacccgggccggcgaccacaaccggcagcggggctgctgcggctccttggccgactaccttactagcgcaaagtttctgctctatcttggacatagcctgtctacctggggcgaccgcatgtggcacttcgcagtgagcgtttttctcgtagaactgtacggtaattccctgctcttaactgccgtgtatggtttggtcgtcgcgggctccgttcttgtgctcggagccatcataggggattgggtcgacaagaacgcacgcctgaaggtggcacaaacctccctcgtcgtgcagaacgtctccgttattttgtgtggtatcatactaatgatggtcttcctgcacaaacacgagttgctgacaatgtaccacggatgggtactcacttcgtgttacatacttataataacaattgcaaacatcgccaacttagcatccactgctacagccataacaatacagcgcgattggattgtcgtggtggccggggaagaccggagcaagctggcaaacatgaatgccaccattcgcaggatcgaccagctcactaatattttagcacccatggcagtcggacagattatgacattcggcagccctgtcatcggatgtggattcatctctggctggaaccttgtgagcatgtgcgttgagtatgtcctgctgtggaaagtgtaccagaaaacgccagccctggcagttaaggctggcttgaaagaggaagaaaccgagctgaagcagctgaacctccacaaagatacagagcctaagcctctggagggcacccatttgatgggagtgaaggactctaacatccatgagctagagcatgagcaagaaccaacttgtgcctcgcaaatggctgagccattccggacttttagagacggatgggtcagctattataatcagcctgtctttctagccggaatgggcctagcgttcctttacatgaccgtactggggttcgactgtatcaccacggggtacgcctatacccaggggctgagtggctctatactatcaattctgatgggggccagtgcgatcacgggtattatgggcaccgtggcctttacttggctgcgccggaaatgcgggctcgtccgcaccgggctcatctcaggactcgcccagctgtcctgcctgatcctgtgtgtgatttcagtgttcatgcccggtagccctttggatctgtccgtcagcccatttgaggatatacgatctagattcattcagggagagtccattactcctactaagattcctgaaatcaccacagagatatacatgagcaatggctcgaacagtgctaatatagtccctgagacgagccccgaaagtgtgcctatcattagcgtctctctgctctttgcaggagtaatcgccgctcggattggactgtggtcctttgacctcaccgtcacccagctgcttcaagagaacgtgatcgaatcagagagagggattataaacggggtccagaacagcatgaactacctcctggacctgctccacttcattatggtgatcttggctccaaatccagaagcctttgggttgctggttctgattagcgtatcttttgtggccatgggccatatcatgtactttaggtttgctcagaacacactgggtaacaagctgtttgcatgcgggcccgacgccaaggaggtacggaaggaaaaccaagccaatacgtccgttgtctag

SEQ ID NO: 4051 - DNA, 603 bp, Artificial Sequence
  Description of Artificial Sequence: Synthetic coding sequence
atgacccgggccggcgaccacaaccggcagcggggctgctgcggcagcctggcggactatctaacgtctgccaagtttttactctatttaggacattctttatctacatggggagatcgcatgtggcattttgccgtgagtgtcttcctggtagagctctacggcaacagcttgctgttgactgcagtgtatggcctggtcgtcgccgggagtgtcttggtcttaggggcaattataggcgactgggtggacaagaacgctcggctcaaggtcgctcaaaccagcttggtcgttcagaatgtctccgtgatattgtgcggtataatcctcatgatggtgttcctgcacaaacacgaactgttgacgatgtaccacggctgggtattgacatcctgttatattcttatcatcaccatagctaatatagccaatcttgcgagcacagccactgcgattacaatccagcgcgactggatcgtggttgtggcaggcgaggacagatcgaagttagctaatatgaatgctaccattcggcgaatcgaccagctgactaatatcctggcacccatggccgtgggacaaatcatgactttcggaagctag

SEQ ID NO: 4052 - DNA, 78 bp, Artificial Sequence
  Description of Artificial Sequence: Synthetic coding sequence
atgacccgggccggcgaccacaaccggcagcggggctgctgcggctccttagccgactacctgactagcgcaaagtag

SEQ ID NO: 4053 - DNA, 78 bp, Artificial Sequence
  Description of Artificial Sequence: Synthetic coding sequence
atgacccgggccggcgaccacaaccggcagcggggctgctgcggcagcttggccgactacctgactagtgctaagtag

SEQ ID NO: 4054 - DNA, 168 bp, Artificial Sequence
  Description of Artificial Sequence: Synthetic coding sequence
atgacccgggccggcgaccacaaccggcagcggggctgctgcggctccctcgcagactacctaacctctgccaagttcctgttgtacctcggccactctctttcaacttggggcgaccgtatgtggcatttcgcggtaagtgtttttttggtggagttatacgggtag

SEQ ID NO: 4055 - DNA, 300 bp, Artificial Sequence
  Description of Artificial Sequence: Synthetic coding sequence
atgcgggccagcatccacaagaagctgcggaagagcagcggcatcgtcaccatcctatactctgcgttcgttctggtctcaacgagtgacatggcagaggagacagaagatgcatggccaagatgttacctgcaattccttgcactactgctgaccagcacgtctgcaagggcagccgccgctatcgcagcagccgaagagcccgccgggtcaccaagcgttatgaccagagccggtgaccacaacaggcagcgcggctgttgtggcagcctggcggactatcttaccagtgcaaaatag

SEQ ID NO: 4056 - DNA, 504 bp, Artificial Sequence
  Description of Artificial Sequence: Synthetic coding sequence
atgggcgtgaaggacagcaacatccacgagctggagcacgagcaggagcctacctgcgctagccaaatggccgagcccttcaggacatttcgcgatggctgggttagctactacaaccaacctgtctttttggctggaatggggctggccttcctctacatgacagtcctggggtttgattgtatcaccaccggctacgcatacacacaaggactgagtggaagcatcttgagtatactgatgggggccagtgcaatcacaggcattatgggcaccgtggcgtttacttggctgcgccgtaaatgcgggctggtccggactggcctgatatccggcttggcccagctctcatgcctgatactgtgtgtaattagcgtgttcatgccaggaagccctctggacctatccgttagcccatttgaggatatccgctcacggttcattcagggggaatcaatcacccccacgaaaattccagagatcaccactgagattcatgtttag

SEQ ID NO: 4057 - DNA, 2496 bp, Artificial Sequence
  Description of Artificial Sequence: Synthetic coding sequence
atggagcggccctggggcgccgccgacggcctgagccggtggccccacggcctgggcctgctcttactgctccagcttttgccgccaagcaccctctcacaggatcggttagatgccccacctccacctgctgccccgcttccaagatggagcgggccaattggtgtgagctggggccttagggccgctgccgcaggaggagcatttcctcggggcggcagatggcgaagatccgccccaggcgaagacgaagagtgtggacgagtgcgtgactttgtcgccaaactggccaacaatactcaccaacacgtattcgatgacctgaggggctctgtatcccttagttgggtgggagattccactggggtcattctcgtgctcactacgttccacgtgcctcttgtaattatgacatttggccagtcgaagctgtatagaagcgaggattatggcaagaacttcaaggatataacagatctcattaacaacactttcattaggaccgagtttgggatggccataggacccgaaaactccggcaaagtagtgcttacggcagaagtgtcaggcggaagccgcgggggcaggatattcagatcttcggactttgcgaagaacttcgtgcagacagacctgcctttccacccactgacacaaatgatgtactctccacaaaactccgattacctgttggcactatctactgagaacggcctctgggtctccaagaattttggcggcaagtgggaagaaatacacaaagccgtgtgcctagccaaatggggaagtgataacacaatctttttcacgacttacgcaaatgggtcttgtaaggcggatctaggcgcccttgagctgtggaggacaagcgacctgggcaagtcttttaaaactattggagtaaagatctactcatttgggctgggggggcgctttctgtttgcctccgtcatggcggacaaggacactacacggcgaattcacgtctctactgaccaaggggatacatggtcgatggcacagctgcctagcgttggacaggagcaattctattctatacttgctgccaatgacgatatggtgtttatgcacgttgatgaaccaggtgatactggctttggcaccatatttacctccgatgatcgtggcattgtatacagtaaaagcctggatagacacctgtacacaacgacaggaggggagaccgactttacaaacgtcacgtctctgaggggcgtttacatcacatctgttctttctgaggacaactccattcagacaatgatcacattcgatcagggtgggagatggactcatctacgaaaacccgagaattcagagtgtgacgctacggccaagaacaagaatgagtgctctctgcatatccatgcttcctactccattagccagaagttgaatgtgccaatggcccccctctctgagccaaatgcggtgggaatcgtgatagcccatggtagtgttggcgacgccatctcagtcatggtgcctgatgtgtacattagcgatgacggcggatattcatggaccaaaatgttagaaggtcctcactactatacgatcctcgattccgggggcattattgtcgccatagagcatagctctaggcccatcaatgttatcaaattctccacagacgaaggccagtgctggcagacatatacttttactagagatcccatctacttcaccgggcttgcgagtgagcccggcgcccgtagtatgaatatcagcatttgggggtttactgagtccttccttacaagccagtgggtctcatacacgatcgattttaaggacatattggagcgaaactgtgaagaaaaggattacacaatttggctggcgcactccacagatcctgaagactatgaggacggatgcatccttggttacaaagaacagtttctgaggctgcggaagtcttccgtgtgccagaatggccgggactacgtagttacgaagcagccatccatatgcctctgtagtttggaagattttctgtgcgacttcgggtattatagaccggaaaatgattccaagtgtgtcgagcaacctgaattgaaaggtcacgatctggaattctgcctgtacggtcgtgaagaacacctgaccaccaacggctatcgcaagatcccaggcgacaagtgtcagggcggcgttaatccggtgcgggaggtaaaagacttgaaaaagaaatgtactagtaattttcttagcccggagaaacagaactcaaagtcgaattctgtgcctattatacttgccattgtgggtcttatgctggtcaccgtcgtagctggggtcctcatcgtgaagaagtacgtgtgcggaggacgctttctggtccataggtattccgtgcttcagcaacatgccgaagccaacggagtagacggtgtggatgccctcgatactgcgtcacacacaaataagagcgggtatcacgatgacagcgatgaagacctgctggaatag

SEQ ID NO: 4058 - DNA, 2085 bp, Artificial Sequence
  Description of Artificial Sequence: Synthetic coding sequence
atgaccttcggccagagcaagctgtaccggagcgaggactacggcaagaatttcaaagatatcactgacctcattaacaacacttttatcaggactgaattcggcatggcaattggccctgaaaatagcgggaaggttgtgctaacggccgaagtgtccggcggatctcgggggggcaggatcttccgcagctctgatttcgctaagaatttcgtacagacagatctgcctttccatccactcacccagatgatgtattctccacaaaacagcgattatctgctagcattgagtactgaaaacggcctttgggtaagcaaaaactttggggggaagtgggaagagattcacaaagctgtatgcctggctaaatggggatctgataataccatcttcttcaccacttacgccaacggcagttgtactgacctcggcgccctcgagctctggcgaacaagcgacctgggaaagagctttaaaactattggcgttaaaatctattccttcggtttaggcggccggttcctcttcgcctcagtcatggccgataaagacaccacacgccgaatccacgtctccacagatcagggggatacttggtccatggctcagctaccaagtgtcggccaggagcaattttacagtatcctggctgcaaatgacgacatggttttcatgcacgtggatgaaccgggggacacagggtttggcaccatctttacatccgacgaccgcggtatcgtctatagcaaaagcctggaccgccatctatatacgaccacaggtggcgaaacagactttaccaatgtcacctccttacggggagtctacattacaagtgtgctttcagaagataacagcatccagacaatgatcacctttgatcaaggcggtagatggacacacctgaggaaacctgagaacagcgagtgcgatgccacagccaagaacaagaatgagtgcagtctccatatacacgcaagctactccatttcccaaaagcttaatgtgccaatggccccactgtcggagcccaatgctgtgggaattgtgatcgcccatggatccgtgggcgacgccatctccgtgatggtgccagatgtgtacattagcgatgatggcggatactcctggacaaagatgctcgaagggccacactattacactatactggactcaggaggaatcattgtggccatcgaacattcaagtcggcccataaatgtcataaagtttagcactgatgaaggacaatgctggcagacctatacctttactcgggacccaatatacttcacaggcctcgcaagcgagcctggtgctagatccatgaatattagcatctggggctttactgaatcattcctgacgtcacagtgggtgtcatacactatcgattttaaggatattctggagcggaattgtgaggaaaaagattacactatctggctggcgcacagtaccgatcccgaagactatgaagacggttgtatcctgggatataaagaacagtttctccgtctgaggaaaagcagcgtctgtcagaacggtagggactacgtggtgacaaaacagccatcaatctgtctctgttctctggaggacttcctttgtgacttcgggtattataggcccgagaatgattccaagtgtgtcgaacaaccagagctcaaggggcatgacttagagttttgcctgtacggccgcgaagagcacctgacaacaaatggctatcgaaagattccaggcgataaatgccagggcggagttaatcccgtacgggaagtgaaggatctgaagaaaaagtgtacatcgaactttttgagccccgagaagcaaaatagcaagtccaactctgtccccatcattctcgcaatcgtggggctcatgctggttactgtcgtggccggcgttctgatcgtgaaaaagtatgtctgcgggggaagattcctggtgcacagatactcggtcctgcagcagcatgcagaggcaaacggcgtggacggtgtcgacgcgctggatactgcttcccataccaacaaaagcggctatcatgacgattctgacgaggacctgcttgagtag

SEQ ID NO: 4059 - DNA, 1446 bp, Artificial Sequence
  Description of Artificial Sequence: Synthetic coding sequence
atgaaggtgctgagcgagggccagctgaagctgtgcgtggtgcagccggtccaccttacatcgtggttgctcatattctttatactaaagtcaataagctgtcttaaacccgccaggctccctatttaccagagaaaacctttcatcgctgcctggaatgcccccacagaccagtgcctaatcaagtacaatctgaggctcaacctgaagatgtttccagtcatcgggagcccactcgcaaaggcccgcggccaaaacgtgacaatattttatgttaatcggttaggttattacccatggtacaccagccagggcgtacctattaacggggggcttccgcagaatatctcattgcaggtgcatctcgagaaggccgaccaagatattaactactacatacccgccgaggacttctctggtctggcagtgattgactgggagtactggcggcctcagtgggcccgaaactggaactctaaggacgtgtatagacagaaatctagaaaacttattagtgatatggggaaaaatgtatcggctacggatatcgagtaccttgctaaggtgacttttgaagagagtgccaaggcttttatgaaagagaccattaagctcggtatcaagtctcgccccaaaggtctgtggggatactatctttatcctgattgtcacaactataacgtttatgcccccaactacagcggcagttgcccagaagatgaggtgcttcggaacaacgaactttcttggctctggaattcctctgccgctctttatccatccattggggtgtggaagagtctcggtgactctgagaatattcttcggttctccaagttcagagttcatgagtctatgcgcatcagtactatgacctcccatgactacgccctgccagtctttgtgtatacacgcctgggctacagagacgaaccactgttcttcctcagcaaacaagacctagtatctactattggagaatcagccgcgcttggcgctgctggtattgtgatttggggagacatgaatcttactgccagtaaggcgaattgtacgaaggtgaagcagttcgtgtcatccgacctcggtagctacatcgccaacgtcacaagagccgctgaagtgtgctctttgcacctttgcagaaataatggtaggtgcattcggaaaatgtggaacgctccttcatacctgcacctgaaccccgcgtcataccacatcgaagcatccgaggacggggaatttacagttaagggaaaggcctccgataccgatctcgccgtgatggccgatactttttcatgccactgttatcagggctatgaaggagccgattgtcgcgagattaagacagcagacgggtgctctggcgtgtctccttctcccggatccctgatgaccctatgcctgctactgctcgcaagttaccgctctatacagctgtag

SEQ ID NO: 4060 - DNA, 1536 bp, Artificial Sequence
  Description of Artificial Sequence: Synthetic coding sequence
atgggcgtgctgaagttcaagcacatcttcttccggagcttcgtgaagtcatcaggggtgtcccagattgtgtttacgtttctgctcatcccctgttgcctcactctcaatttcagggccccaccagtgatccctaacgtaccctttctctgggcctggaacgcacccagtgaattttgtctggggaagtttgacgaaccactcgatatgtcgctgttcagttttatagggtccccaaggattaatgcaaccggccaaggtgtcacaatcttctatgttgatcgactcggctactacccctatatcgacagtatcacgggcgtcacggtgaacggcggcattccccagaagatttctttgcaggaccacctggacaaagctaagaaagatatcacattctacatgccggtggataatttgggtatggccgtgattgactgggaggaatggaggccaacatgggcacgtaattggaaacccaaggatgtctataaaaaccgctcaatcgaactggtccaacagcagaatgtgcagctcagccttacggaggccacagaaaaagccaagcaagagttcgaaaaggctgggaaagacttccttgtcgaaactatcaagctcgggaaactactgcgccccaaccacctttggggctactacctgtttccagactgttataatcaccattacaaaaagcccggttacaatggcagctgcttcaatgtcgaaatcaaaagaaacgatgatctgtcctggttatggaatgaatcaaccgccctgtatcctagtatttacttaaacacacagcagtctcccgtggccgccactttgtacgtccggaatagggtgcgtgaggcaattcgggtgagcaaaattccagacgcaaaaagcccactacccgtgttcgcctacacgcgcatagtcttcaccgatcaggttctgaaattccttagtcaggacgaacttgtatataccttcggagaaactgtagctctcggagcaagcggaatcgtgatatggggcacattgtcaatcatgagatcgatgaaaagttgcctgctcctcgacaattacatggaaacaatcctgaatccctatattataaacgttacgctcgccgccaagatgtgttctcaagttctgtgccaggagcaaggggtgtgtatccgcaagaattggaactccagtgactatttacatcttaacccagacaacttcgctatccagctcgaaaaaggggggaaattcactgtcagggggaagccgactctggaggatttagaacagttttccgagaaattctactgtagttgttattctaccctgagttgcaaagagaaggcagatgttaaagataccgatgctgtcgacgtgtgcatcgccgacggggtctgtattgatgcttttctgaagcctcctatggagacggaagagcctcaaatcttctacaacgcctccccctcgaccctgagcgcaacaatgttcatctggagactggaagtatgggatcaggggattagccggattggcttcttttag

SEQ ID NO: 4061 - DNA, 1530 bp, Artificial Sequence
  Description of Artificial Sequence: Synthetic coding sequence
atgggcgtgctgaagttcaagcacatcttcttccggagcttcgtgaaatccagcggggtctcacaaattgtattcacattcctgctcattccctgctgcctcacccttaatttccgcgctccccctgtaatccctaacgtacccttcttgtgggcctggaacgctccttcagagttttgcctcgggaagttcgacgaaccgttagacatgtcacttttctcattcattgggtccccccggatcaacgcaactggtcagggtgtgaccatcttctacgtggatagactcggatattatccatatattgattcgatcaccggcgtaaccgtgaacgggggcataccccagaagatatccctgcaggaccatctcgacaaggctaagaaagacattaccttttacatgccagttgataatctgggaatggcagtcatcgactgggaggagtggcgccccacgtgggctaggaactggaaacctaaagatgtgtacaagaacaggagcatcgaactggtgcaacagcagaatgtccaactgtcactgaccgaagcaacagagaaagctaaacaggaatttgagaaggcagggaaagactttctggtggagacaataaagttaggcaagttgctcagaccgaatcatctttgggggtattacctgtttcccgattgctataaccaccactataaaaaacctggctataacgggagctgtttcaacgtggagataaaacgaaacgacgacctgtcctggttgtggaatgagtccactgccctctatccttcgatttacctcaatacacagcagtcccccgtcgcagcaacattatacgttcggaatagagtccgagaggccatccgcgtcagcaaaattcccgatgccaagagcccattgcccgtcttcgcctacactcgaattgtctttaccgatcaggtgctgaaatttctcagccaggatgaactcgtgtacacctttggggagactgttgcccttggcgccagtgggatagtgatttggggcaccctctctatcatgaggagtatgaagagttgtcttcttttagacaactatatggagacgatcttgaatccttacatcataaatgtgaccttagccgctaaaatgtgcagccaggttttgtgtcaggagcagggagtatgcattcgcaaaaattggaactccagtgactaccttcatctcaaccctgataactttgcaattcagctcgagaagggggggaagttcaccgtaagaggtaagcccacgctggaggatctggagcagttttctgagaagttttattgctcttgttattccacactgagctgcaaggaaaaagcggatgtgaaggacaccgatgctgtcgacgtgtgcatcgctgacggtgtatgtattgacgccttcctcaaacccccaatggaaacggaggagccacaaatcttctataatgcatcaccaagtaccttaagtgctacaatgtttatagtaagcatactgttcctgattatctcttccgtggcttctctgtag

SEQ ID NO: 4062 - DNA, 243 bp, Artificial Sequence
  Description of Artificial Sequence: Synthetic coding sequence
atgggcgtgctgaagttcaagcacatcttcttccggagcttcgtgaagtcaagcggcgtgtcccagatcgtttttacattccttctcatcccttgttgtctgactttgaactttcgggccccacctgtaatcccaaatgtccctttcctgtgggcctggaacgcaccttcggagttttgtctcgggaagtttgacgagcccctggacatgagcctgttcagcttcatcggtagccctcggtag

SEQ ID NO: 4063 - DNA, 1530 bp, Artificial Sequence
  Description of Artificial Sequence: Synthetic coding sequence
atgggcgtgctgaagttcaagcacatcttcttccggagcttcgtgaagtcttctggcgtgtcacagatcgtgttcacattcctcctgatcccttgctgcctgactctgaactttcgcgctcccccagtgatccctaacgtgcctttcctctgggcctggaatgccccttcggaattctgtctgggaaagtttgatgagccgttagatatgtctcttttctctttcattggatcacctaggataaacgcaactggccagggggtcactatcttttacgtggaccggctcggatactacccttatatagactctataacaggcgtaaccgtgaatgggggaatcccccagaagatcagtctgcaggaccacctggataaggcaaaaaaggacataaccttctatatgccggtggataatctgggaatggccgtaatcgactgggaggagtggagacccacatgggccagaaactggaaacctaaggatgtctacaagaatcggtcaatcgagctggtgcagcagcaaaatgtgcagctgtcactcactgaagcgaccgagaaagccaaacaggagtttgaaaaagccggaaaagacttcctggttgagaccattaaattaggcaagctgctgaggcccaatcatctttggggatattacctattccccgattgctacaaccatcactataagaaacccggctataatgggagctgttttaatgtagagatcaagcgaaacgatgacctgagctggctgtggaatgagtccacagctctgtacccaagcatatacctcaatacacaacagagccccgttgcagccaccttgtatgtgaggaatagggtgcgggaggcaattagggtctcaaaaatccccgacgccaaatctcccctcccagtgtttgcatatacgcggatagtgtttaccgaccaggttctcaagttcttgagccaggacgagctagtctacacattcggggagaccgtagctctcggcgcatcaggcattgttatttggggtacacttagcattatgagatcaatgaaaagctgtctgctgcttgataactatatggaaaccatccttaacccatatatcatcaacgtgacactggcggctaagatgtgcagtcaggtactgtgtcaagaacagggtgtctgcatccgcaagaattggaactcctctgattatctccatttaaatccggacaactttgctatacagctagaaaaaggtggcaagtttaccgttcgtggcaaacctaccctggaggatttagaacagttctcggaaaagttctactgctcatgttacagcactctctcttgtaaggaaaaagcagatgtgaaggacactgatgcagtggatgtctgcatcgcggatggcgtgtgcattgatgcatttctcaaaccccccatggagacagaggagccccagatcttctataatgcctcaccatctactctatccgctaccatgttcattgtatctatactgtttctcatcataagtagtgttgccagcctttag

SEQ ID NO: 4064 - DNA, 1530 bp, Artificial Sequence
  Description of Artificial Sequence: Synthetic coding sequence
atgggcgtgctgaagttcaagcacatcttcttccggagcttcgtgaaatcttctggagtgagccaaatcgtgttcacttttttgctgataccctgttgcctgaccctgaatttcagggcccctcctgtgattccaaacgttccttttttatgggcatggaatgccccgtccgagttttgcctgggcaagttcgatgaaccactggacatgtcgctcttcagtttcataggcagcccccggattaacgccacgggccaaggcgtgacaatattctacgtggacaggcttgggtactacccctacattgactccattaccggcgtgaccgtgaatggcggtatcccacagaagatcagtctgcaggaccatttagacaaggccaaaaaagatattaccttctatatgccagtggataatcttggcatggcagtgatcgattgggaggagtggcgccccacctgggcaagaaactggaagcccaaggacgtttacaagaatcgctcaattgagcttgtgcagcagcaaaatgttcaattatccttgactgaagctactgagaaggctaagcaggaatttgagaaggcagggaaggattttctggtggagactatcaagctggggaagctcttgcgcccaaatcacctgtgggggtattacctttttcctgattgctataaccaccattataagaagcccgggtataatgggtcatgcttcaacgtggagataaaaaggaatgacgacctcagctggctgtggaacgagtctacggcactgtacccctccatctatctcaacactcaacagtcgcccgtcgcagctaccctatatgtgcgaaacagagtgcgggaagcaattcgggtgagcaaaatcccagatgccaaatcacctctgccggtgttcgcatatactcgtatcgtgtttaccgatcaggtcctcaaatttctgagtcaagacgaacttgtgtacaccttcggagagacagtggcactgggcgcatctggaattgtgatctggggcaccctgtcaattatgcgttccatgaagtcctgcctgctcctggacaattacatggaaacaatactcaatccttacataatcaacgtcaccctcgctgcaaaaatgtgtagtcaggtactgtgtcaagaacaaggagtctgcatccggaagaattggaacagctccgactaccttcatcttaaccccgacaattttgctattcagctagaaaaagggggcaagtttaccgtacgcggaaaacccaccctggaagacttggagcagttctctgaaaagttttactgtagttgctactcaacactctcctgtaaagaaaaggccgacgtgaaggataccgacgccgtggatgtgtgcattgctgacggagtgtgtatcgatgccttcctcaagccacccatggaaacggaggagcctcaaatcttttataacgcaagtccttcgacactgagtgccacaatgtttatcgtgtctattctttttttgatcatcagcagcgtggcttcattatag

SEQ ID NO: 4065 - DNA, 1764 bp, Artificial Sequence
  Description of Artificial Sequence: Synthetic coding sequence
atgccccggtacggcgccagcctgcggcagagctgcccccggagcggacgcgagcagggacaagatggcactgctggtgcccccggactattgtggatgggcctcgttttggcccttgcacttgccctggcattagctctggccctgtccgattctcgggtactttgggctccagctgaggcgcatcctctgagtccccaaggccaccccgcacggctgcacaggattgtacctaggctgcgggacgtgtttggctgggggaacctaacttgtccaatctgtaaaggacttttcacagcaatcaatcttggccttaagaaagagcccaacgtggccagagtcggttcagtggctataaaactgtgcaacctgctgaaaatcgctccgccagccgtgtgtcagagcatcgtccacttgtttgaggacgacatggtcgaggtgtggcggcgctctgtgctgtccccaagtgaggcgtgcggactcttgctggggtccacttgtggtcactgggacatcttttcttcatggaacattagtttgccgactgtgcctaagccaccacccaaacctcctagcccgcccgcacccggagcacctgtcagcagaatcctgttcctaactgacctccattgggaccatgactacctggaagggaccgatcccgattgtgctgatccactctgttgtaggagggggtccggacttccccctgcgtccaggcctggagctggctactggggcgagtatagcaagtgtgatctaccactcagaactctagagagccttttaagtgggttaggccctgccggcccatttgatatggtgtactggactggcgacattcctgctcatgacgtctggcaccagacacgccaggatcagctgagggctctaactactgttacggcccttgtgcggaagtttctgggccctgtccctgtgtatccggccgtcggtaatcatgaatccacgccagtcaatagttttccacccccctttattgagggcaatcattcgtcaagatggttgtatgaagcgatggctaaggcctgggaaccttggctaccggccgaggccctgaggactctgcgctacctcagctctgtggagacacaggaagggaaacgaaaggtccacattatcgggcacatcccccctggacattgtctaaagagctggagctggaattactatcgtattgtggcccggtatgagaatactctggctgcccaatttttcggccacacacacgtggatgagtttgaggtcttctacgacgaagagactctctcgagacccttggcggttgccttcctggctcccagcgctacaacatacattggtctgaaccccggctatagagtctatcaaatagacggaaattactctggctcctcccacgtggtgctggaccacgaaacatatattctgaacctcacccaggctaacattcccggcgcaatcccccattggcagctgctgtatagggcccgggaaacttacggtctccctaacaccctgccaaccgcatggcataatctggtctatagaatgcgcggggatatgcaattgtttcagacattctggtttctataccataagggccatccaccatcagaaccctgcgggactccctgcagattggctactctgtgcgcgcagctctcggcgcgcgccgattcaccggccctttgcagacatttgatgccagacggatccctgccagaggcccaaagcctgtggccgcggccactcttttgctag

SEQ ID NO: 4066 - DNA, 1896 bp, Artificial Sequence
  Description of Artificial Sequence: Synthetic coding sequence
atgccccggtacggcgccagcctgcggcagagctgcccccggagcggccgggaacaggggcaagacggcacagctggcgcaccaggcttgctttggatgggcttagtgctagctctcgccctggccctcgcacttgcgctggctctctccgactctagagtcctctgggcccctgcagaagcacaccctttgtctcctcaggggcaccctgctaggctgcatcgcattgtccccagactaagggatgtattcgggtggggtaacctgacctgtcctatctgcaaaggactctttactgcgatcaatctaggattaaagaaggagcctaacgtggctcgcgtgggaagcgtcgccataaaattatgcaaccttctgaaaatagctccccccgctgtgtgtcagtccatagtgcatctcttcgaggacgatatggtggaagtttggcgacgatcagttctaagtccatcagaggcatgtggcctgctgcttgggagtacatgtgggcattgggacatattttcctcatggaatatttctctgcctaccgtcccaaaacccccaccaaaacccccctctccacctgctcccggggcccccgtgtcaagaattctatttctcaccgacctgcattgggaccacgactatcttgagggcactgaccctgattgcgcagaccccctttgctgccggcgcggtagtggattgccacccgccagccgtccgggagctggctattggggggagtacagtaagtgcgacctccctcttaggaccttggaatccctcctatcagggctcggcccggcggggccattcgatatggtgtactggaccggcgacataccagctcatgacgtgtggcaccagacccggcaagatcaactgcgggctttgacaactgttacagctctggtgaggaagttcctgggtcccgtaccagtctacccagctgtgggcaatcacgagagtacgcccgtgaacagtttccccccgccctttattgagggcaatcatagttctagatggctgtatgaggccatggccaaggcttgggagccttggctccccgccgaagccctgcgtactctgaggataggcgggttctatgctcttagcccatacccaggcctgcgcctcatctcattaaatatgaatttctgctcacgagaaaatttctggttgctgattaactctacagatcccgccggacaactgcagtggctggtcggtgagctccaggctgcagaagaccgcggcgataaggtccatatcattggacacattcctcccggccattgcttgaagagctggtcctggaactattaccgaatcgtcgctcgctatgagaacactctggctgcccagttttttggccacactcatgtggatgaatttgaggtgttttatgacgaggaaactctgtctagacctcttgctgtggccttcctggctccatcagcgaccacctacatcggattaaaccctggctatagagtctaccagatagatggtaactactcgggatcaagccatgtggtattggaccatgaaacctacatcctgaacctgacacaggccaatatccccggcgctatcccccactggcaactgctgtacagggcacgagagacctacggcctgccgaatacgctgcctacagcctggcataatttagtatataggatgcgaggagatatgcagctttttcaaactttctggtttctttatcacaagggtcacccgccatccgaaccctgcggcaccccttgtcgactcgctactctctgcgcccagctgtcagcgcgggcggatagccctgcactttgtagacacttgatgcccgacggatctctacccgaggcccagtctctgtggcctaggcccctgttttgctag

SEQ ID NO: 4067 - DNA, 1728 bp, Artificial Sequence
  Description of Artificial Sequence: Synthetic coding sequence
atgccccggtacggcgccagcctgcggcagagctgcccccggagcggaagagaacaggggcaggatggcaccgcaggggcccccggactgttgtggatgggactggttctggcattagccctcgcactagctctggccttggcgctttctgatagtagagtgctctgggcgcccgccgaagcccacccactgtccccccagggtcatcccgctaggttgcataggatcgtgccacggctgcgcgacgtatttggatggggcaacctgacatgtccgatctgtaagggcctgtttaccgccattaacttgggtttgaagaaagagcccaacgtggctcgcgttgggagtgtggcaattaagctgtgtaacctccttaagatcgcccctcctgccgtgtgtcagagtatagtccacctgtttgaggatgacatggtggaagtgtggagaaggtccgttctgtccccctcagaagcttgtgggctgctcctggggagtacatgcggccactgggatatcttctcgtcttggaacatcagtctgcctacagtacccaaaccaccccccaagccaccctctccacccgcacccggagcccccgtttctagaattttgttcttgactgaccttcattgggaccacgactaccttgaggggactgacccggactgtgccgaccctctgtgctgcagacgcggctcgggccttccgccggcctcacggccaggagccgggtactggggagaatactctaaatgcgacttgccattgcgcactctggaaagcctactgtctgggctgggaccagcaggcccattcgatatggtttactggactggcgacattcccgcccacgacgtgtggcatcagactagacaggaccagcttcgcgccttaacgactgtcacagctctagttagaaaattcctcgggcctgtgccagtttaccccgctgtcgggaatcatgagagtactccggtcaattccttcccccctccctttatagaagggaatcactcttcaagatggttatatgaagccatggctaaagcctgggaaccctggttgccggcagaggccctgcgtaccttgcggaaggtgcatatcattggccacattccccccggacattgcctgaagtcctggtcgtggaattactatcgcatcgtggctcgatacgaaaacacattggcagcccagttctttggccacactcacgtggatgagttcgaagtgttttatgatgaagaaactctgagcagaccgcttgcggttgcatttctggctcctagcgcaaccacatatatcggactgaacccaggctatagagtgtatcagatcgatggcaactattccggaagcagccacgtagtgctcgaccatgagacctacattctgaatcttacacaggccaatataccaggtgctattccacactggcagctcttgtaccgcgctcgcgaaacctatggcctgcccaacactctgccgactgcttggcacaatctggtttataggatgcgcggcgatatgcagttgttccagacattttggtttctataccataagggccacccaccttctgagccctgcggcaccccctgtcggctggccacactatgtgcacagttatctgccagagcggacagcccagcgctttgcaggcacttgatgcctgacggctccctgcctgaagcacagtcgctgtggcccagaccattgttttgctag

SEQ ID NO: 4068 - DNA, 1893 bp, Artificial Sequence
  Description of Artificial Sequence: Synthetic coding sequence
atgccccggtacggcgccagcctgcggcagagctgcccccggagcggacgtgagcaaggccaagacggcacggccggggccccaggtctgctctggatggggttggttttggccctggcactggcacttgccctcgcgctcgccctctctgatagccgcgtgctctgggctcccgcagaagcccatcctctcagtccgcagggacatccagcccggctccacagaattgtgcccaggctaagggatgtgtttggctggggcaacctaacgtgtccgatctgcaagggtctgttcactgctataaacctgggcttaaaggagcctaacgtcgcccgcgtaggatccgtagccataaagctttgtaatctgctgaagattgcccccccggctgtatgtcagagcattgttcaccttttcgaggacgacatggtggaagtctggcgcaggagtgtgctgagtccttctgaggcctgcgggctgctgctgggtagtacctgtggacattgggatatcttctcttcctggaacatctccctgccaacagttccaaaacctccacctaagccacccagcccacccgcccctggtgcacctgtcagtaggattttgtttcttaccgacctgcactgggaccacgattacctcgaagggactgatccggactgcgctgacccattatgctgcagaaggggcagcgggttgccacccgcgagcaggcctggcgccggctactggggcgaatatagtaagtgcgatctgcccctgcgcaccttagaatctctactgagcggactgggcccagcgggaccattcgatatggtgtattggacgggtgatatcccagctcatgatgtgtggcaccaaactaggcaggatcaactgcgagctctgacaaccgtgacggccctggtcagaaagtttctgggcccagtgcccgtttatcccgcagttggcaaccatgagtctacgcccgttaacagttttcccccaccctttattgagggcaaccactctagtcgttggttgtacgaagccatggccaaagcctgggaaccgtggctgcccgccgaggccctccgcaccctaagaattggtggcttttacgcgttaagcccctatcccggactcaggttgatctccctgaacatgaacttctgctctcgggagaacttctggctcttgatcaattctacggatccagcagggcaactgcagtggctcgtcggcgaactacaggctgcggaggatagaggcgataaggttcatatcataggccacattccgcctggccattgcctgaagtcatggtcttggaattactatcgaattgtggctcggtatgagaataccctcgccgctcagttcttcggacacactcatgtagacgagtttgaggtattttatgacgaagagactttgagccgtcctctcgccgtcgcttttctggcgccctccgccaccacctatatcggcctgaatcctggatatagagtctatcagatagacggtaactactcaggcagctctcacgtggtgctggatcacgaaacctacatactgaatttgacccaggccaacattcctggagcaatcccccactggcagctgctatatagagctagagagacatatggactgccaaacaccctccccactgcatggcataaccttgtgtatcggatgcggggcgacatgcaactgtttcagaccttctggtttctgtaccataaaggacatcccccatccgagccatgtggaactccttgtcgactggcaacgctttgtgctcagctgtcggcccgagcagatagcccagcattgtgtcgtcacctaatgcctgatggtagtttgcctgaagcccagagtctgtggcctcggcctctgttttgttag

SEQ ID NO: 4069 - DNA, 1101 bp, Artificial Sequence
  Description of Artificial Sequence: Synthetic coding sequence
atgccccggtacggcgccagcctgcggcagagctgcccccggagcggacgggagcagggccaggatggtaccgccggcgcccctggcttactgtggatgggcctagtcctggcgctagccctggctctggccctagcactcgccctatccgatagcagagtgctgtgggccccggccgaggcccacccgctgtctccacagggccatcccgcacgactccaccgtatcgtgccccggctacgggatgtgttcggctggggaaatctcacttgccctatctgtaaaggtctgttcactgccatcaacctgggcttgaagaaggagccgaatgtggccagagtcggatcagtggctattaaattgtgtaaccttctaaaaatcgccccacctgctgtgtgtcagtcaattgtgcatttgtttgaggacgatatggtagaggtgtggaggaggagcgtgctttccccatctgaggcctgcggtttgctcctgggctccacctgtggacattgggacatttttagctcctggaacataagtctgccaacagtcccaaaaccaccccctaaacccccttccccccctgccccgggagcccccgtctcaagaatcctgtttctgaccgacctccattgggatcatgactatctggaaggtactgaccctgactgtgccgaccccctttgctgcagacgtggaagtggcttgcctcctgcttcccgacctggtgcaggctattggggcgaatacagcaaatgcgatctgccccttaggactttggagagccttctgagcggcctcggcccggctggccccttcgatatggtatattggacaggggacatccccgctcacgatgtttggcaccagacacgacaggatcaactgcgcgctctgaccacagtgaccgcattagtccggaaattcctgggccctgtgccggtgtatcctgccgtcgggaatcatgaatccacccctgtgaacagtttcccccctcccttcattgaaggcaatcacagtagccgctggttgtacgaagccatggccaaagcatgggagccttggttgcccgcggaggcgcttcgaaccttgagatgtatttag

SEQ ID NO: 4070 - DNA, 1209 bp, Artificial Sequence
  Description of Artificial Sequence: Synthetic coding sequence
atgccccggtacggcgccagcctgcggcagagctgcccccggagcgggagggagcagggacaagatggtacagccggtgcccccggtctgctgtggatgggcttggtccttgcgctggcactggccctggcgttggccttggccctgtccgacagtcgagtcctgtgggctccagccgaggcgcacccactatcgccccagggtcatccagctaggctgcacagaattgtcccacggctgcgggacgtgtttggatggggcaacttgacctgtcccatatgtaaagggctgtttaccgcaatcaacctgggcctgaagaaagagcccaacgttgcaagggttggaagcgtggcaataaaattgtgcaacctcctgaaaatcgctcccccagctgtgtgccagtcaatcgtgcatttatttgaggacgacatggtggaagtatggagacgctcagtgttaagcccctctgaagcatgcggactgctacttggaagcacttgcggccattgggacatcttctcttcttggaacatttctctgcccacagtgcccaagcctccaccaaaaccaccctccccccctgcacctggtgcgccagtgtcccggattcttttccttaccgatcttcactgggatcacgattatctggaaggtaccgatcccgattgtgcagatcctctatgttgccggcgcggtagcggattaccaccggcaagtcgaccaggcgccggctactggggtgagtactccaagtgcgacctgcctctcagaacccttgagtccttgctttccgggctcggtcctgctggaccgtttgacatggtctattggaccggcgacattcccgctcacgatgtgtggcaccaaacgaggcaggatcagcttcgtgcacttaccaccgtaacggccctcgtgcgcaagtttctggggcccgtacctgtttacccagccgtagggaatcacgaatccacaccagtgaattcattcccccctccgttcatagaaggcaaccattctagtaggtggctatacgaggctatggcgaaagcctgggaaccatggcttcctgctgaagccctgcgaaccctccggtacctcagttcggtcgagacacaggaaggcaagagaaaaaactggggcgtgctgtgcagctttcccattccccggtctcctcctcacctctcgcagtatgaatttcttttcccatag

SEQ ID NO: 4071 - DNA, 954 bp, Artificial Sequence
  Description of Artificial Sequence: Synthetic coding sequence
atgtacaacatgatggagaccgagctgaagccccccggcccccagcaaacgtctggcggtggaggcggcaactccacggccgcagccgctggtgggaaccagaagaattcccccgacagagtgaagagaccgatgaatgccttcatggtttggagccggggacagaggcggaaaatggcccaggagaatcctaaaatgcacaattcagagatttctaagcgtcttggcgcagagtggaagctgctctccgagacggagaaacgtccattcattgacgaagccaagcgcctgcgcgcacttcatatgaaagaacaccccgactacaaatacaggccgagaagaaagactaagacattaatgaaaaaggacaaatatacactgccgggtgggctacttgccccgggggggaactcaatggcctcaggagttggtgttggggcaggcttgggggcgggagtaaaccagcggatggacagttacgcccacatgaacggttggagcaatggatcatattcaatgatgcaggatcagctgggatatccacagcaccctggcctgaatgcacacggagctgctcagatgcagccgatgcatcggtacgacgtctcggcactgcagtataacagtatgacttcttcacagacctacatgaacggatcacccacttactccatgagttactcccaacaaggtacccctgggatggctctgggttccatgggatccgttgtcaagagcgaggcaagctcctcacctcctgtggtcacttcttcatcacattcacgcgctccatgccaagccggggatctgcgggatatgatttctatgtatctgccgggggcggaagtgcccgaacccgctgcaccatcacgcctccacatgagtcagcattatcaatctggacctgtgcctggcacagctataaacggaacattgcctctatcgcatatgtag

SEQ ID NO: 4072 - DNA, 954 bp, Artificial Sequence
  Description of Artificial Sequence: Synthetic coding sequence
atgtacaacatgatggagaccgagctgaagccccccggcccccagcaaacttccggaggcgggggcggcaactcaacagccgctgctgccggcggcaatcagaaaaattcgcccgacagagttaaaagaccaatgaacgcgttcatggtgtggagcagaggtcagagacgcaaaatggcacaggaaaatccaaaaatgcataacagcgagattagtaaaagactcggcgctgagtggaagctgctgtctgaaactgagaagaggcccttcatagatgaggccaaaagactcagagcccttcatatgaaagagcaccccgattataagtaccggccaagacgaaagacaaaaactctaatgaaaaaagataagtataccctgcctggggggttgctggccccaggcggcaatagcatggcctctggcgtgggcgtcggcgccggcttgggggccggcgttaaccagcgaatggattcatatgctcacatgaacggttggtctaacggaagttactcaatgatgcaggatcagcttgggtatcctcagcaccccggcctgaatgcgcatggggctgctcagatgcagccaatgcatcgctacgacgtgtcggctctacagtataactcaatgacatcttcgcaaacatacatgaatggcagccccacctactccatgagttactcacagcagggtaccccgggtatggccctgggctccatggggtccgtggtgaagtcagaagccagctccagccctccagtcgtgacaagctcaagccactcccgcgccccctgccaggccggagacctcagagatatgatttccatgtatctgcctggtgccgaggttccagaacccgccgcaccttccaggctccacatgtctcaacattatcaaagtggacctgtgccaggcacagctatcaatggcacgttgccactctcccacatgtag

SEQ ID NO: 4073 - DNA, 1182 bp, Artificial Sequence
  Description of Artificial Sequence: Synthetic coding sequence
atgcaccaggccggctaccccggctgccggggcgccatggccgagtctcacttactgcagtggcttctcttactccttccaactctgtgcggtccagggacagctgcttggaccacatcatcgctggcctgcgcgcaaggaccagagttctggtgccagagtctggagcaagcactgcagtgccgcgcacttggtcattgcctgcaggaagtgtggggacacgttggcgctgacgatttgtgccaggagtgcgaagacatagtccatattctgaataagatggcaaaggaagctatttttcaggacacaatgaggaagtttctggaacaggagtgcaacgtgctcccattaaaattgcttatgccccagtgcaatcaagtgctggacgattactttccgttggtgatagattacttccagaatcagaccgattcaaacgggatctgcatgcatctcggtttgtgcaaatctcgccaacccgagcccgagcaggagcctgggatgagcgatccgcttcctaagccacttcgtgatcctcttcctgacccgttacttgacaagctggtgcttcctgtcctgcctggcgccttacaggctcgacctggcccacacacccaagatttatctgagcagcagttcccaatacccttgccatactgctggctttgtcgggccctgattaaacgcatccaggctatgatccccaagggcgcattggcagtggcagtggctcaggtatgccgggtggtaccattagtcgcaggtggcatatgtcagtgtctcgcagaacgctacagcgtaatcctgctggacaccctgcttggcaggatgctgcctcagctggtgtgcagactggtgctccggtgttctatggacgactctgctgggcctaggagtcctaccggcgagtggctcccacgcgacagcgagtgtcacctttgcatgagcgttaccacccaggcagggaattctagtgaacaggcaatccctcaggctatgctacaagcatgcgttggcagctggttggatcgggagaagtgcaaacagttcgtggagcagcataccccccagctgctgaccctggtcccgcggggttgggatgcccacaccacatgccaggccctcggagtctgtgggactatgagttcacctctgcagtgtattcactctccagacttgtag

SEQ ID NO: 4074 - DNA, 1182 bp, Artificial Sequence
  Description of Artificial Sequence: Synthetic coding sequence
atgcaccaggccggctaccccggctgccggggcgccatggccgagagccatctccttcaatggttacttcttctccttcccacactgtgtggaccaggcacagccgcttggaccacatctagcctggcttgcgcgcaggggcctgagttctggtgtcagagcctcgaacaagctttgcagtgccgagccctgggccattgcttacaagaggtatggggtcacgtcggagccgacgacttgtgtcaggagtgcgaggatattgttcacattctcaataagatggctaaggaggcaatattccaggatactatgcgaaagttcctggagcaggagtgcaatgtgctcccactcaagctgttgatgcctcagtgtaaccaggtgctggatgactatttcccgctggtgatcgattacttccagaaccagacagatagcaatggaatttgtatgcatctaggcctgtgtaaatccagacaaccagaacctgagcaagagcctgggatgtcggacccattaccgaagccacttcgagacccgttgcccgatcctcttctggataagcttgtcctgcccgttctgcctggcgctctccaggccaggcccggcccgcatacccaggatctttccgagcagcaattccccatcccccttccctattgctggctgtgcagagcccttattaaaagaatacaagctatgattcccaaaggagcattagctgtggctgtcgctcaggtgtgccgggtggtacctctggttgccgggggcatctgtcagtgcctggccgaaaggtattccgtgattctgctggacacactgctgggacgcatgctgccccagctcgtatgccggctcgtgctgaggtgtagtatggatgatagcgccggtcctcgttccccgactggcgaatggcttcccagagatagtgagtgtcatctctgtatgtcagtgaccacccaggcgggtaattcgagcgaacaagccatacctcaagcgatgctgcaagcatgcgttggaagctggctcgaccgcgaaaaatgcaagcagttcgtcgaacagcatactcctcaactgttgactctcgtccccagaggctgggacgcacatacaacatgccaggctctgggcgtgtgtggaacaatgagtagccctctacagtgtatccattctccagatctttag

SEQ ID NO: 4075 - DNA, 1050 bp, Artificial Sequence
  Description of Artificial Sequence: Synthetic coding sequence
atggccgagagccacctgctgcagtggctgctgctgctgctgcccacactgtgcggacctggcaccgctgcttggaccacgtcctccctcgcgtgcgcccagggtcctgaattttggtgtcagtcactggaacaggccctgcagtgccgggcccttggccattgcctgcaggataccatgcgcaaatttctggagcaagaatgcaatgtgctgcctctgaagctgcttatgcctcagtgcaaccaggtgcttgacgattacttccccctggtcattgactacttccagaatcaaacagactctaacggcatatgtatgcacctaggcctttgcaaatccaggcagcctgagccagaacaggagccagggatgtccgatccactgcccaagccactcagagaccccttgcctgaccccctgctggacaaactggtgctcccggtgttgcctggcgctcttcaggctcgcccggggccccacactcaagatctaagtgagcagcagtttcccatcccgttaccctactgttggttgtgtagggccttaatcaagaggatccaggccatgatccctaagggcgccctcgccgtcgcagtggcccaagtgtgtcgcgttgtgcccctcgtcgccggcggtatctgccaatgcctggctgaacgttattctgtgatcttgctggataccctgctcggacggatgctgccacagctggtctgtcggctggttctcaggtgcagcatggacgattcggcgggccctcgttcacctacaggagaatggttgcctagagacagcgaatgtcacctgtgtatgtctgttactacccaggctggaaattccagcgagcaggcaatcccccaggccatgttgcaggcatgtgtcggttcatggctcgaccgcgagaaatgtaagcagtttgtggagcagcatacccctcagctgctgactcttgtgccccgagggtgggatgctcacactacgtgccaggccctgggtgtgtgtggtaccatgtcatcccccctgcagtgcattcatagccctgacctctag

SEQ ID NO: 4076 - DNA, 1152 bp, Artificial Sequence
  Description of Artificial Sequence: Synthetic coding sequence
ggcgccatggccgagagccacctgctgcagtggctgctgctgctgctgcctacactgtgtggccctggcactgccgcctggacgaccagctcattggcatgtgcccagggacccgagttttggtgtcagagtcttgaacaggctttacagtgtagagcgctgggacattgtctacaggaggtgtggggccacgtgggggccgatgatctttgccaggagtgtgaggatattgtccatattcttaacaagatggccaaggaggccatcttccaagacactatgagaaagttcctggaacaggagtgcaacgtcttacctctcaaactactcatgcctcaatgtaaccaggtgctcgacgactactttccattagtgatcgactacttccagaaccagactgattctaatggaatctgcatgcacctgggcctgtgcaagagcaggcagcccgagcctgagcaggagcctggcatgagtgaccctctgccaaagccgctgagggatcccctgcctgatcctctcctggacaaactcgtactgcctgttctgcccggggcacttcaggctcgtccaggacctcacacacaggacctgtctgaacagcagtttcctatcccattgccctattgttggctctgtagagcactcatcaaaaggattcaggcgatgataccaaaaggggccctggccgtcgctgtagctcaggtttgtcgggtggtcccactcgtcgcagggggtatctgccagtgcctggctgagcgctattcggtcattcttcttgacaccctgctggggcgcatgcttcctcagctggtctgtaggctcgtcctccggtgctcgatggatgactccgctggcccccggagcccaactggggagtggttacctcgtgactccgagtgccacctgtgtatgagtgtgacaactcaagcgggtaactcatccgaacaggctatcccacaggcaatgctccaagcgtgcgtgggctcttggctggatcgcgagaagtgcaagcaattcgtcgaacagcatacgcctcagctgctcacactcgtcccacggggctgggacgcacatactacctgccaagcactgggagtgtgtggtaccatgtcttcgccactgcaatgcatacactcgccagacttatag

SEQ ID NO: 4077 - DNA, 1728 bp, Artificial Sequence
  Description of Artificial Sequence: Synthetic coding sequence
atgctgggcgtgctggtgctgggcgccctggccctggccggcctgggcttccccgctccagccgaaccccaaccgggtggatcacaatgtgtagaacacgactgctttgccctataccctggaccagcaactttcctgaacgcatcacagatttgtgatggccttcgtgggcacttaatgacggttaggagctctgttgccgccgatgtaatctcattgctcttgaacggtgacggtggcgtggggcgcagacgcttgtggatcgggctgcagcttccacctggttgcggcgatcccaagcggcttggaccattgcggggcttccaatgggtgacgggagacaataacacgtcatactcacgatgggcaaggctcgatctgaatggcgcgcctctgtgtgggccactatgtgtggccgtctcagcagccgaggccactgtgcccagtgagcccatttgggaagaacaacagtgtgaagtcaaggcagatggattcctctgcgagtttcattttcccgctacatgcagacccctggctgtcgagcccggagcagccgctgctgccgtttcaataacctatggaaccccattcgccgctaggggcgctgatttccaggccttaccggtcgggtccagtgccgccgtggccccacttggactccagctcatgtgtacagcgccgccaggagccgtgcaggggcactgggctcgcgaagctccaggagcgtgggactgcagcgtggagaacgggggatgtgaacatgcctgtaatgctattcctggggcaccgaggtgccagtgtccagcaggtgcagcactacaggctgacggaaggagctgcactgcatctgccacacagagctgtaatgacctctgcgagcatttctgtgtgcctaacccagaccagcctggatcctactcgtgcatgtgcgagaccggctatagactggcggccgaccaacatagatgtgaagatgtggatgattgcatccttgagccctccccatgcccgcaacggtgcgtgaatacacagggcggctttgagtgccattgctaccctaattatgacctggtcgatggcgagtgcgtagagcccgtcgatccatgctttagagcgaattgtgaatatcagtgccagccactgaaccagacctcttacctgtgtgtgtgcgccgaggggttcgcccccatccctcacgagccacaccgctgtcagatgttttgcaaccaaacggcatgcccagcagattgcgatccaaacacgcaagcaagctgcgaatgccccgaaggatacatactggacgatggatttatatgcaccgacatagatgaatgtgaaaatggcgggttctgctctggagtctgccataacctccctgggacttttgaatgtatttgcggtcctgacagcgcactggcaaggcacataggcaccgattgcgacagtggtaaggtcgacggaggtgactccgggtctggggagccacccccctcccctacgcccgggtctacactcactcctccggcagttggactggtgcatagcggacttctgataggcatcagtatcgctagtttgtgtctggttgtcgctttgctagcactgctctgccatctgcggaagaagcagggagccgctcgggctaagatggaatataagtgtgccgccccaagcaaggaggtagtcttacagcacgttagaactgagagaacacctcaacggctttag

SEQ ID NO: 4078 - DNA, 1674 bp, Artificial Sequence
  Description of Artificial Sequence: Synthetic coding sequence
atgagcgaggccgccagccagggcctgcgggccgccgcccggagcgtgtgggccggcaccgatcgaagaggatgccgccatcgaaggccagtgcccttgtgtagcggtacagcgctttctcagtgcccccgctttccgcgccgactgcacgccgctcggctgggcaatatgttaggggtgcttgtcctcggtgcgctggcccttgctggccttgggtttcccgctccaggctgtggcgacccaaagcgcctgggccccctccgagggttccagtgggttactggtgacaacaacaccagttactccagatgggcccggttggatcttaatggtgcaccactgtgcggacctctgtgtgtggccgtgtctgccgccgaggcaacggttcctagtgagcccatctgggaggagcagcagtgcgaggtcaaagcagatggctttttgtgtgaattccatttccctgccacatgtagacccctcgccgtggagcccggggcagccgctgcggctgtttccatcacctatgggactccgtttgccgctagaggggccgacttccaggcactccctgtgggaagctccgcggcagtggcccctctgggtctgcaattgatgtgcacagctccaccgggagcagtacagggccactgggctagagaagccccaggtgcctgggattgtagtgtcgagaatgggggctgtgaacacgcctgtaatgcaatccccggcgcgccccgttgccagtgtcctgcaggggcagcgttgcaggctgatggtaggtcctgtacggcctccgccacccagtcttgtaacgatctgtgcgagcacttctgtgtacctaatccggatcagccgggctcctattcttgtatgtgcgaaacaggatatcgcctagcagctgatcagcatcgctgtgaggacgttgatgactgcattctggaaccgtcaccttgtccccagaggtgtgtgaacactcaggggggttttgagtgtcactgttaccccaactatgatctggttgacggagagtgcgtcgagccagttgatccatgtttccgggcaaattgcgaataccaatgtcagcctctcaaccagacatcttatctgtgcgtgtgtgcagagggatttgcccctattcctcacgagccacatagatgccagatgttttgcaaccaaactgcctgccctgcggactgtgaccccaatacacaagcatcttgtgagtgtcccgaggggtacattctggacgacggattcatatgtaccgacatcgatgagtgcgagaatggggggttttgcagcggcgtatgccataatctcccagggacctttgagtgcatatgcggacccgattctgcgctggctcgacatattggaacagattgtgattcaggaaaggtcgacggtggagactccggttccggcgagcctccgcccagccccacacccgggtctactctcaccccgcctgctgtgggactggtgcactctggcttgctgatcggcatcagtattgcctccctttgtctcgtcgtggcgctcctggcacttctgtgccacctgcggaaaaagcagggcgctgctcgggctaagatggaatacaagtgtgctgccccctctaaggaagtcgtgcttcagcacgttcgcacagagcgtacaccgcagaggctgtag

SEQ ID NO: 4079 - DNA, 1062 bp, Artificial Sequence
  Description of Artificial Sequence: Synthetic coding sequence
atggagctgaccgagctgctgctggtggtgatgctgctgctgaccgcgcgcctgactctttcaagccccgcgccccctgcatgcgatttgagagtgctgtcaaaactgctgagagacagccacgtgctgcatagtcggctgtcccaatgcccggaggttcatcccctgcctacgccagtgctcctacctgcagttgactttagtcttggggagtggaagacccagatggaggagacgaaggcccaagacatcctaggtgcagtgactttgctgttagaaggtgtgatggccgctagagggcaacttggtcccacatgtctcagctctttgctcggacagctgtctgggcaggtgcgtcttctgctaggtgcgctgcagtccctcctcggaacccagctcccacctcagggtaggacaactgcacataaggatcccaatgctatctttctcagctttcagcacttgcttagaggcaaagtacgcttccttatgctggtcggtggatccaccttatgcgtcagacgagcccctccgacaacggctgttccatcgaggacatcactggtactcactttaaatgaacttcctaaccgaacctctggactcctcgaaacaaatttcaccgcgtccgcgaggacaactggatcaggactgctcaaatggcagcagggcttccgcgcaaaaattcccggcctcttgaaccagacatcacgaagtctggatcagatccctggatacctcaacaggatccacgagctgctgaacggaactaggggcttatttcctggtccctcacggaggacactgggggctcctgacatctccagcggcaccagtgacactgggtccttgcctcccaatctgcagcccggctactccccatctcctacccacccgccgacaggacagtatacgcttttccccctgcctcctaccctacccacgccagttgtgcagctgcacccacttctgccggacccgagtgcgccaactccaaccccaaccagcccattactgaatacgagctacactcacagtcaaaacctgagccaggagggctag

SEQ ID NO: 4080 - DNA, 945 bp, Artificial Sequence
  Description of Artificial Sequence: Synthetic coding sequence
atggagctgaccgagctgctgctggtggtgatgctgctgctgaccgcacgactgactctgtctagtcctgcacccccagcctgcgatctgcgggtgctgtccaaattgttacgggactcacatgtcttgcacagtcggctcagccaatgcccagaggtccaccccctgccgacacctgtgctgctcccggccgtggactttagcctcggcgagtggaagacgcagatggaggaaactaaggctcaggatattctgggtgcagtgacgttgcttctggagggagttatggcagccaggggccagctgggacccacctgtcttagcagcctcctcgggcagctctctggccaggtgcggctgctgctcggagcactccaatctttgctgggtacacaactccctccccagggcaggactactgcccacaaggatccgaacgctatattcctgtcttttcaacacctgctgcgaggcaagacctcagggctgttggaaacaaatttcactgcctccgctcgaaccacaggcagcgggctgctgaaatggcaacagggctttcgcgctaaaataccaggcctcttgaaccagacgagtagatccctggaccagatccccggttatctgaaccgcatccatgaactcctcaatgggacaaggggtctgtttcccggccctagtcggagaaccctgggcgcccctgatatatcctcggggacctcagataccggatcactaccccctaatttgcaacccggatattctccttcacctacccatccacctacgggtcagtacaccctgtttccccttcctcccactctcccaaccccggtggtgcagctgcatcctctccttccagatcctagtgctccaacgcccactccaacttcacctctgctcaacacgtcatatacccactcccagaacctgagtcaggaggggtag

SEQ ID NO: 4081 - DNA, 861 bp, Artificial Sequence
  Description of Artificial Sequence: Synthetic coding sequence
atggagctgaccgagctgctgctggtggtgatgctgctgctgaccgctcgattaacccttagctcccccgccccacctgcctgcgacctccgggtcctgagtaagctactccgggacagccatgtgctccacagtcgcctgagtcagtgtccagaggtgcatcccctcccgacacctgtattgctgcccgccgtcgacttctccctgggagagtggaaaacgcagatggaagaaacgaaggctcaagatatcctgggagccgtaacactgctgctagaaggggtgatggccgccaggggccaactcggccctacctgcttaagtagtctcctcggacagttaagcggccaggtgagattactgctcggcgccctccagtctctcttggggactcagctcccacctcagggtcgcacaacagcccataaagatccaaatgccatcttcttatcttttcagcacctgctccgagggaaggacttctggattgtcggcgataagctacattgcctgtcccaaaattattggctctgggcaagcgaggtcgcagctggaatccagagccaggattcttggtccgcagagccgaacttgcaggtgcctggccctaacccacgaattccagaacaggatactcgcacactggagtggaactcatggacactctcgtggactctgacccaggacccaagaagtccaggacattttctaagaaatattagacaccgtcttcctgccacgcaacctccagcatggattttcagcttcccaaatccctcttcatattggacagtgtacgccctgcccagttctacccacctggcacatccctgtggaccagcccctccccctgcttcttag

SEQ ID NO: 4082 - DNA, 1050 bp, Artificial Sequence
  Description of Artificial Sequence: Synthetic coding sequence
atggagctgaccgagctgctgctggtggtgatgctgctgctgaccgccagactaacattgtcttctcccgcacctccagcctgcgatcttagagtgcttagcaagttgctgcgcgactctcacgtgctgcactcaaggctgagccagtgccctgaagtgcaccccttgccaaccccagttctgttgccagccgtggacttctcccttggcgagtggaagacccagatggaggaaaccaaggctcaagacattctgggcgcagtcactttactattagagggagtgatggccgctcgaggacagctcgggcccacctgtctgtcttccctgctgggacagctgtctggccaggtgcgtctgctgttgggagcactgcagtcgcttcttggaacgcagggacgcacaactgcgcataaagaccccaatgccatcttcctctccttccagcacctgctacgcgggaaagtgcgcttcttgatgctcgttggcgggtctaccttgtgtgtgaggagggctcctcccacaacagcagtgcccagccgtacttctctcgtgctgacgcttaacgagttgcctaaccgtacatctggccttctggaaactaattttacagccagtgcccgtaccaccggctccggactgctgaagtggcaacaaggatttcgagctaagatccccggcctgctgaatcagaccagccggtccctggatcagatccctggctacctcaataggatccacgagctcctaaacggcacaaggggcctcttccccgggcccagtcgcagaactttgggggctccagatattagcagcggaacctctgatacgggttctttgccgcctaacctgcagcccggatattcaccgagcccgacccacccacctacagggcagtacacccttttcccactgcccccaactttgccaacaccggtcgtgcagcttcatcctctgctgccggatccatccgctcccacccccacaccgacttcccctctcctaaacacttcttatactcatagccaaaacttgtcacaggaagggtag

SEQ ID NO: 4083 - DNA, 963 bp, Artificial Sequence
  Description of Artificial Sequence: Synthetic coding sequence
atgcccatgtaccaggtgaagccctaccacggcggcggcgcccccttgagagtcgagcttccaacatgtatgtacaggctgccgaatgtccacgggaggtcctacggacctgcccccggggcgggacacgtgcaggaggaaagcaacttgtctctgcaagccctggagtctcgccaggacgacattttaaagcgcctttatgagctgaaagcagcggtggacgggttgtccaaaatgatacagacaccagacgctgatcttgacgttactaacataattcaggcggacgagcctacaaccctgacaaccaacgcgttggatctcaatagcgtgttgggcaaggactatggcgccctcaaggacatcgtgataaatgccaacccagcatcaccacctcttagcctgcttgtgttgcacaggctgttgtgcgagcacttccgcgtgctgagcacagtgcacactcactcatcggttaagtccgtgccggagaatctgttgaagtgcttcggagaacaaaataagaaacaacctcgccaggattaccaactcggctttactttgatctggaagaacgtacctaagacgcaaatgaagttctccattcaaactatgtgtcctatcgaaggtgagggcaatatcgcccgattcctgttctctctctttgggcagaagcacaatgcagtgaacgccactctgattgactcatgggtggatatcgccattttccagttgaaagaagggtctagtaaagaaaaagccgcagtattccgttctatgaatagcgctctcgggaagtctccttggctggccggaaatgagttgaccgtcgcagatgtcgttctctggagcgttcttcagcagatcggaggatgttctgtgacagtgcctgcaaacgtacaaaggtggatgcgttcctgcgaaaacctggcaccgttcaacaccgccttaaagcttctgaagtag

SEQ ID NO: 4084 - DNA, 1068 bp, Artificial Sequence
  Description of Artificial Sequence: Synthetic coding sequence
atggagcggctgtggggcctgttccagcgggcccagcagctgagcccccgaagttctcagaccgtgtatcagagagttgaaggcccgcgaaagggacatctggaagaggaggaggaggatggggaagagggagccgagactctggcacacttctgtcctatggagctccgcgggccagagccactgggtagcaggcctagacaacccaatttgataccatgggctgccgctggtaggagagccgctccctacttggtgctaacagcacttctgatatttaccggagccttcttattggggtatgtcgctttccgagggagttgtcaggcctgtggagattccgttctggtcgttagcgaagatgtaaattatgaaccagacctggacttccatcaggggcggttgtattggtcggatctgcaggctatgttcctgcagtttcttggtgaggggcggctggaggataccatcagacagacgagcctccgggaaagagtcgcaggttccgcaggaatggcagcactgacccaggatatccgggctgcgctatccaggcagaagctggatcatgtctggaccgatactcactatgtagggctacagttccccgacccagcgcatcccaacactctccactgggtagatgaggctggcaaggtgggcgaacaactgccattggaggatccagacgtctactgcccttatagcgctataggaaacgtgacgggggagctggtgtatgcgcattacggcaggcccgaagacctccaggaccttcgcgctcggggggtggaccctgtcgggagattgctgctggtgcgagttggcgtcatttcgtttgcccagaaagaggctcaacgaccttgtggccctccccgaatggcaggtgagcccccaagattacctctcagcccaggacctagagctacaaccgccgcgtcggggcaacagagccaggatttacacccccatcagcagcatttgcggctgcacagaaggcccctgcgagcaaggagtctgcgatgccacagaggccctgagggttgcatgggcccaaggtcttcatag

SEQ ID NO: 4085 - DNA, 2406 bp, Artificial Sequence
  Description of Artificial Sequence: Synthetic coding sequence
atggagcggctgtggggcctgttccagcgggcccagcagctgagcccacgatccagccagacagtgtaccaacgtgtggagggccccagaaaagggcatcttgaggaagaggaggaagacggagaagagggagccgagactctggcccacttttgtccaatggagttgcgcgggcccgaaccactgggatcacgacccagacagcccaatctgataccgtgggccgcagctggccgacgcgcagccccatacctggtcctgactgctctcctgatattcacgggcgcctttttgctgggctatgtggcttttcgtggatcttgccaggcatgcggcgactcggtattagtggtgagcgaagatgtgaactacgagcccgatctcgatttccatcagggtaggctgtattggagcgatctgcaagctatgtttttacagttccttggtgagggacggctggaggataccattcgccaaacctcactgagggagcgggtcgcaggatccgctggcatggctgccttgacacaggatatccgcgccgcactgtctcggcagaagctcgatcatgtttggacagatactcactacgtagggctgcagtttcccgatcccgcacaccccaatacccttcattgggtcgatgaggccgggaaggtgggagagcaacttcccctcgaggaccctgatgtgtattgtccctactccgccattggcaatgtcaccggagagctggtgtatgctcattatggcagacccgaagatctgcaggacctgcgagcacgcggggtcgaccctgtaggtaggttgctgctggtccgcgtcggcgtcatatctttcgctcagaaggttacaaatgcacaggacttcggggcacagggggtgcttatctacccagagcctgccgatttctctcaagacccgccaaaaccatccctgagttctcagcaggccgtgtatggtcatgtccacttaggcaccggtgatccatatacacccgggttcccaagctttaatcagactcagttccctccagtggcctcctccggtttgccctcgatcccggcccagccaatcagtgctgacattgcctctcgattgcttcgcaagctcaaagggccggtggccccacaggagtggcaaggatcactacttggaagtccataccacctgggtcccggtcccagattaagattggttgttaacaaccaccgtaccagtacccccattaacaatatttttggatgtattgagggacggtcagagcctgaccactatgtggtgatcggcgcccagcgagacgcttggggaccgggagccgccaaatccgccgtaggcactgcaatcctgcttgagttggtaagaacgttcagttccatggtgtcaaacgggttcaggcccagacggagtctgctgtttatttcatgggatgggggggactttggcagcgtcggttcaacggaatggctggaagggtatctttccgtgctacacctcaaagccgtggtgtatgtgtcactggacaatgccgtgctgggagacgataagttccacgctaagaccagtcctctgttaacatccctgattgagtccgtcttgaaacaggtggactccccgaaccactccgggcagaccttgtacgaacaggtggttttcaccaacccttcttgggatgccgaggtgattcggccactgccaatggattcttcggcctatagctttacagcgtttgtgggggtccctgccgtggagttttcgtttatggaggatgaccaggcataccccttcttgcataccaaggaggacacttacgagaatttgcacaaagtgcttcaggggcggttaccagccgtggcgcaggccgtcgcccagctggcaggtcaactgctgattcgactgtcgcacgataggttactgccactagattttgggagatatggcgacgtcgtcctccgacacattggtaacttaaacgagttctcgggggaccttaaggcaaggggtctgacactgcagtgggtgtactctgccaggggggactatatccgcgcagctgagaagctgaggcaggaaatttatagttccgaggagagggatgagaggctgacacggatgtataacgtgagaatcatgcgagtggagttttactttctgtctcagtatgtctctcctgctgactcgccctttaggcacatttttatgggccggggtgatcacaccttgggagccctcctcgatcacctgaggctgcttagaagcaatagctctggcactcccggtgctacatcatcgacaggctttcaagaaagccggtttaggagacaactggcattactcacctggacccttcagggagcggccaatgccttaagtggcgacgtgtggaacatagacaacaatttctag

SEQ ID NO: 4086 - DNA, 1029 bp, Artificial Sequence
  Description of Artificial Sequence: Synthetic coding sequence
atggtgagcaacggcttccggccccggcggagcctgctgttcatctcctgggacggaggtgacttcggatccgttggcagcacagagtggttagaagggtatctgagcgtgttgcatctgaaggctgtggtatatgtaagtctggacaatgccgtcctcggagacgataagttccatgccaaaaccagccccctacttacttccctcatcgagtctgtcctgaagcaggtagattccccaaaccatagcggtcaaacactatatgaacaagttgtgtttacaaatccctcttgggatgcggaagtgattcgccccctgccaatggacagtagtgcttacagctttaccgcctttgttggagttcctgctgttgaatttagttttatggaggatgatcaggcgtaccctttcctgcacaccaaggaggacacctacgaaaacctgcacaaggttcttcagggacggctccccgctgtggcacaagccgttgcccagctagcaggacagctgctgatccggctttctcatgaccggctgcttcccctcgatttcggaaggtatggcgacgttgtgctccggcacattggaaacctcaatgaattctccggggatctgaaagcccgcggtctgaccctacagtgggtttatagcgctcgcggcgactatatccgggccgccgagaaattacggcaggagatctatagctcagaggaaagagacgaacgcctcacaaggatgtacaatgtccgcataatgcgggtagagttctatttcttgtctcagtatgtgagccccgctgactcccccttccggcatatcttcatgggtcggggcgaccatactttaggcgctctacttgatcacctgagattgttgaggtctaattcgtctggaactcccggagccacttccagcacaggcttccaggagtctcgatttcggcggcagctcgctctgctgacttggactctccagggcgcagccaatgctctgtctggagacgtctggaatattgataacaatttctag

SEQ ID NO: 4087 - DNA, 1596 bp, Artificial Sequence
  Description of Artificial Sequence: Synthetic coding sequence
atggccgccaccctggacctgaagagcaaggaggagaaggacgccgaactcgataagcgcatcgaagcactccggcgcaagaacgaggctctgattagaaggtatcaggagatcgaggaggacaggaagaaagccgaactagagggggtggctgttactgcgcccaggaagggccgaagcgtggagaaggagaatgtggccgtggagtcagagaagaaccttgggccgtcccgcaggagtccaggtacgcctcgaccccctggcgcttccaaaggcgggagaacgccaccccagcagggaggacgcgccgggatgggccgcgcgtcacggagttgggagggatcaccaggcgagcaacccagaggtggcggagccggtgggagggggcggagggggcgcggccggggctcgccacatctctctggagctggagacacctctatatctgatcggaaaagcaaagagtgggaggagaggcgccgccaaaacattgagaaaatgaatgaggagatggaaaagattgccgaatatgagcgaaatcagcgggaaggcgtcctcgagcctaacccagtgcgcaatttcttagatgatccccgacgcaggtccggaccgctcgaggagtcagaacgcgataggcgtgaagagagccgccgccatggccgcaactgggggggacctgattttgaaagagtcaggtgcggccttgaacacgaacggcagggcagacgcgcaggtctcggatctgccggagacatgacactcagtatgacaggccgagaacgcagcgagtatttacgttggaaacaggaacgggagaagatagaccaggaacgcttgcagagacatagaaaacctactggccagtggcgaagggaatgggacgctgagaagaccgacggaatgtttaaggatggaccagtgccagctcacgagccatctcacaggtatgacgatcaggcctgggctcggcccccgaaacctcctacttttggagagttcttgagccagcacaaggctgaggccagctctaggaggcggcgaaaatcaagtcgtccgcaggccaaagctgcacctcgcgcatacagcgatcacgatgatagatgggagactaaggagggggctgccagccccgctccagagacgcctcaaccaacaagtccagagacgagccccaaagagacaccaatgcaaccgccggagattcctgccccagctcatcgtcctccagaagacgaaggcgaggagaacgaaggggaggaggatgaagagtgggaggacatctcggaagacgaagaggaagaagagatcgaggttgaggagggggatgaggaagaaccagctcaggatcatcaagcaccagaggccgccccaacgggtattccctgtagtgagcaggcccacggtgttccatttagccccgaagaacccttgttagagccacaagcacctggcaccccttcatcaccgttctccccgccgagcggccatcagccggtcagcgactggggcgaggaagtggagctgaactctccacgcacaacccacttagccggggccctctcccccggagaggcctggccattcgaaagcgtctag

SEQ ID NO: 4088 - DNA, 1329 bp, Artificial Sequence
  Description of Artificial Sequence: Synthetic coding sequence
atgcactactgcgtgctgagcgccttcctgatcctgcacctggtgaccgtggccttaagtctgtccacatgttcaacactggatatggaccagtttatgagaaaacggatcgaggccatccgaggtcaaatcctgagcaagctaaagcttaccagtcctccagaggactacccggaacctgaagaagtgccccctgaggtaatctcaatatacaattcgacacgcgacctgctccaggagaaggcaagcagacgagccgcagcatgcgaacgggagcgctccgatgaggagtattacgctaaagaggtgtataaaattgacatgcccccattcttcccttcagaaacggtatgtccagtggtgaccaccccatctggctccgtagggtctctgtgttcccgtcaatcacaggtgctctgtgggtatcttgacgcaatccccccaactttttataggccttattttcggattgtgcgtttcgacgtcagcgctatggagaaaaacgcttccaatctggtgaaggccgagttcagagtcttccgcctccaaaacccaaaggctcgggtgcccgaacagcggattgaactctaccagatcttgaaaagtaaagacctcacatctcccacgcaacgttatattgattcaaaagtcgttaagactcgggcggagggcgagtggctgtcattcgacgtgacggacgccgtgcacgagtggctgcaccacaaggatagaaatttgggtttcaagatctcccttcattgtccatgctgcacgttcgtgccctctaacaattacatcattccaaataagtccgaagagcttgaggcccgatttgccggaattgacggtacctctacctacacttctggggatcaaaagacaatcaaaagcacaaggaaaaagaactccggcaagactcctcacctgttactcatgctattaccaagctaccgattggaatcccaacagacaaaccgtaggaagaagagggcgcttgatgccgcatattgcttcaggaacgtgcaggataattgctgcttaagaccattatacattgacttcaaacgagatctcggctggaagtggatccacgagcctaaggggtacaacgcgaatttttgtgccggggcatgcccctacctctggtcctcggacacacaacatagcagggtgctgagcctctacaatacaattaatcccgaggcaagcgcatctccctgttgtgtgtcacaagacttagagccgctgacaatcctttactatatcggaaagacccctaaaatcgagcagctgtctaacatgatcgttaaatcttgcaagtgttcttag

SEQ ID NO: 4089 - DNA, 1245 bp, Artificial Sequence
  Description of Artificial Sequence: Synthetic coding sequence
atgcactactgcgtgctgagcgccttcctgatcctgcacctggtgacagtggccctgtccctgtcaacatgctctaccctggacatggatcaatttatgcggaaacgcattgaagcaattcgtggccagatactgagtaaactgaagctgacaagcccgcccgaagactacccagagcctgaggaggtcccaccagaagtgatctccatttacaattccactcgtgacttgctccaagagaaagcctcaagacgggccgctgcatgtgagcgggaaagaagcgatgaggaatattacgcaaaggaggtctacaaaatcgatatgccccccttctttccaagcgagaatgccatccctcccaccttttaccggccctactttagaattgtgcggtttgatgtgtctgctatggaaaagaacgccagtaatctcgttaaagccgagttcagagtttttcggcttcagaatcccaaagcacgtgtgcccgagcagcgcatcgaactctaccagatactcaaatctaaggacttgacctctcccacccagaggtatatcgactcaaaggttgtgaaaaccagggcagagggtgagtggctctctttcgacgtaaccgacgccgttcacgaatggcttcatcacaaagacagaaatttaggctttaagatttcccttcactgcccctgctgcactttcgtgccgtccaacaattacattattcccaataagagcgaagagctggaagcccgatttgccggtatcgatggaacttcaacctacacatctggggatcagaaaacaataaaatctactcggaagaagaatagcggcaagacccctcatctcctcttgatgcttctgcctagctacagactggaatcccaacagacaaaccgtcggaagaagcgggccctcgacgccgcctactgcttcaggaatgttcaggacaattgctgccttcggcctctgtatatagacttcaagagagatctgggctggaaatggatacacgagccaaaaggatacaacgcgaacttctgtgctggcgcctgtccttacctgtggtcaagcgatactcagcattccagggtgctctccttgtacaatactattaatcctgaggcctctgcaagcccatgttgtgtaagtcaggatctggaaccccttactatcctctattacatcggcaagaccccaaagattgagcagctgagcaatatgatcgttaagagctgtaaatgttcttag

SEQ ID NO: 4090 - DNA, 1239 bp, Artificial Sequence
  Description of Artificial Sequence: Synthetic coding sequence
atgaagatgcacctgcagcgggccctggtggtgctggccctgctgaacttcgcaaccgtgtccttaagcctttcaacctgtacaaccctcgattttgggcatataaaaaagaaacgtgtcgaagccattcgcgggcagatccttagcaagctgaggctcactagcccacccgaacccaccgtcatgacacacgtgccctaccaggtgctagctctgtacaatagcactcgcgaactccttgaggaaatgcatggggagcgggaggaaggctgcacacaggagaacactgaatccgagtattacgctaaagaaatccacaaattcgatatgatccaggggctggccgagcataacgagctggccgtttgccctaagggcattacatccaaggtcttccgctttaatgtatcgtccgttgaaaagaacagaactaacctgttccgcgccgaattcagggtactgagagtgccgaatccttcttccaagcgaaatgagcagagaatcgaactgttccagatcctgcgacctgacgaacacatagctaaacagcgctatataggcgggaaaaatctgccgacccgtggcacggccgagtggctctcctttgatgttaccgacaccgtgcgtgaatggttgttgagaagggagtccaacttagggctggaaatttctattcactgcccgtgccacactttccagccaaacggggatattctggagaatatacacgaggtgatggaaatcaagttcaagggcgttgataatgaggacgatcacggtagaggcgaccttggtcggctcaaaaagcagaaggaccaccacaatccccacttgattttaatgatgattccaccacaccggctagacaacccaggccagggcgggcagcgcaaaaagcgggctttggacaccaattattgttttcgcaatctggaggagaattgttgtgtgcgaccattatatatagacttcaggcaggacctgggctggaagtgggtgcatgaacctaaaggatactacgcaaacttctgttctggaccctgtccatacctgcgttctgcggacaccacccattcaactgtcctggggttgtataacacactgaatcctgaggcctccgcgtcaccatgctgcgtcccccaggacttggaacctctcaccatactgtactacgtaggacgcactccaaaagtagagcagctatccaatatggtggtgaagagctgcaaatgctcttag

SEQ ID NO: 4091 - DNA, 930 bp, Artificial Sequence
  Description of Artificial Sequence: Synthetic coding sequence
atgaagatgcacctgcagcgggccctggtggtgctggccctgctgaacttcgctacagtttccctctcgctctccacatgtacaacattagattttgggcatattaagaagaaaagagtggaagcaatcaggggacagattttatccaagctgaggttaactagcccgccagagcccactgtaatgactcacgtgccttatcaagtgttagccctgtataattctacccgtgagctgctagaagaaatgcacggtgaacgggaggaaggttgcactcaggagaacaccgaatccgagtattatgcgaaagagatacacaaattcgacatgattcagggactggcagagcacaatgagctggctgtgtgtcctaaaggaataacttcgaaggtctttaggtttaatgtaagttctgtcgagaagaacaggacaaatttgttcagggcggagtttcgcgtcctgcgggttcccaacccatcttccaaaaggaacgagcagcgcattgaactgttccagattctgcgcccagatgagcacatcgctaagcaacgctacatcggcggcaaaaatctccccacacgaggcacagcagaatggcttagcttcgacgtcactgataccgtcagagaatggctccttcggagggagagtaacttagggctggaaatttctatccactgtccatgtcacacttttcaaccaaatggagatatcctcgagaacatccacgaagtgatggaaattaagtttaagggggtagacaatgaagatgatcacgggagaggcgacctcggacgcctaaagaagcaaaaggaccaccacaacccacacctgatcctcatgatgattcccccccacagactggacaatcccgggcaaggcgggcagcgtaaaaaaagagccttagacacaaactattgttttcggtag

SEQ ID NO: 4092 - DNA, 444 bp, Artificial Sequence
  Description of Artificial Sequence: Synthetic coding sequence
atggccagccaccggctgctgctgctgtgcctggccggcctggtgttcgtgtccgaggctggccctacaggaaccggtgaatctaagtgtccactgatggtcaaggtcctggacgctgtaaggggaagtccagcaataaacgtcgccgtccacgtatttcgcaaagccgccgacgacacttgggagcccttcgcgagtggtaaaacttctgaatctggcgaactacacgggctgactactgaagaggaatttgtggaaggcatctacaaagtggagatcgatacgaaaagctactggaaagccctagggatttcaccgttccatgagcatgctgaggtggttttcaccgctaacgattccgggcctcgacgttacactatcgccgctttgctctccccatactcttatagcactacagccgtggtgacaaaccccaaggagtag

SEQ ID NO: 4093 - DNA, 555 bp, Artificial Sequence
  Description of Artificial Sequence: Synthetic coding sequence
atggccagccaccggctgctgctgctgtgcctggccggcctggtgttcgtgtcagaggccggcccaacggggacaggggaatcaaagtgtccactgatggtcaaggttttggacgccgtgagagggagcccggccatcaatgtcgctgtccatgtattccgtaaagcagccgatgacacttgggagccgtttgccagtggaaaaacatccgagagtggggaactgcacgggctgaccaccgaggaggagttcgtagagggtatctataaggtggagatcgataccaaatcatactggaaagccctagggatctccccttttcacgaacacgccgaggtgagcatccagacattcgaagcattccaggaaattctgtacaaaaagaagtttactactctgtggcattggaccagtggcggacaatccttctttagagcactcgtggaggtcgtgttcacagccaacgactctggccctagaaggtatactatcgctgcactgctcagcccttactcatacagcaccacagccgtcgttaccaaccctaaggagtag

SEQ ID NO: 4094 - DNA, 420 bp, Artificial Sequence
  Description of Artificial Sequence: Synthetic coding sequence
atggccagccaccggctgctgctgctgtgcctggccggcctggtgttcgtctcagaggcgggcccaacaggcaccggagagtccaaatgcccacttatggtgaaagtcctggatgccgtgagagggagccctgcaattaatgtggctgtgcacgtgttcaggaaagctgccgacgatacttgggaacccttcgcatctggtaagacctccgagtcgggggaattgcatgggctgactactgaggaagaatttgtggagggcatctataaagtggaaatcgacactaaaagctactggaaggcactcggcatttcgccattccatgagcacgctgaagtcgtgtttacagctaatgactccggccctcgccgctattactcctacagcaccaccgcagtagtgacgaaccccaaggaatag

SEQ ID NO: 4095 - DNA, 996 bp, Artificial Sequence
  Description of Artificial Sequence: Synthetic coding sequence
atgaacggcacccggaactggtgcaccctggtggacgtgcaccccgaagatcaggctgcagtatacctgaaggggagaagcggcgataaaatgatacacgagaagaacatcaaccagctgaagagcgaggtacagtatattcaggaggcccgcaattgtcttcagaagctgcgcgaggacatctcgtccaaattagatagaaatctgggagactctctccaccgacaggaaattcaggtggtcctggaaaagcctaatggcttctcccagagcccaaccgcactgtattcatctcctcccgaggtcgacacttgcatcaatgaggatgtggagagcctgcgaaagaccgtccaagacctcttagcaaaacttcaggaggcaaaacgacagcaccagagtgactgcgtcgctttcgaggtaacactctcccgctatcagagggaagctgaacagtccaatgttgcccttcagagagaagaagacagggtggaacagaaggaagccgaggtgggcgaactacaacgaagacttctcggtatggagactgagcaccaggctctactcgccaaagtgagggaaggagaagtggcgctggaggaactccgcagtaacaatgccgactgtcaagctgaaagagaaaaggctgctaccttagaaaaagaggtggcagggttgcgggagaagatacatcacttagatgatatgttgaaaagccaacaaagaaaggtgcgccagatgatcgagcagctccagaattccaaagcggtgattcagtcaaaagatgctactatccaggagctgaaagagaaaatcgcttatcttgaggccgagaacctggaaatgcacgaccgcatggagcacctgatcgaaaagcagatctcccacgggaacttcagcacacaggcccgggccaagacagagaaccccggtagcatccggatcagtaaaccaccatcaccaaagcctatgcctgtaattcgggtagtggaaacttag

SEQ ID NO: 4096 - DNA, 1098 bp, Artificial Sequence
  Description of Artificial Sequence: Synthetic coding sequence
atgaacggcacccggaactggtgcaccctggtggacgtgcaccccgaggatcaggccgctgcaggtaggaagacatatgccatggtgtctagccatagtgcgggacactctctggcaagcgaattagtggaatctcacgatggccatgaggagattattaaggtgtacctcaaaggcaggtcaggcgataaaatgatccatgagaagaacatcaatcagcttaaaagcgaagttcagtatatccaggaagctagaaactgtctgcaaaagttgagagaagacattagtagcaagctggatcggaatctcggcgattcactgcatagacaggaaattcaggttgtgctagagaaacctaacggcttcagtcagtctccaaccgcgctctactctagtcctccggaggtggatacctgtattaacgaggacgtggagtctttgcgcaagaccgtgcaggacctcctcgccaagctgcaggaggccaagcggcagcaccagtccgactgcgtggcctttgaagtcacactgagccggtatcagcgggaagcagaacagagcaatgtggctctgcagagggaggaagatagagtggaacagaaagaagccgaggtgggtgaattgcaaaggcggttgctagggatggaaaccgagcatcaggcactgcttgccaaagtgcgggagggtgaggtcgccctggaggagctgcgaagtaataatgctgattgtcaggctgaaagggagaaagcagctaccctggaaaaggaagttgccggcctgcgtgaaaagattcatcatctagatgacatgctcaaaagtcagcagagaaaagtgcggcagatgattgagcagctacaaaactccaaagctgtgattcagagtaaagacgccaccattcaagaactgaaagagaagattgcttatctggaagcggaaaatttagagatgcatgacaggatggaacacctgatcgagaagcagatatcacacggaaacttctctacccaggctcgcgccaagacagagaatccaggatctatccgcatctcaaaacctccatcgcccaaaccaatgcccgttattcgggttgtggagacctag

SEQ ID NO: 4097 - DNA, 1173 bp, Artificial Sequence
  Description of Artificial Sequence: Synthetic coding sequence
atgaacggcacccggaactggtgcaccctggtggacgtgcaccccgaagaccaggcagcagggagcgtcgatatcctgcgtttgaccctgcagggcgaactgaccggcgacgagctcgaacacatcgcccaaaaggctggaaggaagacgtacgctatggtgagctctcatagcgcaggccactcccttgcatcagaactggtcgagagccacgacggccatgaagagattatcaaagtttacctgaaggggaggtcaggggacaagatgatccacgaaaaaaacattaaccagctgaagtcagaagtgcagtatattcaggaggctaggaactgcctgcagaaactgcgtgaagatatcagctcaaagctggatcgcaacctgggggacagcctgcatcgacaggagattcaggtggtgttggagaagcctaacggcttctcccaatccccaacggccctttattcaagcccacccgaggtggatacatgcatcaacgaggatgtcgagagccttagaaagacggtccaggacctgttggcgaaactccaggaagcaaagcgtcagcaccagagtgattgcgtggctttcgaggttacactctcacggtatcagcgcgaagccgagcagtcaaacgttgccctacagagagaagaagatcgcgtcgaacagaaagaggccgaagtcggcgaactgcagcggcgtttgctaggcatggaaaccgagcaccaagccttactagccaaggtgagggaaggagaggtagcactagaagagttgaggtcgaacaatgccgactgtcaggctgagagagaaaaagccgccaccctagaaaaggaggtcgctggcctgcgcgagaagatccatcacctggacgatatgctgaagtctcagcagcgcaaggttcgccaaatgatcgagcagttacaaaactctaaagccgttatccaatcaaaagacgctactatccaggagctaaaggaaaagatcgcttatttggaagctgaaaacctggagatgcacgatcggatggaacatctgattgagaagcagatctcacatggtaattttagcacacaggcgagggccaaaaccgagaaccctggaagtataagaatatcaaagcctccatctcccaaacctatgcccgtgatccgagtggtagagacgtag

SEQ ID NO: 4098 - DNA, 600 bp, Artificial Sequence
  Description of Artificial Sequence: Synthetic coding sequence
atgaacggcacccggaactggtgcaccctggtggacgtgcaccccgaggatcaggcagctgcaggccggaaaacatacgccatggtgtctagccactctgccggccattccctggcaagtgagctcgtcgagtctcacgacgggcacgaggaaatcatcaaagtgtacttgaaaggaaggagcggggacaaaatgattcatgagaagaacattaatcagctgaaatctgaagtgcagtatattcaggaagctcgcaactgtctgcaaaagctgagagaggatatcagcagcaaacttgacagaaatctgggcgattctctgcaccgtcaagaaattcaagtagtattggagaaacctaacggcttctcgcaatccccaaccgccctgtactcgagcccccccgaggtggatacctgcatcaacgaagacgttgagtcccttcgtaaaacagtgcaagatttgttggcaaaactccaggaggccaagagacaacatcagtcagactgtgtggcctttgaagtgaccctgtctagatatcagcgcgaggcggagcagtccaacgttgcgcttcagcgcgaggaggaccggtgccccgaatag

SEQ ID NO: 4099 - DNA, 1230 bp, Artificial Sequence
  Description of Artificial Sequence: Synthetic coding sequence
atgagcagccccggcatgaccagcctgcagctggagaaggaggagtgcatgcaatgtgtgccttgttcacctcggacaagagtcgctctgctggaattgtacagagccatgtgccagggcagcgtggatatcctaaggctgaccctccaaggcgagttgaccggggacgagcttgagcacatcgctcagaaagctggccggaagacttacgccatggtcagctctcatagcgcaggccacagcctcgccagcgaacttgtggagtcccacgacggacatgaggagataattaaggtctacctcaaaggccggagcggcgacaagatgattcatgagaagaacattaaccagctgaagagcgaagttcagtacatccaagaggcgcgcaattgtttgcagaaactgcgcgaagatatctcaagcaaattagacagaaacctgggtgactccctccataggcaggaaattcaggtcgtgctcgaaaagccaaacgggttttctcagtctcccaccgcgctgtactcctcacccccagaggtagatacctgcataaacgaggatgtggagtcactgcgcaagactgtgcaggacctcttggcaaaattacaggaagccaagcgccagcatcaaagtgattgcgttgctttcgaggtgactctttccaggtaccaacgggaggcagaacagtctaatgtcgcacttcagagagaggaggacagggtcgagcagaaagaagcagaagtgggcgaattacaacgccgactcttagggatggaaaccgagcaccaggctctcctggccaaagtcagggagggtgaggtggcattggaagagctgaggtcaaacaacgctgactgccaggccgaacgggagaaagccgccacacttgagaaggaggtggctggtcttcgggaaaaaatacaccaccttgatgatatgcttaagtcacagcagagaaaagtgcggcagatgatcgaacagctgcagaatagtaaagcggtcatccagtctaaagatgctactatccaggagcttaaagagaagattgcgtacctggaagctgagaatttggaaatgcatgacaggatggagcacttgatcgaaaagcagatcagtcacgggaactttagtacccaggccagggcaaagacggaaaatcccggctccattaggatttcaaaacccccatctcccaagcccatgccagtcattcgcgtggttgagacttag

SEQ ID NO: 4100 - DNA, 543 bp, Artificial Sequence
  Description of Artificial Sequence: Synthetic coding sequence
atgaacggcacccggaactggtgcaccctggtggacgtgcaccccgaagaccaggcagcagctgggcgtaagacctacgcgatggtatcttcacacagcgctggccactccctcgcaagtgaactggtggaatctcacgacggtcacgaagagattatcaaagtttacctgaaaggacgttctggggataaaatgattcatgagaagaacataaaccagctgaagtcagaagtgcagtacatccaggaagccaggaattgcctccaaaagctgcgcgaggacatttcaagcaaattggacagaaacctgggtgattccctgcataggcaggagattcaggtcgtactggaaaagcctaatggcttcagccagagcccaaccgccctgaaagccggcgataccgatgtgcagtccgactggagaatgtcatggggaaatgaggtgccttccaccaacaccgcccaattcctagcgaccaactgcctatttttctacctgttgcatctacagcccacactgccatggcctcccgccgaccggtag

SEQ ID NO: 4101 - DNA, 1182 bp, Artificial Sequence
  Description of Artificial Sequence: Synthetic coding sequence
atggaggagccccagagcgaccccagcgtggagccccccctgagccaggaaacattttcagacttgtggaagttactgcccgaaaataacgtcctctcaccactgccttctcaggctatggacgatttgatgctcagcccggatgatatagagcagtggtttacagaggatccaggtcctgatgaggcaccaaggatgcccgaggcagctcccccagtggcacctgcccccgctgcgcccacacctgccgctcccgcacctgctccaagttggcctttgtcaagctccgtacctagccagaaaacttatcagggctcgtacggatttcggctcgggtttttgcacagtgggacagccaaaagcgtgacctgtacatattcaccagccctcaataaaatgttctgccagctggcaaaaacttgtccagttcagctctgggtagattcaacccctccgccagggaccagagtgagagcgatggctatttacaaacaatctcagcatatgacagaggtggtgcgtaggtgtcctcatcatgaacgctgtagtgactctgatgggttggcccctccacaacatctgatccgtgtcgagggcaacctgagagtggaatatctcgacgacagaaacacctttcgtcacagcgtcgttgttccatacgaacctcccgaagtgggtagcgactgcaccacgatccactataattatatgtgcaactctagctgtatgggggggatgaacagacggcctattctcacaattattacattagaagactcaagtggtaatctgctcggaagaaattcctttgaggtgcgggtctgtgcctgccccgggagggaccggcgaaccgaggaagagaatctaagaaagaagggggaaccccaccatgaacttccacccggatcgaccaaaagagccctgcccaacaacacatccagctcccctcaacctaagaagaagcctctggatggtgaatatttcacgcttcaaattaggggacgcgaaaggttcgaaatgttccgggagctgaatgaggcgctggagttgaaggatgcccaggctgggaaagagcccggtggtagcagggctcacagcagccacctgaaaagtaagaagggacagtccaccagtcgacataagaaattgatgtttaagaccgaggggcctgactcggactag

SEQ ID NO: 4102 - DNA, 1032 bp, Artificial Sequence
  Description of Artificial Sequence: Synthetic coding sequence
atggaggagccccagagcgaccccagcgtggagccccccctgagccaggagacatttagcgacctgtggaagttgctccctgaaaacaatgttctgagccccttacctagccaagctatggacgatctgatgctttcacccgacgacatagaacagtggttcacagaagaccctgggcctgatgaagctccacgcatgccggaagccgctcctccagttgccccagccccagcagcacccacccctgccgccccagcccctgcgccctcatggcctctgtcctcctcggtgccttcccaaaaaacctaccaagggagctacggttttcggctggggttcctccattccggcacagctaaaagtgtcacgtgtacttattcgcccgccttaaacaagatgttctgtcagctcgctaaaacatgccctgtacaactatgggtggattctaccccgccccctggaacgagggttcgtgcgatggctatctataaacagtcccaacatatgacggaagttgtgcggaggtgcccgcatcatgaacgctgctctgattctgacgggttggccccaccacagcatctgatccgcgtcgagggaaacctgcgagtcgagtaccttgatgaccgcaacacttttcgccacagtgtagtagtgccatatgagcctcctgaggtgggttcggactgcactactatccactacaattatatgtgtaatagctcatgtatggggggcatgaatcggagaccaatcctaacaatcatcaccctggaggattcatcaggtaatcttctcggcaggaattctttcgaggtccgcgtctgcgcttgcccaggtcgagatcgccgaactgaggaagagaacttacgcaagaagggcgaaccacaccacgagttaccacccgggtcaaccaagcgcgcactgcccaacaacacaagcagctccccacagcctaaaaagaaacctttagatggcgaatacttcacgctccagaagacttttcccgcaagacacggcggtagccacctgtag

SEQ ID NO: 4103 - DNA, 1149 bp, Artificial Sequence
  Description of Artificial Sequence: Synthetic coding sequence
atggaggagccccagagcgaccccagcgtggagccccccctgagccaggaaacctttagtgacctgtggaagctgctccccgaaaacaatgttttgagccccttaccgtcccaggccatggatgaccttatgttaagccccgacgatatagagcagtggtttactgaagaccccggaccagacgaggctcctcgaatgccggaggctgcccccccagtggccccagcaccagcggctcccactcctgctgccccggcacctgcaccaagctggcccctcagctcatccgttccttcccaaaagacatatcagggatcctatggtttcagactgacatgtacatacagtcctgccctaaacaagatgttttgtcagctggccaagacctgccccgtgcagctgtgggttgatagcacccccccacctggaacccgggttcgtgcaatggcaatctataagcaaagccagcatatgaccgaggtggtcagacggtgcccacatcacgaacgttgctcagactccgacgggcttgcacctccacagcaccttatcagagtggagggcaatctcagagtcgagtatctggacgacaggaacacatttagacactcagttgtggtgccgtacgagccccctgaggtgggttcagactgcacaacaatccactacaactatatgtgtaacagcagttgcatgggaggcatgaaccgcagaccaatactgactatcatcacactggaagacagtagcgggaacttgctggggcggaattcatttgaagttagagtctgcgcttgccccggtagggaccggcggacagaagaagagaacctacgaaaaaaaggtgaaccacaccacgaactgcccccgggctcaacaaaacgggcattgcctaataacaccagcagttctccccagcctaagaagaaaccattggatggagagtactttacactccaaatccggggtcgagagaggttcgagatgttccgggagctgaacgaagcccttgagttaaaggacgcccaggcgggcaaagagcctggcgggagtagggcgcactcatcacacttgaagtcaaagaagggccagtctacaagccgacacaagaagttgatgttcaaaacggaaggacctgactccgactag

SEQ ID NO: 4104 - DNA, 858 bp, Artificial Sequence
  Description of Artificial Sequence: Synthetic coding sequence
atggaggagccccagagcgaccccagcgtggagccccccctgagccaagaaacctttagcgatctgtggaagctcttgcccgagaataatgtcctgagcccactcccctcacaggccatggacgacctaatgttatctccagacgacatcgagcagtggtttacagaggacccagggccggatgaggccccaaggatgccggaagctgccccaccggtggctcccgcacctgccgcgcccacacccgctgcccccgcaccagccccctcgtggccactgtcatcctcggtgccgtcgcaaaagacttatcagggttcttacggcttccggctgggcttcttgcatagcgggacagccaagagcgtaacatgcacctatagccctgcccttaacaagatgttttgtcagctggcaaaaacctgcccagtgcaactatgggtggacagcacccccccccccggtacaagagtgagggccatggctatatataagcagtctcagcatatgacagaagtggtcagacgatgtccccatcatgaacggtgctcagactcagacggcctcgcccctcctcagcacttgatccgcgtggagggaaacctgagggtagagtacctggatgacaggaatacgttcaggcactctgtggtcgtcccctatgaaccacctgaagtcggcagcgactgcaccacaattcactataactatatgtgcaactcttcctgtatgggcggaatgaataggaggcctattctgaccatcatcaccttggaggacagccggcccaggcaggtcgaccatttacgctctggagtacaggacagcctggctaatattgccaagtcccacctgtactag

SEQ ID NO: 4105 - DNA, 273 bp, Artificial Sequence
  Description of Artificial Sequence: Synthetic coding sequence
atgttctgccagctggccaagacctgccccgtgcagctgtgggtggattccacacccccacctgggaccagggtgagggctatggctatctacaaacagtctcaacatatgacagaagtggtccggaggtgcccgcatcacgaacgctgctccgattccgatggcctggcccctccacaacaccttatacgggtagaagggaatttgagggttgaatatttggatgaccgaaacacattcaggcactcagtggtgagtgggcgtagaggctag

SEQ ID NO: 4106 - DNA, 135 bp, Artificial Sequence
  Description of Artificial Sequence: Synthetic coding sequence
cccctgcccagccagcggcggaaccactggatggagaacatcagcccattttctcacctaaagagcaagaaaggccagagcacttctaggcataagaaactcatgttcaaaacggaagggccggattccgactag

SEQ ID NO: 4107 - DNA, 1026 bp, Artificial Sequence
  Description of Artificial Sequence: Synthetic coding sequence
atggaggagccccagagcgaccccagcgtggagccccccctgagccaggaaaccttctccgacctgtggaaacttctgccagagaacaacgttttgagccccttgccgagtcaggccatggacgacttgatgctgagtccggatgacatcgagcagtggttcaccgaggaccccggcccagatgaagcgccacgcatgcccgaggccgcgcccccggtcgcccccgctcccgccgcccctacacccgctgccccagctcctgcccccagttggcctctgtcttccagcgtaccatcccagaaaacttaccaggggtcatatggatttagattaggctttctgcatagcggcaccgccaaatccgttacctgtacatacagcccagctctcaataagatgttctgtcagctggcgaagacttgccctgtgcagttgtgggtggattccaccccacctcccgggacgcgggtcagagccatggccatctataaacagtcccagcatatgacagaggttgtgagaaggtgccctcaccatgaaaggtgttccgatagtgacggacttgccccccctcagcacctcatccgcgtcgaggggaaccttcgggtcgagtacttagatgatcggaatacctttagacactctgtagtggtcccgtatgagccaccagaggtggggtctgactgcaccaccatccactataattatatgtgtaacagctcatgcatgggaggcatgaatagacggcccattctgacaatcatcaccttggaagactcttccgggaatctcctgggaaggaattcttttgaagtgagagtctgtgcctgtcctggcagagatcgacgtaccgaagaagaaaacctaagaaaaaagggcgaaccccaccacgaattgccaccaggctcgaccaagcgtgctctgcctaacaataccagcagttccccccagcccaagaagaagccgctcgacggggaatacttcactctccaggatcaaactagctttcagaaagagaactgttag

SEQ ID NO: 4108 - DNA, 1182 bp, Artificial Sequence
  Description of Artificial Sequence: Synthetic coding sequence
atggaggagccccagagcgaccccagcgtggagccccccctgagccaggagacatttagtgatctgtggaaactgttaccggagaacaatgtgttatcgcccctgccgtcccaggctatggacgacctcatgttgtcccctgacgatattgaacagtggttcaccgaggatcctggtccagacgaagctccccgcatgccagaagcggccccacctgtggctcccgcacccgcggccccgacaccagccgctccggcacccgcgcctagttggcctctatcatcatccgtcccaagccagaaaacctaccaaggcagctatgggttccgtctgggcttcctgcattctggaaccgccaagtccgttacctgtacgtactctccagcgttgaataaaatgttttgtcaactggctaagacatgtcctgttcagttatgggttgattcaacgccgccccccggtacacgggtccgcgctatggctatatacaagcagagtcagcatatgactgaagttgtcaggcgctgtccacaccacgagagatgttccgatagcgacgggctggcccccccccaacacctgatccgagtagaaggaaatctgcgggttgaatacctggatgatcgaaatacttttcggcattctgttgtggtgccctacgagcccccagaagtgggcagtgattgcaccaccatccattataactatatgtgtaattcatcctgtatgggggggatgaacagaagaccaattctaaccatcattacgttggaggacagtagtggaaacctattaggccgcaactcattcgaagttagggtatgcgcttgtcctgggagagatcgtcgcacagaagaggagaacctgaggaagaaaggggagccacatcacgaattgcctcctgggagcaccaagagagccttacctaataacacttcaagcagtccccaacccaaaaagaaaccccttgatggcgagtacttcactctacagattcgagggagagaaagatttgaaatgtttcgggagctaaacgaggccctggagctgaaggacgcccaggctggtaaggagccgggggggagtcgggcacactcctcacacctgaaatccaaaaaaggacagtctacttctcgacacaaaaaattaatgttcaaaacagaagggccggactctgattag

SEQ ID NO: 4109 - DNA, 1041 bp, Artificial Sequence
  Description of Artificial Sequence: Synthetic coding sequence
atggaggagccccagagcgaccccagcgtggagccccccctgagccaggagacattttccgacctgtggaaattgctccctgaaaacaacgtcctgtctcccctcccatctcaagccatggacgacctcatgttgagtccagatgacatcgagcagtggttcaccgaggatcccggaccggatgaagccccaagaatgcccgaagccgcgccacccgtcgccccggcaccagctgcccctacacctgccgcgcccgcccccgccccctcatggccattatctagctccgtcccctctcagaagacgtatcaaggctcctacggtttcaggctgggcttccttcattcgggcacggctaaatctgtgacatgtacctactcacctgctctgaataagatgttctgtcagctggctaaaacctgtcccgtccagctgtgggtagacagtacccctcctccggggacgcgggtgagggctatggccatatataagcaatcacagcacatgaccgaagtcgtaaggagatgcccacaccatgaaagatgctctgattccgacggactagcacctccgcagcatttgatccgggtcgagggtaatctccgtgtggagtacctggacgacaggaacacatttagacacagcgttgtggtgccgtatgagccccctgaggtgggctcagactgtactactattcattataactatatgtgtaatagtagctgcatgggcggtatgaacagacgaccaattctgactattatcacattggaagacagcagcggaaacctgctgggacgtaattcgtttgaggtgcgagtctgtgcttgtcccggacgggaccgaagaacggaagaagaaaatctgagaaagaaaggggagcctcaccacgagctgcctcccggctctacaaagagagcgctgcccaacaacacctcttctagtccgcaaccaaaaaagaagcctctggatggggagtatttcactctccagatgctattagacctccggtggtgttactttctcataaattcttcatag

SEQ ID NO: 4110 - DNA, 387 bp, Artificial Sequence
  Description of Artificial Sequence: Synthetic coding sequence
atggaggagccccagagcgaccccagcgtggagccccccctgagccaggaaaccttctccgacctctggaagctcctgcctgagaataacgtgctatctcccttgcccagccaagctatggacgacctgatgctgtctcccgatgatattgaacagtggtttacagaagaccctgggcccgacgaggcaccacgaatgcccgaggccgcaccaccagtggcccctgcccctgcagcaccaacacctgccgcacctgcacccgcacctagctggcccttaagttcgagtgtgccctcccaaaaaacctatcaaggaagctatggcttccggctaggctttcttcattcaggaaccgcaaaatccgttacttgtacctactccccttag

SEQ ID NO: 4111 - DNA, 498 bp, Artificial Sequence
  Description of Artificial Sequence: Synthetic coding sequence
atggaggagccccagagcgaccccagcgtggagccccccctgagccaggaaacattttctgacctttggaagctgcttccagaaaataatgtcctgagtccgctgccctcgcaggcaatggacgacctgatgctctctccggacgacatcgagcaatggttcactgaagatccaggccccgacgaggcaccgaggatgccggaagcagcaccacctgtcgcgcccgcacccgcggcccccactcccgccgccccagcgccagccccttcttggcccctctcttcttctgtgcccagtcagaaaacctatcaggggtcttatggatttcggctaggatttctccactccggcaccgctaagagtgtcacgtgtacctactctcccgccctgaataagatgttttgccagttagcaaaaacgtgtccagtccagctctgggtggactcaacccctccccccggcacaagagtcagggcgatggccatttacaaacagtag

SEQ ID NO: 4112 - DNA, 600 bp, Artificial Sequence
  Description of Artificial Sequence: Synthetic coding sequence
atgttctgccagctggccaagacctgccccgtgcagctgtgggtggatagcaccccaccacctgggacacgggttcgggctatggctatttataagcagtcacagcacatgaccgaagtggtgcggcggtgtccccatcacgagcggtgctccgattctgacggcctcgcccctccacagcatctcattagagtagagggcaatctacgggtggagtatcttgacgaccggaatacctttcggcactccgtggtagtcccctatgagccccccgaggtcggatcagattgtactacaatccattacaattacatgtgtaatagctcctgcatgggaggcatgaataggagaccgattctgaccataataaccctcgaagacagctctgggaatctgctggggagaaacagtttcgaagtgagagtgtgtgcatgccctgggagagaccgcagaaccgaggaagaaaatcttcgaaagaaaggtgaacctcaccacgagctccctccagggagcactaaaagagccctgcctaacaacacctcgtcttctccacagcccaaaaaaaagcccctggatggcgaatatttcaccttgcaatag

SEQ ID NO: 4113 - DNA, 468 bp, Artificial Sequence
  Description of Artificial Sequence: Synthetic coding sequence
atggaggagccccagagcgaccccagcgtggagccccccctgagccaagaaactttcagcgatctctggaagctcctgcctgaaaacaatgtgctgtactctccggcgctgaacaagatgttctgccagctagcaaaaacatgtccagtgcaactgtgggtcgactctactccacccccggggacacgggtgcgggccatggccatctataagcagagccagcacatgacggaggttgtaaggcggtgccctcaccatgagcggtgcagcgactcagatggcctcgctcccccacaacatctaatacgggtggaaggaaatttacgggttgagtacctggatgacagaaacacatttcggcactccgtggtggtaccctatgaaccccccgaggtaggaagcgattgtactaccattcactataactatatgtgcaattcgtcttgcatggggggtatgaaccgatag

SEQ ID NO: 4114 - DNA, 468 bp, Artificial Sequence
  Description of Artificial Sequence: Synthetic coding sequence
atggaggagccccagagcgaccccagcgtggagccccccctgagccaggagaccttcagtgacttgtggaaactgttacccgagaacaatgttctgtactcaccggccttaaacaaaatgttctgccagctcgccaagacttgtccggtgcagctgtgggtggactctaccccacctccaggaacgagagtccgagccatggctatctacaagcagtcccagcacatgactgaggtggtgaggaggtgccctcaccatgaaaggtgctccgattccgatggcctggctccacctcagcatttgatacgagtggagggcaatctccgggttgagtacctggatgaccgcaatacctttaggcatagcgttgtcgtgccctatgaacctcctgaagtaggctctgactgcacaaccatacattataactacatgtgcaacagcagctgtatgggcggaatgaaccgctag

SEQ ID NO: 4115 - DNA, 1590 bp, Artificial Sequence
  Description of Artificial Sequence: Synthetic coding sequence
atgctgctggccgtgctgtactgcctgctgtggagcttccagaccagcgcgggtcacttccctcgggcctgtgtaagttctaaaaatctgatggagaaagaatgctgtccgccttggtctggggaccgaagtccctgcgggcagctctcgggccgcggttcatgccaaaacattcttctttctaatgcccccctgggaccccagttcccttttactggggttgatgaccgtgagtcctggccaagcgtcttctacaaccgcacttgtcaatgctctggcaatttcatgggtttcaactgtgggaattgcaagttcggattctgggggccaaattgcactgagcgtcggcttctggtgcgcagaaatatatttgaccttagtgcgccggagaaagataagttctttgcttatctcaccctggcaaaacatacaatcagctctgactacgtgatacctatcggcacttacgggcagatgaagaacgggtcaacccccatgtttaacgatatcaatatctacgatctattcgtgtggatgcattactacgtgtccatggatgccctgctgggggggtctgaaatttggagagacatcgatttcgcacatgaagcgccagcctttcttccctggcatcgactcttccttttgcggtgggaacaggaaatccagaagctgacaggagatgagaacttcaccattccctactgggactggcgggacgctgaaaagtgtgacatttgtactgacgagtatatgggtggtcagcaccctactaaccccaacttactcagccccgcttcttttttttcatcctggcagatcgtctgctccaggctggaagagtataatagtcatcagtcactctgcaacgggacccccgagggcccattaagacgcaaccctggcaaccacgataaatcacgcacaccacgcttgcccagctccgccgacgtggagttctgcctgtccctcactcagtatgaaagtggctcaatggataaggcagctaatttttcctttagaaatactttggaggggtttgcgtcccctcttaccggtatcgcggacgcctcccagtccagtatgcataacgcgcttcatatctacatgaatggcaccatgtctcaagtgcagggctccgcaaatgaccccatttttttattgcatcatgcctttgtggacagtatctttgagcagtggctgagacggcacaggccacttcaagaggtttacccagaagctaatgcccccattggccataatcgggaaagctacatggtgccctttattcctctgtaccgcaacggggacttcttcattagttcaaaagacttaggatatgattactcttacctccaggactccgatccagatagtttccaggattacatcaaaagctatctggaacaagcctcaagaatctggtcatggttactgggagctgccatggtgggggctgtgttaactgccttgctggctggcctcgtgagcctgctctgccgacataagcgtaaacaattgcctgaggaaaagcagcccctgctgatggaaaaagaagattaccatagcttatatcagtcccatttgtag

SEQ ID NO: 4116 - DNA, 1365 bp, Artificial Sequence
  Description of Artificial Sequence: Synthetic coding sequence
atggacccctacatgatccagatgagcagcaagggcaacctgccctccatactggacgtgcacgtgaatgtgggcggacgctctagtgtaccgggaaaaatgaagggacggaaagcacgctggtctgtaaggccctctgacatggccaaaaagacatttaatcccattcgcgccattgtcgataacatgaaagtgaagcccaatcctaataaaaccatgataagcttaagtattggagacccaactgtgttcggcaacctacccaccgaccccgaggtgacccaggctatgaaggatgcattggactcagggaagtacaacggctacgcaccttctatcggcttcctgtcctctcgagaggaaatcgccagctactatcactgtcccgaagctcctctagaagccaaagacgtaatcctgacaagcggatgttcccaagcgatcgacttatgtctcgctgtgctcgccaacccaggacagaatatcctggtgccaagacctggatttagcctctataagaccctggctgagtctatgggtattgaagttaaactgtacaatctacttccggagaagagttgggaaatcgatttaaagcagctggagtatcttatcgatgagaaaactgcttgtctaattgtgaataacccttctaacccatgcggatctgtgtttagcaaaaggcatttgcagaagatactggctgtcgccgcgcggcaatgcgtgccaatcctcgctgacgaaatctacggtgacatggttttttctgattgtaagtacgaacccctagcaaccttgtccacagacgttcccatcctgagctgtggtggcctagccaagcgatggctcgtaccaggatggcggctgggatggatcctgattcacgacaggcgagacatctttggcaacgagattagagacggtttagtgaaattaagtcagcgtatcctcggcccttgcaccatcgtacagggggcactcaagtccattctctgtagaacccctggcgagttctatcacaatacattgtcttttcttaagagcaacgcagacctgtgttacggtgcgctcgctgcaatccccggactgagaccagtacggccaagcggcgccatgtacctgatggtgggcattgagatggagcatttccctgaatttgagaatgatgttgagttcacggagaggctggtcgccgaacagtccgtgcattgtctcccagcaacttgtttcgagtatccaaatttcattagggttgtgattacagtgccagaagtgatgatgctggaggcctgcagcagaattcaggagttctgcgagcagcactatcattgcgcggagggcagccaggaggagtgcgacaaatag

SEQ ID NO: 4117 - DNA, 1602 bp, Artificial Sequence
  Description of Artificial Sequence: Synthetic coding sequence
atggccgtggagagccagggcggccggcccctggtgctgggcctgctcctgtgcgtgctaggaccggtcgtgtcacatgctggaaagatcctcttgattcctgttgacggatcgcactggttaagcatgctgggcgccattcagcagctgcagcagcgaggccacgaaatcgtcgtgttggctccggacgcctccctttatatccgagacggcgcattttacaccctgaagacttacccagtacccttccagagagaagacgtcaaggaatcttttgtcagtctcggacataatgtgttcgaaaacgactcatttcttcagagggtgatcaagacatataaaaagatcaagaaagactccgccatgctcctgtccggctgttcacacctgctgcataacaaggagctgatggcctcccttgccgagagcagtttcgacgtgatgctgacagacccctttctcccctgttccccaatagtggcccagtacctaagccttccaacagttttttttctccatgcgctgccttgctctctggaatttgaggcaacccagtgtcctaaccccttttcgtacgtacctcggcctctctctagccacagtgaccacatgacctttttgcagcgagtgaaaaatatgttgatcgctttttcacagaacttcctgtgcgacgtcgtttatagcccttatgcgactctggcatctgagttcctgcagcgcgaggtgaccgtccaggacttactgagttcggcctccgtttggctattcaggagcgacttcgtgaaagattacccacggccaataatgccaaacatggtattcgttggcgggatcaactgtttgcaccagaacccactctctcaggagttcgaggcttatataaacgcctccggagagcacgggatcgtcgtattctccctgggatccatggtgtccgagatcccagaaaagaaagcaatggcgatcgcagacgctctgggcaagatcccacagactgtcctgtggcgctataccggtacccgccccagtaatctcgctaataacaccatacttgtgaagtggttgccccagaacgacctgttaggccaccccatgactagagcttttattactcacgctggctcgcacggagtgtacgaaagcatatgtaatggcgtccccatggtgatgatgcctttattcggagatcagatggacaacgctaaacgtatggaaacaaagggcgctggagtgactctgaacgtcttggaaatgacaagcgaagatctagagaatgcccttaaagctgtcataaacgacaagtcttacaaggaaaatattatgcgcctcagctctctccacaaggaccggcccgtagagccgctggaccttgccgtgttttgggtcgaattcgtgatgagacataagggtgctccacaccttcgccctgctgcccacgacctgacttggtaccagtaccactctctcgacgttatcggtttcttactggctgtcgtcttgaccgtggccttcatcacgttcaagtgttgcgcctatggctaccgaaaatgtctggggaagaaagggagagtgaagaaggcacataagagcaagacacactag

SEQ ID NO: 4118 - DNA, 1335 bp, Artificial Sequence
  Description of Artificial Sequence: Synthetic coding sequence
atggccgtggagagccagggcggccggcccctggtgctgggcctgctcctgtgtgtgctcggccctgtggtgtcacacgccggcaagatcttgctgattccggtggatgggtcccactggctgagcatgttgggcgccatacagcagctgcagcagagagggcatgaaatcgtggtgcttgccccggacgcaagtctgtacatccgagatggagctttctacacgctaaagacataccccgtcccctttcagcgagaagatgtgaaagagtcattcgtcagtcttggtcacaacgtgttcgagaacgactctttcctgcagagggtgataaagacgtataaaaagataaaaaaagacagtgcaatgctgctgtccggatgcagtcacttgttacataataaggaactgatggcaagcttagccgaatcttcgtttgatgtgatgcttaccgatcctttcctcccatgttcacctattgtggcccagtatctcagtttgccgaccgtgttcttcctccatgcccttccttgtagcttggaattcgaagcaactcagtgccctaaccctttttcttatgtaccccgcccattgtcttcccacagtgatcacatgaccttcttgcagcgagtaaagaatatgttaatcgcatttagccaaaactttctttgtgatgtggtctattccccctacgcgaccctggccagcgagtttttacagcgtgaagtcacggtgcaggacctccttagttccgctagcgtttggctgtttcgttctgacttcgtaaaggattacccacggccgatcatgccaaatatggtattcgtgggagggatcaattgtctgcatcaaaatcctctctcacaggaattcgaagcctatattaatgctagcggcgagcatgggattgtcgtgttctctctgggaagtatggtgagtgagattcccgaaaagaaggccatggccatcgcagacgctctcggcaaaatcccacagaccgtactttggcggtacaccggtacccggccttcaaatcttgcgaacaatacaattcttgtcaaatggttgccccagaatgatttgctcggtcatccgatgacgcgtgccttcattacccacgccggctcacatggcgtgtacgaaagtatctgtaatggtgtacccatggtaatgatgccattgttcggtgaccagatggataacgcgaaacggatggagaccaaaggtgcaggtgtgacattgaatgtgctggagatgacaagcgaggatttagagaacgccttgaaggcagtgattaatgacaagcggaagaaacagcagtcaggaagacagatgtag

SEQ ID NO: 4119 - DNA, 1593 bp, Artificial Sequence
  Description of Artificial Sequence: Synthetic coding sequence
atggcccgggccggctggaccagccccgtgcccctgtgcgtgtgcctcctccttacctgcggctttgcggaggccggaaagctcctggttgtaccaatggacggatcccactggttcacaatgcagtccgttgtcgaaaagcttattctgcggggacatgaagtggtagtggtgatgccagaagtgagttggcagttggagcgaagccttaactgtaccgtgaaaacatatagcacatcttatactctggaagatcagaatcgcgaatttatggtgttcgcacacgcccagtggaaagcacaggcccagtccatattttccctgctgatgtcgagtagcagcgggttcttggacctgtttttctcccattgccgcagcctctttaacgaccgcaagttggtcgaatatttaaaagagtccagcttcgacgccgtgtttctcgacccatttgatacctgcggtctgatcgtggccaagtacttttccctgccctccgttgtctttactagaggtattttctgccaccacctagaagagggcgctcaatgtccggcgcccctatcttatgtgcccaatgatttgttgggattttccgacgccatgaccttcaaagaaagggtgtggaatcatattgtgcatttagaggatcatctgttctgccagtacctgttccgtaacgcattagagattgctagcgagattttacaaacgccggttaccgcctatgacctttacagccatacaagcatatggcttctccgaactgattttgtgctggattaccccaagccggtgatgcccaacatgatttttatcggcggaattaactgccatcagggaaaaccattgccaatggaattcgaggcatatattaacgcgagcggggaacatggtatcgttgtcttctctctcgggtcaatggtttctgaaatccctgaaaaaaaggcaatggccattgctgacgctttagggaagatcccccaaactgtcctatggagatacacggggacacgcccctccaatctcgcaaataacaccattcttgtgaaatggctgccgcaaaacgatctgctgggacatcctatgaccagggccttcatcacgcacgcagggtcccatggggtgtacgaatcgatctgcaacggtgtgcccatggtgatgatgcctctgttcggggaccagatggataacgcgaagaggatggaaactaagggagctggcgttaccctaaacgtgttagaaatgacaagcgaggacctcgaaaacgctttgaaggccgtcattaatgacaagtcctataaggagaatatcatgcggctgtcttctctccacaaagataggccggtagaacctttggatctggctgtattttgggtagaattcgtcatgcggcacaaaggggcaccacacctccgccctgcagcccatgacctcacttggtaccagtatcattccctcgatgtgatcggtttcttgttagccgtggttttaaccgtagcattcattacattcaagtgttgcgcgtatggttatcgtaagtgtttgggtaaaaagggtcgggtcaagaaggcgcataaaagcaagacccactag

SEQ ID NO: 4120 - DNA, 1605 bp, Artificial Sequence
  Description of Artificial Sequence: Synthetic coding sequence
atggccaccggcctgcaggtgcccctgccctggctggccaccggccttctcctgcttctgtccgtacagccctgggctgaaagcggcaaagtgttggtggtgccaatcgatgggtcccactggctttcaatgagagaagtccttcgtgaactccacgcaaggggccaccaggcggtggtgctcacaccagaagtaaatatgcacataaaagaggagaatttttttactttgactacctatgccatttcatggacccaagacgagtttgatagacatgtcctcggtcacactcagctctactttgaaaccgagcacttccttaaaaagtttttccggagtatggccatgctcaacaacatgtcgcttgtgtaccacaggtcatgcgtggaacttcttcacaacgaagccctcattaggcacctcaacgccacatcctttgatgtggtcctgacagaccccgttaatctgtgcgccgccgtactggccaaatatctttccatccccacagtcttcttcctgagaaatattccctgcgacctagattttaagggcactcagtgccctaacccatcttcctacattccaagactgctcacaactaacagtgaccacatgacttttatgcagcgcgtgaagaacatgctgtatcctttagccctcagctacatttgtcacgctttcagtgccccctacgcctctttagcctcggaactgttccagcgcgaagtgtctgtggtggacatcctatctcatgcatctgtgtggctctttagaggggactttgtgatggactatccaaggccaattatgccgaatatggtgttcatagggggaattaattgcgctaaccgcaagccgctctcacaagaattcgaggcctatattaacgctagcggtgagcatggaatcgttgtattcagcctcggctctatggtcagcgaaatccccgagaagaaagctatggctattgccgacgccctgggaaaaatacctcagaccgtactgtggcggtatacaggaacacgcccgagcaacttagctaacaacactatcctcgtgaagtggctcccacaaaacgacctgctgggacatccgatgacgcgagcctttattacccacgcagggtcacatggggtatacgaatccatatgcaacggggtccccatggtgatgatgccgttatttggcgatcaaatggataatgctaagcgcatggagaccaagggcgccggagtcacgctgaacgttttggagatgacatccgaggacctggaaaatgcattgaaggcggtgattaatgataagtcttataaggagaatatcatgcgcctctcttccctccacaaggaccgtccagtcgagcctctagatctggcagttttctgggtcgagttcgtgatgaggcataagggtgccccccatctacggcccgctgctcatgatttaacctggtatcagtaccatagtttggatgtcatcggatttctgctagctgtcgtgctgacggtagcatttataactttcaagtgctgtgcctatggctacaggaagtgcctggggaaaaagggaagagtgaagaaggcccataagtctaagacacactag

SEQ ID NO: 4121 - DNA, 1470 bp, Artificial Sequence
  Description of Artificial Sequence: Synthetic coding sequence
atggccggccagcgggtgctgctgctggtgggcttcctgctgcccggggtcctgttaagtgaagcagctaaaatcctgacaatttccaccgtcgactttaaaaaggaggagaagagctatcaggtgattagctggctcgcccccgaagaccaccagcgagagttcaagaagagtttcgatttttttctggaggagacgctgggcggacgcggcaaatttgagaatcttttgaatgtcctcgagtacctcgctctccaatgttcacattttctaaataggaaggatatcatggattcacttaagaacgaaaacttcgatatggttattgtggagaccttcgactattgccctttcttaatcgctgagaaactgggcaaacccttcgttgcaattctgtccacatcattcggctccctcgagttcggactccccatccccttgtcctatgtccctgtgtttagatccttgctgaccgatcacatggacttttgggggcgcgttaaaaacttccttatgttctttagcttctgtaggcgtcaacagcacatgcagtctacattcgataacaccattaaggagcacttcactgagggatcgagacctgttctgagccatttgttactaaaagctgagctttggtttatcaattccgatttcgcatttgactttgcccggccgttgttgcctaacacagtgtacgttggaggtctgatggaaaaacccattaaacctgtcccgcaggacctggagaacttcattgcgaagtttggagactccgggtttgtattggtgaccttggggtccatggtgaacacctgtcagaatcctgaaattttcaaagagatgaacaacgcctttgctcatttgccccagggtgtcatctggaaatgccagtgcagccactggccaaaagatgtgcacctcgccgccaatgtgaagattgtcgactggctgccccagagtgatctactggcacatccctcaatcaggctcttcgttacccatggtgggcagaacagtataatggaggctatccaacatggcgtgcctatggtcggcattcccctgtttggtgatcagcctgagaacatggtacgcgtggaggcaaaaaaatttggcgtcagtattcagcttaagaaactgaaggccgagacattagccctcaagatgaagcagatcatggaggataagcgctataagtctgccgcggtagcggctagtgtgattctccggtctcatccactctcccccacacaacggttagtcggctggatcgaccacgtgttgcagacaggtggggctacacacttaaaaccatacgttttccagcaaccttggcacgagcagtatctacttgatgtcttcgtgtttctgctgggcctaacattagggaccctctggctgtgtggaaagctgctcggaatggccgtgtggtggctccgaggcgcacgcaaggtcaaagaaacatag

SEQ ID NO: 4122 - DNA, 1572 bp, Artificial Sequence
  Description of Artificial Sequence: Synthetic coding sequence
atggccggccagcgggtgctgctgctggtgggcttcctgctgcccggagtccttctgtcggaagccgccaagattctgacaatttcaaccgtgggcggatctcactatttgctcatggacagagtgtcacagattctccaggatcatgggcacaatgtgacaatgttgaaccataaaagagggccgttcatgccagacttcaagaaagaggaaaagtcataccaggtgatctcatggctcgccccggaagatcaccagcgtgagttcaagaagtcttttgacttctttttggaagagacccttggcgggcgcggaaagttcgagaatcttctgaatgttctagaataccttgcactgcaatgctctcacttcctgaatcgcaaagacattatggattcactgaaaaacgagaacttcgacatggtgattgtggaaaccttcgattattgcccatttctgatcgctgaaaagcttggcaaaccgtttgtcgccattttgagcacttctttcgggagcctggaattcggcttgcccatcccccttagctacgtaccagtgtttaggagcctcctcaccgaccatatggatttctggggtcgcgtgaaaaacttcctcatgtttttctcattctgtagacgacagcagcacatgcagtccactttcgacaatacgatcaaagaacatttcacagaggggtctaggccagttttgagccacctgctcttgaaagctgagttgtggttcataaattcagactttgcctttgactttgctcgtccactactgccaaacaccgtatacgtgggaggattgatggagaagcccataaagcctgtgccgcaggacctggagaatttcatcgcaaagtttggagattcaggatttgttcttgttacgctcggaagtatggttaatacttgccagaaccctgaaatctttaaggagatgaataacgcctttgcccacctgccccagggcgtaatctggaagtgtcagtgtagccattggcccaaggatgtgcacttggcggcaaatgtgaagattgttgattggcttccccaatccgacctgctggcacatcccagcataaggttatttgttacgcacggggggcagaattccattatggaggccattcagcacggtgttcctatggtcggaatcccactgttcggagaccagccggagaatatggtgagggttgaggcaaagaagtttggagtgtcgattcagctgaagaaactcaaagcagaaacactcgccctcaaaatgaagcagatcatggaagacaagcgatataaaagcgctgctgtagccgccagcgttatcctgcggagccatccactgtctcccacgcagaggctggtggggtggatcgatcatgtgttgcagaccggcggagccacccatctgaaaccatacgtcttccaacagccgtggcatgagcagtatctcttggacgtctttgtgtttttgcttggcctgactcttggtactctgtggctatgtggaaagctccttggcatggctgtatggtggctgcgaggagcacgcaaggtgaaagaaacctag

SEQ ID NO: 4123 - DNA, 417 bp, Artificial Sequence
  Description of Artificial Sequence: Synthetic coding sequence
atggccggccagcgggtgctgctgctggtgggcttcctgctgcccggcgtgctactgagcgaggctgccaaaatcttgactattagcacagtgggtggttctcattatctgctgatggacagagtgtctcagattctccaggatcacggtcataatgtgacaatgctgaatcacaagagaggtcctttcatgcctgacttcaagaaagaggagaaatcataccaggtgatctcttggctcgcccccgaggaccaccaacgggaatttaaaaaatccttcgactttttcctcgaggaaacactgggtggccgggggaaatttgagaacctccttaatgtactcgagtatttggccttgcagtgctctcactttttgaatagaaaggatattatggactccctcaagaatgagaactag

SEQ ID NO: 4124 - DNA, 666 bp, Artificial Sequence
  Description of Artificial Sequence: Synthetic coding sequence
atggtgaacacctgccagaaccccgagatcttcaaggagatgaacaacgccttcgcccaccttccacagggtgtaatctggaaatgccagtgttcacattggcccaaggatgttcacctcgctgccaatgtcaagattgtggattggctgccccagagcgaccttttagcgcacccctccatccgcttgtttgttacccacggcggacagaactccatcatggaagccatccagcacggtgtgcctatggtggggatacccctgtttggtgatcagccagagaacatggttcgggtggaagccaaaaaattcggggtgtcgatccaacttaagaagctcaaggctgaaactctcgccttgaagatgaaacagatcatggaggataagcgatacaaatcagccgctgtggcagcctcagttatccttcggtctcacccattatccccaacccagagactggtgggatggatagatcacgtgcttcagacaggcggggcaacacatttgaaaccctacgtgttccaacagccttggcacgaacagtacctgcttgacgtgtttgtgttcttgttaggattgaccctcggaactctatggttatgtggcaagctcctcggcatggccgtttggtggttaagaggcgcacggaaggtcaaagagacatag

SEQ ID NO: 4125 - DNA, 1086 bp, Artificial Sequence
  Description of Artificial Sequence: Synthetic coding sequence
atggccatgaactacaacgccaaggacgaggtggacggcggccccccatgtgctcctggcggaactgcaaagacccgcagaccagacaacaccgctttcaagcaacagaggctccctgcatggcagcctatcctgactgcaggcaccgtgctcccaatcttcttcatcatcggactaatattcatccccattggaattggcatctttgtgacctcgaataacatccgggagatcgagatcgactatactggaactgaacctagcagtccatgcaataaatgcctctctcccgacgttaccccatgcttctgcaccattaacttcacactggagaaaagcttcgagggcaacgtgtttatgtactatggtttgtccaacttttatcagaatcataggcgctatgtcaaaagcagggatgactcccagcttaatggcgacagtagcgccttgttaaacccgtcaaaagaatgtgaaccttatagacgaaacgaagacaagcccatagcaccttgtggcgctatcgccaactccatgtttaatgatacacttgagttattcttgataggcaacgactcatatccgatccccattgcattaaagaaaaaggggatcgcctggtggacagacaagaacgtgaagtttcgcaatccacctgggggagataatcttgaggagcgctttaagggaaccaccaagccagttaactggttgaagccagtctatatgctggactctgaccccgacaataatggcttcataaatgaggactttattgtgtggatgcgcaccgctgctctgcccaccttccggaagttgtatcgtttaattgagaggaaatccgacttgcaccccactctccccgccggaagatatagtctgaacgtcacatacaattatccagtgcactattttgatgggcgcaagagaatgatcctgtcaacaattagttggatgggcggaaaaaacccttttctgggtatcgcatacatcgccgttgggtcaatctcatttttactgggagtagtgcttttagtcattaatcacaagtatagaaattcctcaaatacggccgatatcacaatctag

SEQ ID NO: 4126 - DNA, 954 bp, Artificial Sequence
  Description of Artificial Sequence: Synthetic coding sequence
ctgaccgaccggcagaccgacaccgcccccagccccagctaccacctgctgccgggacgcaggcggacagtggatgcagcagcttctcggggacaggggcccgaaccagctccgggaggaggagtcgagggagttggagcccgaggcgtcgccttgaaattgtttgtgcagcttctgggctgctcacggttcggtggggcagtagtgagagccggcgaagccgagcccagcggtgcagccagaagtgcaagttccgggcgcgaggagccccaacccgaggagggtgaggaggaggaggagaaggaagaagagagggggccacagtggaggttaggagcccggaaacccggaagctggactggagaggcagccgtctgtgccgacagtgcccccgcggctcgggctcctcaggcattagcaagggcctccggccgtggagggcgtgtggcccggcggggggctgaggaatctggccctccccactcgccatctaggcgcgggagcgcctcccgagcagggcccggtagagctagcgagaccatgaatttcttactctcttgggtgcattggtctctggctctcctgttgtacctccaccacgcaaaatggagccaggctgcacccatggccgaaggcggcggtcaaaaccaccatgaagtggtaaagttcatggatgtgtatcagagaagttactgccacccaattgagactctcgtggacatctttcaggaatatccagatgagatcgaatacatattcaaaccaagctgcgttccccttatgcgctgcggcggatgttgcaatgacgaaggattggaatgtgttcccaccgaagagtctaacataaccatgcagattatgcggatcaaacctcatcaaggccaacacattggggaaatgtcctttctccagcataacaagtgtgagtgccggtgcgataaaccgcggcgttag

SEQ ID NO: 4127 - DNA, 1239 bp, Artificial Sequence
  Description of Artificial Sequence: Synthetic coding sequence
ctgaccgaccggcagaccgacaccgcccccagccccagctaccacctcctaccagggcgcaggagaaccgtggatgcagctgccagtcggggacagggaccagagcctgccccgggaggaggagtggagggagtcggggccagaggcgtcgccttaaaactgtttgtacagctcttgggatgctctaggttcggaggggctgtggttagggcaggggaagccgagccttccggcgcagcaaggagtgcctccagcggccgcgaagaaccacagcctgaggaaggtgaggaggaggaagagaaggaggaagagagaggcccccagtggcggctcggcgccaggaagcccggaagttggactggggaagcagcagtctgcgcagactctgcgcctgcagcccgagcgcctcaggccctggctcgggcgtctgggagaggaggcagggtagcacgcagaggcgccgaagaaagcggccccccccactcaccctctcggagaggctctgcgagcagagcaggacccggccgtgcctctgaaacaatgaatttcctccttagttgggtgcactggagcctggctctactcctctacctgcatcacgccaaatggtctcaggctgctccaatggctgaaggaggcggccagaaccaccacgaggtggtgaaattcatggatgtataccagcggagttactgccacccaatagagactctcgtagacatatttcaggagtacccagacgagattgaatatatcttcaagcctagctgtgtgccgttaatgcggtgtggggggtgttgcaatgacgagggactggagtgcgtcccaaccgaggagagcaacataaccatgcagatcatgcgcatcaagccgcaccagggccaacacatcggtgagatgtctttcctgcagcacaacaagtgcgaatgtagacccaagaaggacagggccagacaggaaaagaaatccgtacgtggaaagggcaaaggacagaaacgtaagagaaagaagtccagatataaaagctggagcgtttatgttggagcgagatgctgtctgatgccgtggagtctgcccgggccacacccttgcggcccctgctccgagagacgaaaacacttgtttgtgcaagatcctcagacttgtaaatgtagctgtaaaaacactgacagccggtgtaaagcaaggcagctcgaactgaacgaacgcacatgtcgatgtgataagcctaggcggtag

SEQ ID NO: 4128 - DNA, 984 bp, Artificial Sequence
  Description of Artificial Sequence: Synthetic coding sequence
ctgaccgaccggcagaccgacaccgcccccagccccagctaccacctgctgcctgggaggagaagaacggtcgatgctgcggcgtcccgggggcaaggaccggagcctgctcctggcggtggagtggagggtgttggagccaggggtgtggcactcaagctattcgttcaactgcttgggtgtagccggttcggcggagccgttgttagggctggagaggctgagccctccggcgctgcaaggagtgcctcttctggcagagaggagccgcagcctgaagagggagaggaggaagaggaaaaggaagaagaacgcgggcctcaatggcgactgggggcaaggaagccggggtcgtggactggagaggcagccgtctgcgcagactcggctccagctgcccgtgcgccccaggcactcgcccgtgcgagtggcaggggaggccgagtcgctcgccggggtgccgaagaatccgggccgccccacagcccttcacggcgcggtagtgcgagccgtgctgggccaggacgagcatcagagaccatgaactttctgctctcttgggttcactggtcccttgcgctcttactctacctgcatcacgctaagtggtctcaggctgcacccatggccgaggggggcggtcagaatcaccatgaggtggttaagttcatggacgtctaccaacgcagttactgtcatccaattgagaccttggtcgacattttccaggagtaccccgacgagatagaatacatcttcaaacccagttgcgtccctctgatgcggtgcggggggtgctgcaatgatgaaggactggagtgtgtgccgaccgaagaatcaaatattaccatgcaaattatgcgtatcaagccccaccagggacagcatattggtgagatgagcttcctccagcataacaagtgtgagtgtcgtccgaagaaagatcgggcacggcaggagaaatgtgacaaaccccggcggtag

SEQ ID NO: 4129 - DNA, 1116 bp, Artificial Sequence
  Description of Artificial Sequence: Synthetic coding sequence
ctgaccgaccggcagaccgacaccgcccccagccccagctaccacctgttgccgggccgccgtagaacggtagacgcagctgccagccgcgggcaggggcccgagccagctccaggcggcggggtcgaaggagtgggagcaagaggtgttgcacttaagttgtttgtacagttgctcgggtgtagcagatttggtggggctgtggtcagagccggcgaagccgagccctcgggcgcagccaggtcagctagcagcgggagagaggagccccagccggaggagggcgaggaggaggaagagaaagaggaagaacggggcccccagtggcgcttgggagccagaaaacctgggagctggaccggcgaggcggcagtatgcgctgactcggcacctgccgccagggctcctcaggcacttgccagggcatcagggagagggggccgggtggcccgaaggggtgctgaggaatctggacctcctcactccccgagccggagagggtcagcatcccgagcaggccctggtcgcgctagcgagaccatgaacttccttctctcatgggtacactggtccctggctttacttttgtatcttcaccatgcgaagtggagccaggccgccccaatggcagagggaggaggacagaaccaccacgaagttgtcaaatttatggatgtttatcagcggagttactgtcaccccatagaaaccctggtggatatattccaggagtatccagacgagattgagtatatcttcaagccctcatgtgtgcccctcatgaggtgcggtggatgctgcaacgatgaggggctagaatgtgtgcccacggaagagtctaacataactatgcagatcatgcggatcaagcctcaccagggacagcacatcggggaaatgagctttctgcagcataacaaatgtgagtgccggcccaaaaaagacagagcaaggcaggaaaatccgtgcggaccttgtagtgagagacggaagcacctcttcgtccaggatccacagacatgtaaatgtagctgcaaaaacacagattcccgttgcaaagcccgccaactggaactgaacgagcggacatgtaggtgcgacaaacctcgcaggtag

SEQ ID NO: 4130 - DNA, 444 bp, Artificial Sequence
  Description of Artificial Sequence: Synthetic coding sequence
atgaacttcctgctgagctgggtgcactggagcctggccctgctgctctatctccaccatgccaaatggtctcaggccgcccctatggctgagggtggagggcaaaatcaccacgaggtggttaagtttatggacgtgtaccagaggtcgtactgccaccccatagaaaccctggtcgatatctttcaggaatacccggatgaaattgagtacatttttaagccctcttgcgtgcccctaatgcgctgcggcggatgttgcaacgatgaaggccttgagtgtgtccctactgaagagtctaacatcacgatgcagataatgagaatcaagccccaccaaggacagcacattggggaaatgtccttcttacaacacaataaatgtgagtgcaggcccaagaaagaccgggcgcgtcaagaaaaatgcgataagcctaggaggtag

SEQ ID NO: 4131 - DNA, 1170 bp, Artificial Sequence
  Description of Artificial Sequence: Synthetic coding sequence
ctgaccgaccggcagaccgacaccgcccccagccccagctaccaccttctgccggggagaagacgtactgtagacgcggccgctagccggggccaagggcccgaaccagccccgggcggaggggtggagggcgtgggggcaagaggggtggctttgaaacttttcgttcagctgctgggctgcagccggtttgggggagccgtcgtgcgggccggcgaggctgaacccagtggggccgcccgcagcgcgagctctggcagggaggagcctcagcccgaggagggtgaggaggaagaggagaaggaggaagagcgggggccacagtggcggctgggagcccgaaagcctggatcctggacaggggaggccgccgtgtgtgcagatagtgcacctgcagcacgagctccccaagctctggccagagcctcagggcgtggaggacgcgtagcccggaggggggccgaggagtctggacccccccactcgccatcaagacgcgggtccgcatcgagggcgggtcccggaagagcgtctgaaaccatgaatttcctcctcagctgggtgcattggtctctggctttactcctgtacctacatcacgccaagtggtcacaggccgcccccatggcggaagggggaggccagaatcaccatgaagtggtgaaattcatggatgtgtaccagagatcctactgtcacccaattgaaaccttggttgatatctttcaggagtacccagacgaaatcgagtacattttcaaaccaagttgcgtgccattaatgagatgtggaggctgctgcaatgatgaaggcctcgaatgcgtgcccacagaggagagcaacattacaatgcaaattatgagaatcaaacctcaccaaggacagcatatcggcgagatgtcctttttgcagcataacaaatgcgagtgtaggcccaagaaggatagagccaggcaggagaaaaagagtgtgagaggaaaggggaaaggacagaagcggaagcgtaaaaaatcccgaccatgtgggccttgctccgaacggagaaagcatctcttcgttcaggatccgcaaacttgcaaatgtagctgcaaaaacaccgattcccggtgtaaggctagacagctggagctgaacgagcgcacctgtcgctgtgacaagccgcggaggtag

SEQ ID NO: 4132 - DNA, 1065 bp, Artificial Sequence
  Description of Artificial Sequence: Synthetic coding sequence
ctgaccgaccggcagaccgacaccgcccccagccccagctaccacctcctccctggacgcaggagaaccgtggacgctgcagccagcagaggccaggggccagagccagcgccgggcgggggagtggaaggggtgggagcaaggggggtggcactgaagctgttcgttcagcttttaggctgcagccgcttcggtggcgccgttgtgagagctggcgaagcagagccgagtggggcagcccggagtgcctcctccgggcgtgaagaacctcagccagaagagggggaagaggaagaagagaaagaggaagagcgcggacctcaatggcgcctgggcgcaagaaaacctgggagctggacaggcgaggcagccgtgtgcgctgattcagctccggcagctcgggctccccaggcactagcacgcgcatccgggcgcggtggaagagtcgcaagacgcggtgcggaggaatctggaccaccccacagtccgtcacggcgaggcagcgccagtcgcgccggccctggccgcgctagcgaaactatgaacttcctcttgtcctgggttcattggtcactggcactgctcttgtacctgcaccatgcaaagtggagccaggccgctcccatggcagagggcggagggcagaatcatcacgaggtcgtcaaattcatggatgtgtaccagcggagctactgccatcccatcgagactctggttgacatctttcaagaatacccagacgaaatcgagtatatttttaaacctagctgtgtccccctgatgagatgcggtgggtgctgtaacgatgagggtctggagtgtgtacctaccgaagaatctaatatcaccatgcagataatgcgcatcaagccgcaccaggggcagcacataggcgaaatgtcgtttctccagcataacaaatgcgagtgtagacccaagaaggatcgggccaggcaggaaaacccctgtggaccatgctcagagcgtcggaagcacctgtttgtgcaggacccacaaacatgtaaatgcagttgcaaaaatactgatagccgatgcaaaatgtag

SEQ ID NO: 4133 - DNA, 1188 bp, Artificial Sequence
  Description of Artificial Sequence: Synthetic coding sequence
ctgaccgaccggcagaccgacaccgcccccagccccagctaccacctcctgcctgggcggcgcaggactgtggatgcggctgcatcaagggggcagggaccagagccggcacctggcggcggggtggaaggcgtgggggcccggggggtggccctcaagctgttcgtccagctgctgggttgctcccgcttcgggggtgccgttgttcgcgcaggggaggctgaaccatccggagcagcaaggtcagcttcgtcaggcagagaggaaccacagcctgaggagggggaagaggaggaagaaaaggaagaagagcggggtcctcagtggcgcctaggcgctagaaaacccggtagttggacaggcgaggccgcagtgtgtgctgatagcgcccctgccgcaagggccccacaggctctcgctcgtgcttcagggaggggcggaagagtcgctaggagaggtgcagaagaaagtggcccgcctcactcgccttcccggagaggatccgcatccagagctggccccggtagggccagcgaaacgatgaactttttattgagctgggtacactggtctctggcgctactgctgtaccttcaccatgctaagtggtctcaggctgcccctatggccgagggaggcggacagaaccaccatgaggtagtcaaattcatggatgtgtaccagaggagctactgccaccctatagagacgctagttgacatcttccaggaataccccgacgaaatcgagtatattttcaaaccttcgtgcgtgcccttgatgcgctgcgggggctgttgcaacgatgaggggctagagtgtgtacccaccgaggaatcaaatattaccatgcagatcatgcggatcaagcctcatcagggccagcatatcggggagatgagctttcttcagcataacaaatgtgagtgccggcctaaaaaagatagggcccgccaggagaagaaatccgtgaggggaaaagggaaggggcagaagaggaaacgaaaaaagagcaggtataagtcctggtccgtcccatgcggaccttgttcagaacggcgcaaacacttgtttgtccaggacccccagacctgtaaatgctcttgcaaaaacactgatagtcgatgtaaagctagacagctcgagttaaatgaaagaacctgcaggtgcgataagccacggaggtag

SEQ ID NO: 4134 - DNA, 414 bp, Artificial Sequence
  Description of Artificial Sequence: Synthetic coding sequence
atgaacttcctgctgagctgggtgcactggagcctggccctgctgctgtatttacaccatgccaaatggtctcaggctgccccgatggccgaaggcgggggtcaaaatcaccacgaagttgtcaaattcatggacgtctaccagcgcagctattgccatcccattgaaactctggtggacatattccaggaataccccgacgaaatcgaatacatcttcaaacccagttgtgtcccactgatgaggtgtggggggtgctgcaacgacgaggggttagaatgcgttcctacagaagaatctaatatcaccatgcagatcatgcggataaagcctcaccaaggtcaacacatcggagagatgtctttcctccagcacaataagtgcgaatgtcgctgtgataaaccacgccgctag

SEQ ID NO: 4135 - DNA, 1116 bp, Artificial Sequence
  Description of Artificial Sequence: Synthetic coding sequence
ctgaccgaccggcagaccgacaccgcccccagccccagctaccacctacttccaggccgccggcggaccgtggatgcagcggcgagccgcggtcagggcccagaacccgccccgggaggaggcgtagagggcgtgggcgccaggggggtggctcttaagctgtttgtgcagcttctgggatgcagtaggtttggcggagcggtggtcagagcaggagaggcagagcccagcggagccgcccgctcagcaagctctggcagagaggagccgcagcctgaagagggtgaagaggaggaagagaaggaggaggaaagaggaccgcagtggcgtttaggagcgcggaagcccggcagctggaccggagaggctgccgtctgtgccgattcagcgcccgcagcccgggcccctcaggctcttgctcgcgcgtccggccgaggtggcagagtcgctaggagaggagccgaagaatccgggccaccacactccccctccaggaggggttcagcctcgagagccggacctgggcgtgcatctgaaacaatgaactttctcttgagttgggtgcactggtcgctagctcttctgctgtatttgcatcatgcaaaatggagccaggcagctccgatggctgaaggcggtggacagaaccatcacgaggtcgttaagtttatggatgtctaccaaagaagctattgtcatcctatagagaccctcgtggatatttttcaagagtatcccgatgaaattgagtatatttttaagccatcttgcgtacctctgatgcgctgcggtgggtgttgtaatgacgagggcctggagtgtgtacccaccgaagaatcgaatatcactatgcagataatgcgtattaaaccacaccagggccagcacatcggagaaatgtcattcctccagcacaacaaatgcgaatgccgtcctaagaaggaccgcgcccgtcaggaaaatccctgcggaccttgctcggagcgtcgcaagcacttattcgtgcaggatccccagacctgcaaatgtagctgcaagaataccgactcccggtgtaaggcgcggcagctggaacttaatgagcgcacctgtcgcagtcttacccgaaaggactag

SEQ ID NO: 4136 - DNA, 630 bp, Artificial Sequence
  Description of Artificial Sequence: Synthetic coding sequence
atgaacttcctgctgagctgggtgcactggagcctggccctgctgctgtatctccatcatgccaaatggagtcaggcagcccctatggcagaggggggcggccagaaccaccatgaggttgtcaagttcatggatgtgtaccagcgctcttattgccatcctattgagactctcgtcgatattttccaggagtacccagatgagattgaatacatttttaaacccagttgtgtccctttgatgcgctgcggagggtgttgcaatgacgagggtcttgaatgcgtgcccactgaggaatctaacatcacaatgcaaataatgcgaattaagcctcatcagggacagcatataggcgagatgagcttcctccaacacaacaaatgcgaatgccggccaaagaaagaccgggcccgacaggaaaagaagtctgtgcggggaaagggcaaagggcagaagagaaaacggaaaaaatcgaggccttgcggcccctgttcggagcgccggaagcacctctttgtccaggacccacagacatgtaagtgctcatgcaaaaacaccgactcaaggtgcaaggcccggcaattggaactgaacgaaaggacctgccggtgtgacaagcctcgccggtag

SEQ ID NO: 4137 - DNA, 576 bp, Artificial Sequence
  Description of Artificial Sequence: Synthetic coding sequence
atgaacttcctgctgagctgggtgcactggagcctggccctgctgttatatctgcatcatgcgaagtggtcacaggctgcccctatggctgaagggggtggccaaaatcaccacgaggttgtgaaatttatggacgtctatcaacggtcatactgccacccgattgagacactcgtcgatatattccaggaatatcccgacgagatcgagtacatctttaagcccagctgtgttccgctcatgaggtgcggggggtgctgcaacgatgagggccttgagtgcgttcctacagaggaatctaacatcaccatgcagatcatgcgcattaagccccatcaggggcagcatataggtgaaatgagcttcctccaacacaacaagtgcgagtgtcggcctaaaaaggatagagcaaggcaggagaacccttgcggtccctgcagcgaacggaggaagcatttgttcgttcaggatcctcaaacatgtaaatgtagctgcaaaaataccgattcccggtgcaaggctcgccagttggagctgaacgaaaggacttgtaggtcgctgacccggaaggactag

SEQ ID NO: 4138 - DNA, 972 bp, Artificial Sequence
  Description of Artificial Sequence: Synthetic coding sequence
tgacggggccagggccccgagcccgcccccggcggcggcgtggagggcgtaggtgcgcggggggtggcactgaagcttttcgtccaactcctcggctgctcaaggttcggaggagctgtggtcagggctggcgaggccgaaccttctggagccgccagatctgcttctagtggacgggaggaaccacagccagaggagggtgaggaagaggaagaaaaagaagaggaacgggggccgcaatggcgcctgggtgcacgaaagcctgggagctggacaggcgaagccgcagtgtgcgccgactctgcccctgctgcgcgcgctcctcaggcattagcaagggcctccggccggggaggacgggttgccaggcgcggcgcagaagaaagtggaccgccccactctccttccaggcggggatctgcctccagagctggccctggtagagcatcagagacaatgaactttcttctgagctgggtgcattggtccctagcgcttctgctgtatctccaccatgccaagtggtctcaggctgcacccatggccgaggggggaggccagaaccatcatgaggtcgtgaagtttatggacgtctatcagaggagctattgccacccaattgagacactggttgacattttccaggaatacccggatgagatcgagtacatctttaaaccttcttgtgttccactgatgaggtgcggtggatgttgcaacgacgaagggctcgagtgtgtgcccaccgaggagagcaacattaccatgcagatcatgcgaatcaaaccccatcaaggtcagcacattggagagatgtcatttttgcaacataataaatgcgaatgtcgacccaaaaaagatagggcacgacaggaaaagaaatcagtaagagggaagggaaaaggccaaaaaaggaagcggaagaagagccggtataagtcatggtccgtatgcgataagccgagacgctag

SEQ ID NO: 4139 - DNA, 648 bp, Artificial Sequence
  Description of Artificial Sequence: Synthetic coding sequence
atgaacttcctgctgagctgggtgcactggagcctggccctgctgctctaccttcaccacgcgaagtggagccaggccgctcctatggcagagggaggcggccaaaatcatcatgaagtggtaaaatttatggatgtgtaccagagaagctactgccacccaatagaaaccctggtggacatttttcaggaatatcctgatgagattgaatatatcttcaagccaagctgcgtccctctgatgaggtgtggcggctgctgtaatgacgagggcttggagtgtgtgccaacagaagaatccaacatcacaatgcagatcatgagaataaagccacaccaaggccagcacattggcgagatgtctttcctgcaacacaataaatgtgaatgtcggcctaagaaggatcgcgctaggcaggaaaagaagagcgtgagaggcaagggaaagggtcaaaagagaaaaaggaaaaagagcagatataaatcctggagcgtgccttgcggcccctgttctgaacgacggaagcacctctttgtgcaggatcctcaaacttgcaaatgctcgtgcaagaatacagacagtcggtgtaaggcccgacagctagagctgaatgaaaggacctgtcgatgtgataagccccggcgctag

SEQ ID NO: 4140 - DNA, 525 bp, Artificial Sequence
  Description of Artificial Sequence: Synthetic coding sequence
atgaacttcctgctgagctgggtgcactggagcctggccctgctgctgtatcttcaccacgccaagtggagccaggccgctcccatggcagagggaggcggccagaatcatcacgaggttgtcaaatttatggacgtataccagcggagttactgtcacccaatcgaaactctggttgacatttttcaagaatatcccgatgaaatcgaatacatttttaagccatcgtgtgtgcccttgatgcggtgtggcggatgttgcaatgacgagggcctggagtgtgttcccaccgaggagtctaatataaccatgcagatcatgcgaataaagccccaccagggccagcatataggagaaatgagtttcctgcaacacaataagtgcgagtgcagacctaagaaggaccgggccaggcaggaaaacccatgcggtccttgctccgagaggagaaaacacttgtttgtgcaggatccacagacctgcaagtgttcctgtaaaaacaccgatagtagatgcaagatgtag

SEQ ID NO: 4141 - DNA, 699 bp, Artificial Sequence
  Description of Artificial Sequence: Synthetic coding sequence
atgaacttcctgctgagctgggtgcactggagcctggccctgctgctgtacctacaccacgcaaagtggtcccaggctgcacccatggccgagggaggcgggcagaaccatcacgaagtcgtgaaattcatggatgtatatcaaaggtcctactgccaccccatcgaaacgctggttgatatctttcaggaatatccagatgagattgagtatattttcaaaccaagctgcgtacctttgatgaggtgtggcggctgttgtaatgatgaaggactcgaatgcgtgccaacggaagagtcaaacataacgatgcaaatcatgcgcatcaaaccacaccagggccaacatatcggagaaatgtcctttctccagcacaacaagtgtgaatgtcgccccaaaaaggatcgtgcaagacaggaaaaaaagagtgtgaggggaaaggggaagggccagaagcgcaagcgaaagaaaagccggtacaaatcatggtccgtctacgttggtgcaagatgctgcctgatgccttggtctctgcctggtcctcatccttgcgggccgtgttcagagcggcgtaaacatctgttcgtgcaggacccgcaaacttgtaagtgctcttgtaaaaatacagactctcgatgcaaggcccgccaattagagttgaacgagcggacatgtcggtgcgataaaccgcgccggtag

SEQ ID NO: 4142 - DNA, 576 bp, Artificial Sequence
  Description of Artificial Sequence: Synthetic coding sequence
atgaacttcctgctgagctgggtgcactggagcctggccctgctgctctatcttcaccacgctaagtggtcgcaggccgcccccatggcggaaggcggggggcagaatcatcacgaagtagtaaaatttatggatgtctatcagaggagctactgccaccctattgagaccttggtggacattttccaagaatacccagatgaaatagagtacatctttaagccctcttgcgtaccccttatgcggtgtggaggatgttgtaacgacgaagggttggagtgcgtaccaaccgaagagtccaatatcactatgcagatcatgagaatcaaaccccaccagggtcaacacatcggcgagatgtctttcctccagcataataaatgtgagtgcaggcccaagaaggacagggcccggcaggagaacccttgcgggccctgctcggagagacgcaaacatctgttcgtgcaagatccccaaacgtgcaaatgttcctgcaaaaatacagatagtaggtgtaaggcacgacagctggaactaaacgagcggacttgccgatgtgacaagccaaggcgctag

SEQ ID NO: 4143 - DNA, 1263 bp, Artificial Sequence
  Description of Artificial Sequence: Synthetic coding sequence
atgcacctgctgggcttcttcagcgtggcctgcagcctgctggccgcggctctgctgcccggaccaagggaagctcctgctgctgctgctgctttcgagagcgggctggacttgagcgatgcggagccggatgctggggaggccaccgcttatgcctcaaaagatcttgaagagcagctgaggtccgtctcatctgttgacgagctgatgacagtcttataccccgaatactggaaaatgtataaatgtcagctccggaagggtggctggcaacataaccgagagcaggctaatttaaattcccgcaccgaggaaaccattaagtttgcggcggcacactacaatacagagattctaaagtccatagataacgagtggagaaagacccagtgcatgcctcgagaggtgtgcatcgatgttggcaaggaatttggcgtcgcgaccaatacattcttcaagccaccttgtgtgtcagtgtacaggtgcggaggctgctgcaacagcgaagggctgcagtgtatgaacacgtccacatcttacttgtctaaaacactgtttgaaattactgtacctttgagtcagggccccaagcctgtgaccatttcgtttgccaatcacacctcgtgcaggtgtatgtccaagctggatgtttatcggcaggtccacagtattattcgtagatcccttccagcaacactccctcagtgccaggcagccaataaaacatgtccaaccaattatatgtggaacaatcacatctgtcgctgtctcgcacaagaggatttcatgttttcaagcgatgccggagacgacagcaccgacggattccatgacatctgtggccctaacaaggaactagacgaagaaacatgccagtgcgtgtgccgagccgggctgcgacctgcctcttgcgggccgcacaaagaactggacagaaactcctgtcagtgcgtttgtaaaaacaagctctttccttctcagtgcggtgcaaatagagagttcgacgagaacacttgtcagtgcgtctgtaaacgcacatgccccagaaaccaacctctcaatccaggcaaatgtgcgtgtgagtgtactgagtctccgcagaaatgcctgctcaagggcaagaaattccaccaccaaacgtgtagctgctataggaggccttgcacaaacaggcaaaaagcttgtgaaccgggtttttcgtactccgaggaggtctgtcggtgtgtgccttcttattggaagagacctcagatgatgtcttag

SEQ ID NO: 4144 - DNA, 510 bp, Artificial Sequence
  Description of Artificial Sequence: Synthetic coding sequence
atggacacccggaacaaggcccagctgctggtgctgctgaccctgttgtctgtattgttctcacagacctctgcctggccgctctatcgcgctccgagtgccctgaggctgggagatcgcattcccttcgagggcgccaatgaacccgatcaagtctctctgaaggaagatattgacatgctgcaaaatgctctggctgaaaacgacacaccttattatgacgttagcaggaacgctcgccatgcagatggggtcttcacctcagacttctctaagctccttggccagttaagcgccaaaaaatatctcgagtcactcatgggcaagagagtcagcaacatcagtgaggaccctgttcccgtcaaacggcatagtgatgccgtattcacggacaactacacaagattgaggaaacaaatggctgtgaaaaagtatctgaattccattttgaacggcaagcgatccagcgagggcgaaagtccagacttccccgaggagctcgagaagtag

SEQ ID NO: 4145 - DNA, 513 bp, Artificial Sequence
  Description of Artificial Sequence: Synthetic coding sequence
atggacacccggaacaaggcccagctgctggtgctgctgaccctgttgagtgtcttgttttcccaaaccagcgcatggcccctttatagagcacctagcgcccttcgactgggtgacagaatcccattcgagggcgcgaacgaaccagaccaggttagcttaaaggaggatatcgatatgcttcagaacgcccttgcagaaaatgataccccctactacgatgtgtccagaaacgcacgtcatgccgatggcgtgtttacatctgatttcagtaaactgctgggccagttaagtgctaaaaaatatctcgaatctctcatggggaaaagagtcagctccaatatcagcgaggatcctgtccctgtcaagcgacacagcgacgcagtattcacagataattacaccaggctgcgcaaacaaatggcagtgaagaagtatcttaactccatcctgaatggaaaaaggtcctctgagggcgagagcccagacttcccagaggaactcgaaaagtag

SEQ ID NO: 4146 - DNA, 360 bp, Artificial Sequence
  Description of Artificial Sequence: Synthetic coding sequence
tgagtgagcctgaaggaggacatcgacatgctgcagaacgccctggctgagaatgacacgccatactatgatgtgagccgaaatgcaaggcacgccgacggcgtttttaccagcgacttcagcaagctgttggggcagctgagtgccaagaagtacctggaatcactgatgggaaaacgggtatcatctaacatctcagaggatccagttccagtcaaaaggcattcagatgctgtctttaccgataattatacgagactgcggaaacagatggctgtgaaaaagtatcttaacagtattctgaacggaaaaagaagcgagggggaatcccccgattttccagaggaattagagaagtag

SEQ ID NO: 4147 - DNA, 774 bp, Artificial Sequence
  Description of Artificial Sequence: Synthetic coding sequence
atgcccctgaacgtgagcttcaccaaccggaactacgacctggactacgactccgttcagccttacttctattgcgatgaggaggagaatttttatcagcagcagcagcagtccgagctccagcctcccgctccgagcgaagacatctggaagaagtttgaactcttaccgacccccccgctttccccctcaagacggtcggggctttgtagcccgagctatgtcgcagtgacccctttttctcttaggggagataatgacggcgggggaggcagcttttctaccgctgatcaacttgagatggttacagaacttctcggcggcgacatggtcaaccagtccttcatctgtgatccagatgacgaaaccttcataaaaaacatcataatccaggattgtatgtggtcaggattctctgccgccgcaaagctggtgtcagagaaacttgctagctatcaggctgccagaaaggactctgggtctccaaacccggcccgaggtcatagcgtgtgttccacaagttcactgtatctccaagatctgtccgccgcggcgagcgagtgcattgacccatcagtagtgttcccctaccctctgaacgactcctcatccccgaagagctgtgctagtcaagactcctcagcgttcagccctagttcagatagtctgctctctagtacagagtcaagcccgcagggtagtccggagcccttggtgcttcacgaggagacacccccaacaacatcctctgacagtggtggtacaagaaggtag

SEQ ID NO: 4148 - DNA, 1365 bp, Artificial Sequence
  Description of Artificial Sequence: Synthetic coding sequence
ctggacttcttccgggtggtggagaaccagcagccccccgccaccatgccgctgaatgtgtccttcaccaacagaaactacgatctggactatgactccgtgcaaccctacttttactgcgatgaggaagaaaatttctaccagcaacagcaacaaagcgagctacaaccaccagccccatcagaagatatctggaagaagttcgagctgctccccaccccacctttgagcccttctaggcggtctggcttgtgctcaccaagctatgtcgcagtcacccctttttctctgcgaggagataacgatggcgggggaggctcgttcagtaccgccgaccaattagaaatggtgacagagttactggggggggatatggtcaaccagagctttatatgtgatcctgatgacgagaccttcataaagaacatcattatccaggattgtatgtggtccggcttctccgctgcagctaaactagtgtctgagaaactcgcatcttaccaggctgcccggaaggattcaggatcacctaacccagccagaggccactcagtatgcagtacatcaagcctctaccttcaggacctctctgcagccgcatctgaatgtatcgacccgagcgtggttttcccttacccacttaacgatagctccagtcctaagtcatgcgcctcgcaggactccagcgctttttccccgtcctctgacagcctcctgagtagtacagaatccagcccacaaggcagtcccgagcctctggtattacacgaggaaactcctccgactacctcaagcgattctgaggaagagcaggaagatgaagaggagattgacgtggtgagcgtggaaaagaggcaagcccctgggaagcggagcgagagcggatcaccttcagcagggggccactccaaaccaccccactctccgttggtgctgaagcgctgccacgtgagcacgcaccaacacaactatgccgccccaccctccacgcgaaaagattatccagccgccaagcgggtgaagctggactccgtaagagttctgaggcaaatctccaacaaccgtaagtgtacaagccccaggagcagcgacacagaggagaacgtgaagcgcagaactcacaatgtgctggagcgacagagaaggaacgaactgaaacgctcattcttcgcccttcgcgatcagatcccagaattagaaaacaatgaaaaggctcctaaagtagtgatcctcaaaaaggcgacagcctatatcttgagtgtgcaggccgaagagcagaaattgatatctgaggaggacctgttaaggaagcggagagagcaactgaagcacaaactggagcaattacgcaactcctgcgcatag

SEQ ID NO: 4149 - DNA, 1263 bp, Artificial Sequence
  Description of Artificial Sequence: Synthetic coding sequence
atgcccctgaacgtgagcttcaccaaccggaactacgacctggactacgattctgtccagccttacttctattgtgatgaggaggatatctggaagaaattcgagctgctgcctacaccccctctctctccgtcacgccgttcagggctctgcagccccagctacgtggcagtcactcccttctctctccggggagacaatgatggagggggcggcagcttcagcaccgcggatcagctcgagatggttaccgaactcctcggaggtgatatggtgaaccagtcgttcatttgcgatcccgatgacgaaacattcattaaaaacattatcatccaggattgtatgtggagtgggttcagtgcggctgctaaattggtctctgagaaactcgcctcttaccaggcagcacgcaaggactctggaagccctaatcccgctcggggccacagtgtgtgcagcacctcttctctatatttgcaagatctgtcagctgctgccagcgagtgtattgaccctagtgtggtgttcccctacccactgaacgactccagctcccctaaatcctgtgcctcacaggacagctccgcgttctcccctagcagcgactctttgttgtcctctacagaaagcagcccccaaggcagtcctgagcccctggttctacacgaggagaccccccccacaacttcttccgacagcgaagaagaacaggaagatgaggaggagatagacgtcgtgagtgtagaaaagcggcaggcgccgggaaagaggtcagaatccgggagcccctccgcgggtggccactcaaaacctccccattctcccctggttcttaagaggtgccacgtctcgacacatcagcacaattacgctgcaccacctagtacccgcaaagattacccagccgccaaacgagttaagctggactccgtgcgagtgcttcggcagatctcgaataaccggaagtgtacttccccgagatctagtgatactgaggaaaatgtcaagagaaggacacataatgtgctcgagagacagcgtagaaatgaactgaaaagatccttctttgctttaagggaccagatcccagagctcgagaacaacgagaaggctcccaaagtggttatcctcaagaaggccaccgcttacattttgtcagtgcaggccgaagagcaaaagttgatttccgaggaagacctgctgcgtaagagaagagagcagctgaaacacaaactcgaacaacttcgaaacagttgcgcttag

SEQ ID NO: 4150 - DNA, 1362 bp, Artificial Sequence
  Description of Artificial Sequence: Synthetic coding sequence
ctggacttcttccgggtggtggagaaccagccccccgccaccatgcctctgaatgtgtcctttacaaaccgcaactatgatctggattatgattcggtgcagccctacttttactgtgacgaggaggagaacttttaccagcagcagcagcagtccgaactgcagccccctgctccctctgaggacatttggaaaaaattcgaactgctcccaaccccccccctctctccttcacgaaggtctggactgtgcagtccttcttatgttgctgtaactccattttcactccgaggcgacaacgacggaggcggtggtagttttagcacagcggatcagctggaaatggtgactgaattgctgggcggcgacatggtgaaccagagttttatctgcgatccagacgatgaaacctttattaaaaatatcatcatccaagactgcatgtggtctggcttcagcgccgccgcgaaactagtttcagagaagttagcgtcttaccaagccgcgaggaaggattccgggtcaccaaaccctgcccgcggacactccgtctgtagcacaagtagtttgtacctccaggatctgtctgccgccgcgagcgagtgtatcgatccatctgtggtgtttccttaccctctcaatgatagtagtagccccaaatcctgcgccagtcaggattcaagcgcattttctccatcctcagactcactcctgagttcgacggaaagctccccgcagggaagtcctgagcctctggtcctgcacgaagagacacccccaactacgagctctgacagtgaggaagagcaagaggacgaggaagagattgatgtggtgtcagtcgagaagaggcaggccccaggcaagaggtcagagtcagggagtcctagcgcaggaggtcattccaagccaccccactctccgcttgtactcaagagatgccatgtttctacacaccagcataattacgccgcccctccctccacgcggaaagattaccccgccgcaaaacgcgtcaagctcgattcagtaagagtcctccggcagattagtaataacagaaaatgcacctcgccacgatcctctgacactgaagaaaacgtaaaaagacgcacgcacaatgtcctggaacgacagcgacgtaacgagctgaaacggtcgttttttgcattgagagaccaaatccctgagctcgagaataacgaaaaggcccccaaagtcgttattctcaagaaggctaccgcttatatcctgtccgtgcaagcagaagaacaaaagttaatttctgaggaggatctcctccgtaagaggagagaacagttgaagcacaagcttgagcagctgcggaactcatgcgcatag

SEQ ID NO: 4151 - DNA, 8442 bp, Artificial Sequence
  Description of Artificial Sequence: Synthetic coding sequence
atgatccccgcccggttcgccggcgtgctgctggccctggccctgatactgcctgggaccttgtgcgccgaggggacacgggggcggagctcaaccgcacgctgcagccttttcggctcagacttcgtcaataccttcgacggcagcatgtatagcttcgctggctattgctcttacttgttggctggcggctgtcagaagcgttccttctccatcatcggagactttcagaacgggaaacgggtcagtttgtctgtgtaccttggcgagttctttgacattcatttatttgtgaacgggaccgttacacaaggagaccaacgtgtgtcgatgccgtacgcaagcaagggtctgtacctcgagacagaggcaggatattataaactcagcggagaggcatacggcttcgtagctcgcatagatggttcgggtaacttccaggttctgctatccgacaggtattttaataagacttgtggattgtgtggaaatttcaatatcttcgcggaggatgactttatgacgcaagagggcaccctgacctctgacccctacgactttgccaattcgtgggctttatcctctggtgagcagtggtgtgaacgcgccagccccccttctagctcatgtaacattagctctggagagatgcagaagggattgtgggaacagtgtcagctgttaaagtctacgtccgtctttgcaaggtgtcacccactcgtggatcccgaacctttcgtggctctgtgtgaaaaaaccctgtgcgagtgcgccgggggacttgaatgcgcctgcccagctctgctggagtacgcaaggacttgcgcccaagagggaatggtcttgtatggttggaccgatcattccgcctgttcccctgtgtgcccagctggcatggagtacaggcaatgtgtgagcccgtgtgcacgaacttgccagagtctgcacatcaacgaaatgtgtcaagagaggtgtgtcgacgggtgttcttgcccagaggggcaactccttgatgagggcctttgtgtagagagtactgagtgcccttgcgttcatagcgggaaacgctatccccctggtacttccctctcaagggactgcaacacatgcatatgtcggaactcacagtggatttgtagtaatgaggagtgccctggagaatgtctggtgacagggcagtcccactttaagagtttcgacaaccggtacttcacattctctggcatatgccagtatttactggctcgcgattgccaggaccatagtttcagtatcgtgatagaaaccgtgcaatgcgccgacgaccgggatgcggtgtgtactaggtcggttacagtcagattgcctggcctgcacaattctctggtgaaattaaagcacggtgctggggttgccatggatgggcaggacgtgcagttgcccctgctgaaaggggacctcaggatccagcacacagtgaccgcttctgtcaggctctcctatggagaggacctgcagatggactgggatggccgggggcggcttcttgttaagctttctccagtgtatgctggcaagacgtgtgggctgtgtggtaactacaatggaaaccaaggggatgacttcttaactccttcaggtttggccgagcctcgagtggaagacttcggcaacgcttggaaactgcatggagactgtcaagaccttcagaagcagcactcagatccatgcgcattgaacccgcggatgacacgcttctctgaggaggcctgtgccgtcctaaccagtcccacgtttgaggcttgccatcgggctgtcagcccgctgccttacttgcggaactgcaggtatgacgtatgctcatgcagcgatggacgagagtgcctgtgcggcgcactcgcaagttatgcagcagcttgtgcaggccggggcgtgagagtcgcctggcgcgagcctggaaggtgtgaactaaactgcccaaagggccaagtgtacctgcaatgcggaaccccctgtaatctcacttgtcggtcactctcatacccagatgaagagtgcaacgaagcctgtctggaaggatgtttctgccctcctggactgtacatggatgagcgtggcgactgcgtgcctaaagcacagtgtccctgctattacgacggtgaaattttccaacccgaggacatcttttcggaccaccataccatgtgttattgcgaagatgggttcatgcattgcacaatgtccggagtgcccggcagccttctccccgacgccgtgctttcgtcacctctcagccacagatctaagagatccctgtcctgcagacctcccatggttaagttggtatgcccggccgataacctgcgggcggaaggactcgagtgcacaaaaacttgccaaaactacgatttggaatgcatgtcaatgggatgtgtgtctggatgcctgtgcccgcccggaatggtccgccacgaaaaccgttgcgtggcactcgagcgatgcccgtgtttccaccaagggaaagagtatgcccctggtgaaacagttaagataggctgtaacacttgtgtttgtcaggatcgtaagtggaactgtacagaccatgtttgcgatgccacctgttccacgatcggtatggcccattatctcactttcgatgggctcaagtatctgtttccaggggagtgtcaatatgtgttggtccaggattattgcggatcaaaccccgggaccttccgcatattagtagggaataaggggtgcagccatccaagcgtaaagtgtaagaaacgagttaccatacttgtggaaggtggagaaatagagctcttcgacggcgaggtaaacgtaaagcggcctatgaaggatgagacacatttcgaagtggtggagagcggccgttacattattctcctgctgggaaaggccttgtccgtagtgtgggacagacatttgtctataagtgtcgttctgaagcagacctaccaggagaaggtgtgcggactgtgcggcaacttcgatgggatacagaataacgatctaacctcgtccaatctccaggtggaggaagatcccgtggattttggcaatagttggaaagtttcatcccagtgcgcagatacccgtaaagtgcctctggacagcagtcctgccacctgccataataacataatgaagcagacaatggtggacagcagctgtcgtattcttacttccgacgtgtttcaggactgtaataagcttgtggatcctgagccgtacttagatgtttgtatctacgacacatgttcttgcgagagcattggtgactgcgcctgcttttgcgacacaatcgccgcctacgcccacgtgtgtgcccaacatggtaaggtggttacctggcgtacggctacactgtgtccccagagctgcgaggagcgcaaccttagggaaaacgggtatgagtgtgaatggcgctataattcctgcgccccagcttgtcaggttacatgtcagcatcccgaacctttagcatgtcctgtgcagtgcgtggagggctgccacgcacactgcccacctggtaaaattctggacgaactcctccagacctgcgtggacccggaggactgccctgtatgtgaagtggccggaagaagattcgccagtggtaaaaaagtcactctgaatcccagcgatccagaacattgccaaatctgtcattgcgacgttgtaaatctcacttgtgaagcgtgtcaggaacctgggggcctcgtggtgccacctaccgacgctcctgtgtcgcccaccacactctatgtagaggacatctcagaaccacccctgcacgacttctactgctcccgcctactggatctggtctttctcctggacggcagtagccggcttagcgaggcagaatttgaagtactaaaggcattcgtggtcgatatgatggaacgtctcaggatctctcaaaaatgggtgcgggtggcggtcgttgagtaccatgatgggtctcacgcttatataggcttaaaagaccgaaagcgccccagtgaactgcggcgaatagcttctcaggttaagtacgctggctcccaagtagcaagtacatccgaggtgctaaagtacacgctattccagatcttctccaaaatcgatagacccgaggcaagccgaattacacttctgctcatggcttcccaggaaccccagcgcatgtccagaaactttgtgcgctatgtgcagggcttaaaaaagaagaaagtgattgtaatccctgtggggatcgggcctcacgccaacctgaaacagatccgcttgattgaaaagcaagcccctgagaataaggcatttgtgctctcatccgtggacgagctggagcagcaacgggacgaaattgtgagctacctctgcgacctggccccagaggctccaccgcctacactccccccagatatggcccaggttactgtggggcctgggcttctgggggtatctacgctgggacctaagcgaaatagcatggtcttggacgtggccttcgttctagaagggtcggacaagatcggagaggccgattttaatcgcagtaaggaatttatggaggaagttatacaacgaatggacgttgggcaggattcgattcatgtgacagtattacagtatagttacatggttaccgtagagtatccatttagtgaagctcagtcaaagggggacattctgcagcgggtaagggagatccggtaccagggaggaaataggactaatactggactggctttgcgttatctgtccgatcacagcttcctggtaagccagggagatcgcgaacaggcacctaatctggtatatatggttaccgggaatcccgcctccgacgagatcaaacgtctcccgggcgacatccaggtggtccctataggtgtcgggccaaacgcgaatgtacaagagctggagcggatcggttggcctaacgccccgattctcatccaggacttcgagacactgccacgggaagcacctgatcttgtcctccagcgctgctgtagtggcgaaggcctgcagatacctactctgtcacctgccccagattgctcccaacccctggacgtaattcttctcctggacggaagctcctccttccccgccagttacttcgatgaaatgaagtcctttgcaaaggcatttatttctaaagccaacattggcccgaggttaacccaggtgagcgtccttcaatacggatccattaccacaatcgacgtcccttggaatgtggtgccagaaaaagcgcatctgctctctctcgtcgatgtaatgcagagggagggcggcccctctcagattggcgacgctctgggatttgctgtgaggtacctgacatctgagatgcatggagccaggcccggcgcttctaaggccgtcgtgatcctcgtgacagatgtaagtgttgactctgtggatgctgccgctgatgccgctcggagcaatagagtaacagtctttccgatcggtataggagatagatacgatgctgcccagctgagaattcttgcggggcccgccggggattctaatgtggttaagctgcagcgcatcgaggatctacccactatggtgaccctgggcaacagcttcttgcataagctgtgtagcggctttgtgcgcatatgcatggacgaggatggcaacgagaagcgccctggcgatgtctggacgctgccggatcagtgccacaccgtcacatgtcaaccagacggtcaaacacttctgaaatcacatcgggtgaactgtgaccgaggactgcgtccctcctgccctaattcccagtcgccggtgaaggtggaggagacctgtggttgccgctggacatgtccctgcgtctgcaccggatcctcaactcggcatatcgtgacatttgatggtcagaacttcaaactgacagggagctgttcatacgtcctctttcaaaacaaagagcaggatctggaagtgattctccataacggtgcatgttcacctggggcccggcagggctgtatgaagagcattgaagtgaagcattccgctctatcagtcgagttgcactctgatatggaagttaccgttaacggtaggctcgtatctgtgccctacgtcggtggaaatatggaggtcaacgtttacggagctatcatgcacgaggtcaggttcaatcatctgggccacatcttcactttcactcctcaaaataacgaatttcagctacagcttagcccgaaaaccttcgcttccaaaacttatgggttgtgcgggatatgcgacgagaatggcgccaatgattttatgttgcgggatggaactgttacaaccgattggaaaacactggtccaggaatggacagtgcaaagacctggacagacttgccagcctatactggaagagcagtgcctggtgccagattcctcacattgccaggtgctgctattgcctcttttcgctgagtgtcacaaggttttggcccccgcgacgttttacgctatctgccaacaagacagttgccaccaagaacaagtctgtgaggtgatcgcctcttacgctcacctgtgtcgaacaaacggggtttgtgtggactggcgcacacctgatttctgcgctatgtcctgccctcccagcctcgtgtacaatcactgtgagcatggatgtccccgtcattgcgacggcaacgtctcatcatgtggagaccacccctcggagggatgcttttgtccgcctgacaaagtgatgctggaggggagttgtgtgccggaggaggcgtgcacccaatgtattggcgaggatggtgtgcagcaccagtttctggaggcctgggtgccagatcaccagccctgccagatctgcacatgtttgtcaggccgcaaggtcaattgcaccacccaaccctgtcccactgccaaagctcccacttgtgggctgtgcgaagtagcccggctccgccagaatgctgaccagtgctgtccagaatatgagtgcgtgtgcgatcctgtcagctgtgatctgccgccagtgcctcactgcgagaggggtctgcagcctaccctgaccaatccaggcgaatgcagaccgaactttacatgtgcctgtcgtaaggaggagtgtaaaagagtgagcccaccatcttgtccacctcatagattacccacattaaggaagacacagtgctgcgacgaatacgaatgcgcctgcaactgcgtgaacagcactgtcagctgtccactgggctacctggccagtactgcaacgaatgattgcggatgcaccacaactacttgcctccccgacaaggtgtgtgttcaccgatcaacgatctatcccgtcggacagttttgggaagaggggtgcgatgtgtgcacttgtaccgatatggaggacgccgtcatggggctcagggtagcccagtgtagccaaaaaccgtgtgaagactcttgtcggagtggattcacttacgtgcttcatgaaggcgaatgctgcggccgttgcttgccttccgcctgcgaagtggtcacgggttctcctcgtggcgattcacaatcttcttggaaaagcgtgggctcgcaatgggcctcaccggaaaacccgtgtttgattaatgaatgtgtaagagtgaaagaggaggtcttcattcaacaaaggaatgtttcctgcccccaactggaggtgcccgtgtgccctagtgggttccagctaagttgcaaaacgagtgcgtgctgcccaagctgtaggtgtgaacgcatggaggcatgtatgttgaatggaacagtgatcggccccggtaaaacagtgatgattgacgtttgcaccacctgccggtgtatggtgcaggtaggcgtgatatccggatttaagctggagtgccgtaagactacgtgcaatccttgcccgttgggatataaagaagaaaataacacaggcgagtgctgtggccgatgtctcccaacagcctgcacaatccagttaagggggggccaaattatgactttgaaacgagacgagaccctgcaagacggctgtgacacccacttctgtaaagttaatgaaagaggggagtacttttgggagaagcgtgtaacaggctgtccaccatttgatgagcacaaatgtcttgctgaaggtgggaaaataatgaagataccagggacctgttgcgacacctgcgaggagccggaatgtaatgacataaccgcgcgccttcagtatgtcaaagtgggctcttgtaaatccgaggtagaggtggatatccactattgtcagggcaaatgtgctagcaaggcgatgtacagcatcgatatcaatgatgtccaagatcagtgctcttgttgttcacccaccaggaccgagcccatgcaggtcgccctgcattgcacaaatggtagcgtcgtataccatgaggtgttaaacgctatggaatgtaagtgcagcccccgcaagtgctctaagtag

SEQ ID NO: 4152 - DNA, 816 bp, Artificial Sequence
  Description of Artificial Sequence: Synthetic coding sequence
atgaccgagccccaggtgggctgcgtggcctgcccccgggtgcacaaggaaccagcccaggtgggtaccccgtggcctgccaaaccacgttcccatccaaggaaaagagatccaaccgcactgcttcctcggtcactgtggcccgcatgtcaggaatcagttacagcattatgtttccttcaggagaccgtcgagcgcctgggtcagtctcctgctcaggacactccagtgctgggaccctgctgggatcctatggcactcgggacccaaggtagattgctgctggacagggatagcaaggacactcagactaggatcagtcagaagggccgcaggctccagccaccagggactccctccgctccgccccagcgcagacctcgcaaacaactcaatccttgccggggaacagaaagggtggacccggggtttgagggggtcaccctaaagttccagataaaacccgacagttccctccaaataattcccacctactcactaccttgcagctcccggagccaggagtccccagcagatgcagtgggaggtcctgccgcgcacccgggaggcaccgaagcccactcggccggttcagaggccctcgaacccaggcggtgtgcttcatgccgcacacagagaaccccactttggcgtgatgctgaggatggcactccgctctgcaatgcctgcgggatcagatataagaaatacggtactagatgcagctcctgctggctcgtcccgcggaagaatgtacagcccaaacggctgtgtggcaggtgcggtgtgagtctcgatccaatccaggagggttag

SEQ ID NO: 4153 - DNA, 1182 bp, Artificial Sequence
  Description of Artificial Sequence: Synthetic coding sequence
atgaccacatattctgacaaaggagccaagccagagaggggacgtttcttacacttccatagcgtcactttctgggtcggcaacgcgaagcaggcgacgtcgttctattgttctaagatgggttttgaaccactggcatacagaggcctggagacaggttcgcgtgaagtggtgtcccatgtgattaagcagggtaagattgtgtttgtgctctcaagtgccttaaatccctggaacaaggagatgggtgaccatcttgtaaagcatggggatggggttaaagatatagcgttcgaagtagaggattgcgactacatagtgcagaaggctagagagcgcggagctaaaatcatgcgcgagccatgggtggagcaggacaagttcggaaaggtgaagttcgcggtgctacaaacatacggcgatacaacacacacactggtggagaaaatgaattacattggtcagtttctgcccggatacgaggccccagcttttatggaccccctactgccaaagcttccaaaatgctccctagaaatgatcgatcacattgttggcaaccagcccgaccaggagatggtcagcgcctctgagtggtatttaaagaacctccaattccatagattttggtcggtcgatgatacgcaggtgcacactgagtacagctcactccggagcattgtcgttgctaactacgaggagtctatcaagatgccgatcaacgagccagcccctggcaagaagaagagccagatccaggaatacgtagattacaacgggggtgctggtgtgcagcacattgccctcaagactgaggacatcatcactgctataaggcacctgcgggagcgaggacttgaattcctgtccgtcccgagcacctactacaaacagctcagagaaaagctgaaaacagcaaagattaaggtaaaggagaatatcgacgccctggaagagttaaagatcttggttgactatgatgaaaaggggtatctactccagattttcactaaacctgtccaggataggcctactctgtttcttgaggtcatccagcgacataatcaccaagggttcggagctggcaacttcaactccctgttcaaggccttcgaagaggaacagaacctaagaggtaatctgaccaacatggaaaccaacggggtggtaccgggaatgtag

SEQ ID NO: 4154 - DNA, 1065 bp, Artificial Sequence
  Description of Artificial Sequence: Synthetic coding sequence
atggggtttgaacccctcgcgtacaggggactggaaacaggcagtcgcgaggttgtgtcacatgtgataaagcagggtaagattgtattcgtgttaagcagcgctctcaatccctggaacaaagagatgggggatcatctggtaaagcatggtgatggtgtcaaagatattgcttttgaggtggaagactgcgactatatcgtgcaaaaagccagggagcgcggtgcaaaaataatgcgcgagccatgggttgaacaggacaaattcggaaaggtgaagtttgctgtccttcaaacctacggcgacacgacccataccctcgtagagaaaatgaactacatcggacagttcctgccagggtacgaggctccagcctttatggatcctctcctcccaaaacttcccaagtgttcgctcgagatgatcgaccatattgtggggaaccaaccagaccaggagatggtgtccgcgtccgaatggtacctgaaaaatctacagttccaccgtttttggagcgtggacgatacgcaggtccatactgagtattccagcctcagaagtatcgtagttgcaaattacgaagaatccatcaaaatgcctattaatgaacctgccccaggcaaaaaaaagagccagattcaggagtatgtggactacaatgggggagcaggggtccagcatattgcgctcaaaacagaagatataattacggccatccggcacctgcgcgagcggggactggaattcctaagcgtgccttccacctattacaagcagctgcgagaaaaacttaagactgcgaagattaaggtgaaggagaacatcgacgcattggaagaactcaagatcctagtcgactatgacgagaaaggctatcttctgcagatttttactaagccagttcaagacagaccaacactgtttttggaggtaatccagcgtcataatcatcagggattcggcgcagggaatttcaattccctgttcaaggcttttgaggaggaacaaaatctgcggggaaacttgaccaacatggaaaccaacggcgtggtgcccggtatgtag

SEQ ID NO: 4155 - DNA, 1173 bp, Artificial Sequence
  Description of Artificial Sequence: Synthetic coding sequence
tactctgataaaggggcaaaaccagagcgcggaagattcctccactttcactctgttaccttctgggtgggtaacgccaaacaagccacctctttttactgctccaagatgggtttcgaacctctagcctaccgcggtctagaaacagggtcgcgcgaagtggtgtcacatgtcattaaacagggaaagatcgtatttgtgctgagcagcgcacttaatccctggaataaagagatgggcgaccatttggtgaagcatggagacggtgtcaaagatatcgccttcgaagtggaggactgcgattatatagttcagaaggcgagagagcgcggagctaaaatcatgagggagccctgggtggagcaggacaagtttgggaaagtgaagttcgctgtactgcagacctatggcgatacaacgcatactctggttgaaaaaatgaattacatcgggcaatttctgcctggctacgaggcccctgccttcatggacccactgctccccaaactacccaagtgctctctggagatgatcgaccatattgtcggtaaccagcccgaccaggagatggtgtctgcgtctgagtggtatttaaagaatcttcagttccacagattctggtctgtcgacgatacccaggtgcacaccgaatacagttctctgagatccatcgttgtagctaactacgaagaatccataaaaatgcccatcaacgagcctgctcctggcaaaaagaagagtcagatccaggaatatgtggactataatggaggagcgggagtgcagcacatagctctgaagacggaggatattattactgcaattcgacacctcagggaacggggactggagtttctttccgttccgtccacatactataagcagctgagggagaaattgaagaccgccaagatcaaggttaaggagaacattgacgccctagaagaattgaaaatcttggtggattatgatgaaaagggctacctgcttcagatattcaccaagcccgtgcaggatcgacctactttgttcttggaggttattcaacgacacaaccaccagggatttggcgctggcaacttcaattcactgttcaaggctttcgaagaagaacagaaccttagggggaacctgacaaacatggaaaccaacggtgtagttccaggcatgtag

SEQ ID NO: 4156 - DNA, 438 bp, Artificial Sequence
  Description of Artificial Sequence: Synthetic coding sequence
atgagcaccgagggaggtggtagaagatgccaggcccaagttagccggcgaatttcctttagcgcgtcacaccgcctgtattccaaatttctcagcgacgaggaaaatctcaaattgttcggaaaatgtaataacccaaacgggcatgggcacaattataaggtggtcgtaactgtccacggagagattgaccctgcaacaggcatggtgatgaacctggccgatctgaaaaaatatatggaggaggcaatcatgcagcctttggaccacaaaaatcttgacatggatgtgccctatttcgctgatgtcgttagcaccaccgaaaacgtagccgtatacatttgggacaatctccagaaagtgttaccggtgggagttctgtacaaggtgaaggtgtatgaaactgataacaacatcgtggtatacaagggcgagtag

SEQ ID NO: 4157 - DNA, 4284 bp, Artificial Sequence
  Description of Artificial Sequence: Synthetic coding sequence
atgcatcagaggcaccctcgcgcaaggtgtcctccactgtgcgtggctggcattctggcttgcggatttctcttaggatgctggggacctagccacttccaacagtcatgtctgcaggcccttgagccccaggccgtatccagctacctgtcccccggtgcaccgctgaaaggacggcctccctctcctggattccagagacagcgccaacggcagcggagagccgctggcggaatcctccatctcgagctgctggtggcagtgggtccagacgtgtttcaggcgcatcaggaagataccgagaggtatgtgttgaccaacctgaatattggcgctgagctgctcagggatccttctttgggggctcagtttcgagttcatctcgtgaagatggttattctcactgagcctgagggagcacctaatataacagccaatttgacatcttcgctgcttagcgtgtgcggctggtcacagaccattaatccggaagacgataccgatccaggccatgcagatctggtactttacatcacacggtttgacttggagctgccggatggtaacagacaagtaagaggcgtgacccaactcggcggagcgtgttctcccacctggtcctgtctgattacagaagacactggcttcgatctgggagttaccatagcacacgagatcggccattccttcggcctggaacatgatggagctccaggttctggttgcggaccctcgggacacgtaatggcttctgacggtgcggcacccagggcgggtctcgcatggtccccttgttcacggagacagctccttagcttactgagcgctggcagggccaggtgcgtgtgggatccccctcgacctcagccaggcagtgcaggtcatcctcctgacgcccagccagggctttactattctgccaatgaacagtgtcgagtggctttcgggccaaaagccgtggcttgcaccttcgccagggagcacctggacatgtgtcaagctctgtcctgccacacggatccgctggaccaatcgagctgtagccgactgctggtcccactgctcgacggcactgagtgtggcgtcgaaaagtggtgcagcaaaggaaggtgcaggagtctcgttgaactgacgccaattgctgctgttcacggcagatggtccagttggggcccacggtcgccttgctctcgttcttgcggcggaggggtcgtaactagacgtaggcagtgcaacaacccaagacccgcttttggcggacgcgcttgcgttggggctgacctgcaggcagagatgtgcaacactcaggcgtgcgagaagacccagctggagttcatgtcccagcagtgtgcgcgaacggatggtcagcctctccgtagctccccaggcggagcctcattttaccactggggtgccgctgtgccccactctcagggagatgctttgtgtaggcatatgtgtcgggctatcggtgaatcatttataatgaaaaggggtgacagtttcctggatggcacgcggtgcatgcctagtgggcctcgagaagatggcactctgtcactttgcgtaagtggctcttgccggacctttgggtgcgatggtcgcatggactctcaacaggtgtgggatagatgccaggtatgtggaggcgataattccacttgctcccctcggaaaggctccttcacagccggtagagcacgcgagtacgttactttccttacagttaccccgaatctcacttctgtgtatattgccaatcacagacctctcttcacccaccttgcggtgagaatcggcggtagatacgtcgtggcagggaaaatgtctattagccccaatacaacatacccatctttgctggaggatggcagagtggagtaccgggtggcattaacagaagaccggctgccacgactcgaggaaatacggatttgggggccactgcaggaggatgccgatatccaggtctatcggagatacggtgaggaatacgggaatctcacccgccctgatattacgtttacctattttcagcccaagccacggcaggcctgggtctgggccgcagtgagaggtccttgttctgtctcctgtggcgcaggattgaggtgggtcaactattcatgccttgatcaggccaggaaggagctcgtcgagacagtgcagtgtcaaggcagccagcagccacccgcatggccagaggcgtgcgtgcttgagccctgccccccatattgggcagtcggggactttggcccttgttccgcaagttgcggaggcggtctacgagaaagacctgtgcgatgcgttgaagcacaggggagtctgcttaaaacacttcctcctgcccgttgcagagctggagcacagcaacccgctgtagcactcgagacctgcaatccacagccatgccctgcccgatgggaggttagcgaacctagttcttgtacctcagcagggggtgcaggcctggcactggagaacgagacatgtgttcctggcgctgatggtctcgaagcccctgtcaccgaggggccagggtcagtggacgagaaactgccagcccctgagccatgtgtgggcatgtcgtgtcccccaggatggggccatcttgatgcaaccagcgccggagaaaaggcacccagtccatggggatccattaggacaggggctcaagccgctcatgtgtggacacccgcagccggaagctgctccgtcagctgcggtcgcggactcatggagctgaggttcctgtgtatggatagcgccctgagggtgccggtgcaggaagagttatgcggcttggcttcgaaacctggaagtcgcagggaggtctgccaggcagtgccttgcccagcccgttggcagtacaagctggccgcatgttcagtgtcatgtggcagaggagtagttcgaagaatcctgtattgcgccagagcccacggggaggacgatggcgaagaaatcctgctcgatacacagtgccagggacttcctagacccgagccgcaggaagcatgttccttggaaccttgtccaccacgctggaaggtgatgagtcttggcccatgcagcgccagttgtggtctgggcactgctagacgcagcgtggcttgcgttcaactggaccagggtcaggatgtggaggtcgacgaggctgcgtgtgctgctcttgtgcgcccagaggcctcggtgccatgtctgatcgccgactgtacctatcggtggcatgtcggcacttggatggaatgcagcgttagctgcggcgatggcattcaacggaggcgcgacacatgccttggccctcaagctcaggcgccagtgcctgcggacttctgccagcacctgcccaaacccgtcaccgtgcgcggatgctgggctggaccatgcgtgggtcaaggaactccttcccttgtgccccacgaggaagctgcagctcctggcagaaccacagctactcccgcaggggcaagcctcgagtggtctcaagctcgcggtctgttattttccccagcccctcagcccagacgcctactgcctggaccacaggagaattccgtgcaaagtagtgcctgcggtaggcagcacttggagcccacggggactattgacatgagggggcctggacaggcagattgcgccgttgctatcgggaggcctctgggagaagttgtaaccctgagggtgttggaatcctctttgaattgcagtgccggtgacatgcttctgctttggggccgactaacttggcggaagatgtgcaggaagttgcttgacatgacattctcttcaaagacgaacaccctggtggtgaggcaacgatgtggcaggcccggaggaggggtcctgctgcggtatgggagtcagctggcccctgagactttttatagagagtgtgatatgcaactgttcggaccttggggcgagatcgtgtctcccagcctcagtcctgccactagtaatgctggtggttgtaggctattcatcaacgtcgcccctcatgccagaattgccatccacgcactagcaacgaacatgggtgcagggaccgaaggcgctaacgcctcctatattcttatcagagatactcactctcttagaaccacagctttccatggccagcaggtactgtactgggagagcgagtcttcgcaagctgagatggagttttctgaaggtttcctcaaggcccaggctagcctgcggggacagtattggacacttcagtcttgggtcccggaaatgcaagacccgcagtcgtggaaggggaaggaagggacatag

SEQ ID NO: 4158 - DNA, 3309 bp, Artificial Sequence
  Description of Artificial Sequence: Synthetic coding sequence
atgtttcaactgcccgtcaataacctgggtagccttaggaaagcacgaaaaaccgttaagaagattctctccgacattggactagagtattgtaaagaacatattgaggacttcaagcaattcgagccaaacgacttttatttaaagaacacaacatgggaagacgtgggactgtgggatcccagccttaccaagaaccaggactaccgaactaagccgttttgttgtagcgcctgtcccttctcctctaaattcttctctgcctataagtcccactttcgaaacgtccacagtgaagattttgagaatcgaattctgctcaattgcccctactgcacatttaatgccgataaaaaaaccttggaaacacacatcaaaatttttcacgcccctaacgccagcgcacccagtagttccctgagtacatttaaagataagaacaaaaatgatggactcaaacccaaacaagccgatagcgtggagcaggctgtgtactattgcaagaaatgtacctacagagatccgttgtacgagattgtcagaaagcacatctatcgcgaacacttccagcacgtagcagccccatacatcgccaaggcgggagagaagtctcttaacggtgctgtgcccctggggtccaacgcccgagaggagtccagcatccactgtaagagatgccttttcatgcccaaatcttatgaagccctggtgcagcatgtcatcgaggaccatgagcgcatcggctaccaggttaccgctatgattggacataccaacgtagtggtgccaaggtcaaagcctctgatgcttatagcacctaaaccgcaagataaaaaatccatgggcttgccccctcggattggcagtctcgccagtgggaatgtgagaagcctgccaagccagcaaatggttaataggttgtccataccgaaaccaaatctgaattctactggcgtgaacatgatgagtagcgtgcatcttcaacagaataactatggagtgaagtctgttggtcaaggctatagtgtagggcagtccatgagactgggactggggggtaatgcccctgtctcaatcccccagcagtcccaaagcgtgaagcagctgctcccgtccgggaatggcaggagctacggtctgggctccgaacaacgatcacaggctccagcgaggtactcactgcagagtgcaaatgcaagcagcctcagcagcggacagctcaagagcccaagtctgagtcagtcccaggcatcccgggtcctggggcagagttcctcgaagcctgccgctgcggctacaggccctcctccagggaacactagtagcacccagaagtggaagatttgcacaatctgcaacgagctgtttcctgagaatgtatacagcgtacactttgagaaggaacacaaggctgaaaaagttccggctgtggcaaattatattatgaaaatccacaacttcacatcaaaatgtctgtattgtaatagatatctgcccactgatactctcctaaatcacatgttgatccatggcctgagttgtccctactgtcggagcaccttcaatgatgtggaaaagatggcagctcacatgcgaatggtgcatatcgatgaggagatgggaccgaagactgactctaccctttctttcgacctgactttgcagcaagggtcccataccaatattcaccttcttgtgacaacctacaaccttcgcgacgctcccgctgagagcgtggcatatcatgcacagaacaatccaccagtgccacctaagccccagcctaaagttcaagagaaggcagacattcccgtcaagtctagcccacaggctgcggtcccttacaagaaggatgtcggaaagacgctctgccccctgtgttttagtatcctgaaagggccaattagcgatgcattagcccaccatctccgggaacgtcatcaggtgattcaaacggtccacccagtggagaaaaaactcacatataagtgtatacactgccttggagtgtatacaagcaatatgaccgctagcaccatcacactccatttggtccattgtaggggggtagggaaaacacagaacggacaggacaagaccaacgctcccagccggctcaaccagagcccttccctggcacctgtgaaacgaacatacgagcagatggaatttccactcctgaagaagcgcaaattagacgacgatagcgatagcccctcattcttcgaggagaaacctgaagaaccagtcgtgctggcgctcgacccaaaaggccacgaggacgactcctacgaagccagaaaatcatttcttaccaaatattttaataagcagccttaccccacacgacgggaaattgaaaagctcgctgcttcactatggctctggaagtcagatatcgcttcccatttctcaaacaagagaaaaaaatgtgttcgcgattgtgagaaatacaaacccggagttctgcttgggtttaacatgaaggaattgaacaaggtgaagcatgagatggacttcgatgcagagtggttgtttgagaaccatgatgaaaaagactcccgtgtgaacgcgtccaagaccgccgataaaaaattgaacctgggcaaagaagatgactcctcatccgattctttcgaaaaccttgaggaagaaagtaacgagtctggatcccctttcgatccagtgtttgaggttgagcccaaaatttcaaacgataaccctgaagagcatgtgctcaaagtaatcccagaagatgcaagcgagtccgaagaaaaactggatcaaaaagaggatggctccaagtacgagacaatccatctgacggaggaaccaaccaagctgatgcacaacgcctctgacagcgaagtagaccaggacgacgtggtggaatggaaagatggagcaagccctagcgaaagcgggccaggatcacaacaggtgtccgatttcgaagacaatacatgcgagatgaagccaggaacatggagcgatgaatcttctcaaagcgaagacgctcggagctccaagcccgcagccaaaaaaaaagcgactatgcaaggtgatagagagcagttgaagtggaagaacagctcttatggcaaggtagaagggttttggtccaaggatcaatcccagtggaaaaacgcctcagaaaatgacgaacgcctatctaaccctcagattgagtggcaaaactctaccattgacagcgaagacggagagcagttcgataacatgactgatggcgttgctgagcctatgcacgggagcttggccggagtgaagctctctagccagcaagcttag

SEQ ID NO: 4159 - DNA, 3309 bp, Artificial Sequence
  Description of Artificial Sequence: Synthetic coding sequence
atgttccagctcccagtcaataacttaggcagcctgcgcaaagcacggaagaccgttaagaaaattctgagcgatataggcctggagtattgcaaagagcatattgaagatttcaaacagttcgaacccaacgatttttacctgaagaacactacttgggaagatgtggggttgtgggatccctccctcacaaaaaatcaggactataggaccaaaccattttgttgcagcgcatgtccttttagttctaagttcttctccgcttacaaaagtcactttcgcaacgtgcattcggaagatttcgaaaaccgcattttgctaaactgcccctactgtacgttcaatgccgacaagaagacgctcgaaactcatatcaaaatctttcatgccccaaatgcatccgcgccatcttcatctctgtctaccttcaaagataaaaataaaaacgatggcctgaagccaaagcaggcagacagcgtggagcaggccgtgtactactgcaaaaagtgtacttatcgtgatccgctatatgaaatcgttagaaagcatatctatcgcgaacacttccagcatgtggcagcgccttatatcgcgaaagccggagagaagtccctgaatggcgcagtgcctctggggtctaacgcacgggaggagagctctattcactgcaagagatgtctcttcatgcctaaatcctatgaagccctcgtccaacacgtaattgaggatcatgagaggatcggttaccaggtgacagccatgatcggacacactaacgtggtggtgcctcgaagtaaacccttgatgctcatcgccccaaagccacaggataagaaaagcatgggcctgcctccaagaatcggatctctcgcttctggcaatgtaagaagcctgccatcacagcagatggtgaacaggttatctatccccaagcctaacctgaactccaccggcgtcaacatgatgagcagcgtgcacttacagcagaacaattacggtgtgaaaagcgtgggacagggttactctgtgggccagtctatgcggctggggctgggaggaaacgcccctgtttccatccctcaacagtcacagtcggtcaagcagctgttgcctagcgggaacggtcgatcctacggcctggggtcagaacagcgctctcaggctccagccaggtatagccttcagagcgcaaatgcctctagtctcagttcaggacagttaaagtctccatctctaagtcagagccaggcgagccgagtgctgggtcagtcatcctctaagcccgctgccgcagctaccggcccacccccaggaaatacaagcagcacccaaaagtggaaaatctgtacaatttgtaatgaactgtttcccgagaatgtatatagcgtgcacttcgagaaggaacacaaagccgagaaagtgcccgcagtggctaactatataatgaagatacacaatttcacttcaaagtgcctctattgcaatagatatctcccaaccgacaccctgctgaaccacatgttgatacacggccttagctgcccatattgtcgatcaacctttaacgacgtggagaagatggccgcacacatgcggatggtccatatagacgaggaaatggggcctaagactgattccaccctgagcttcgaccttactcttcaacagggaagccacactaacattcatctgctagtgactacttacaacctgagggacgctccagccgaaagcgttgcctaccacgcccagaacaatccgccagtgccccctaagccccagccgaaagtccaggagaaggctgatattcctgtcaaaagtagtccccaggcagctgtgccgtataaaaaagatgttggaaagaccttgtgtccactttgcttctcgatcctcaagggcccaatttcagatgcactcgcacatcatctgagggagcggcatcaggtgatccagacagtgcaccctgtagagaagaaactgacgtataagtgtatccactgtcttggagtgtacacctcgaatatgaccgcttcaacaatcaccctgcacctggtgcactgcaggggggtcggaaagacgcagaatggacaagataagaccaatgcacccagtcggctgaatcaatcaccatccttagctcccgtcaaaaggacatatgagcagatggagttcccactgctgaagaagcgtaagcttgacgacgactccgacagtcctagttttttcgaggaaaagcctgaagaacccgtggtgctcgccctcgatcctaagggacacgaagacgactcatatgaagctaggaagagcttccttactaaatacttcaacaaacagccttatccaacgcggagagagatcgagaagttggctgcgtccctctggctgtggaagtcagatatcgcttcccacttctctaataaaaggaaaaaatgtgtgcgggactgcgagaagtataagccgggagtactcttaggattcaacatgaaagagctgaataaagtgaaacacgagatggacttcgatgctgagtggctttttgaaaatcatgatgaaaaggattctagagttaacgctagcaaaaccgccgacaagaagctcaacttgggcaaggaggatgatagcagctccgactcatttgaaaatctcgaagaggaatctaacgaaagcggctctccatttgatccggtctttgaggtggagcccaagattagtaacgataaccccgaagaacacgttttaaaagtcattccggaggacgcatcagaaagcgaagagaagcttgatcaaaaagaggatgggtcgaagtacgagaccatacatctgacggaggaaccgacaaagctgatgcataatgcctccgactccgaggtggaccaggacgatgtggtcgaatggaaggacggcgcaagcccatcagagtccgggcctggcagtcagcaggtgtctgactttgaggacaatacttgtgaaatgaagcccggtacctggagtgatgagtcatcacagtcggaagatgctcgctcttcgaaacccgctgccaaaaagaaagccaccatgcagggagacagggaacagctcaagtggaaaaattcaagttatgggaaggttgagggattttggagcaaggatcagtctcaatggaagaatgcgagcgaaaatgacgaaagactatctaacccccagattgaatggcagaacagcaccatcgactctgaggatggggagcaatttgacaacatgacagacggagtggccgagcccatgcacgggagccttgccggtgtgaaattgtcttcccagcaggcatag

SEQ ID NO: 4160 - DNA, 3309 bp, Artificial Sequence
  Description of Artificial Sequence: Synthetic coding sequence
atgtttcaactccccgtgaacaacctgggatcgcttcggaaagccaggaagaccgttaagaagatcctttcagatattggactggaatactgcaaggaacacatcgaggatttcaagcaattcgagccaaatgatttttatctgaagaacaccacctgggaggacgtggggttatgggacccatcactgacaaagaaccaggactatagaacgaagcccttttgttgctctgcctgcccattttcctctaaatttttctccgcctacaagtctcactttcggaatgtccactccgaggacttcgagaacagaatcttgctaaattgcccttattgcacatttaacgcagacaagaaaactctcgagacgcacataaagatcttccacgcccctaacgcatctgcgcctagctcgtctctgtcaacctttaaggataaaaacaaaaacgacggtttaaagcctaagcaggctgattcggttgagcaggccgtgtattactgtaagaaatgcacctacagggacccgctctatgagattgtgaggaagcacatctaccgggaacatttccaacatgtcgctgctccctacattgccaaggccggagagaagagtctaaacggggctgtgcctctagggagtaatgctcgagaggagtcctccattcactgtaagcgatgtttattcatgcccaaatcgtatgaggccctggtgcagcacgtcattgaggatcatgaaagaattggttaccaagtgactgctatgattggacacactaatgttgtagtgcccaggagcaagcccttgatgctgattgcgcctaaaccccaggataaaaaatcaatgggactccctccacggatcggaagtctggcctcagggaatgttcgctccctgccctcacagcagatggtcaataggttgagcataccgaaacccaatcttaattctacaggagttaacatgatgtcaagtgtgcacctgcaacagaataactacggcgtgaagagcgtaggtcaaggctattccgttggccaatcaatgaggcttggtctgggaggcaacgcacctgtgtcgatcccgcagcagtcacagtccgtaaaacaattgctaccctctgggaatggcaggtcctatggactgggtagtgaacagaggagccaggcccctgccagatattctcttcagtcagctaatgccagctccctgtcatctggccaattaaaatcacccagccttagccagtctcaggcttctagagttttggggcaaagttccagtaaacctgcggctgccgcaacaggacctccaccgggtaatacaagcagcactcaaaaatggaagatttgcaccatctgcaatgaactctttcccgagaacgtgtactcggtgcacttcgagaaagagcacaaggctgaaaaagtaccggcagtcgccaattacatcatgaaaatccacaattttaccagcaagtgcctctactgcaaccgctatttgcctactgacacactcctcaatcacatgctaatccacgggttgtcatgcccatattgccgctccaccttcaacgatgtcgagaagatggctgctcacatgcggatggttcacatcgacgaggaaatggggcctaagaccgattccaccctgagctttgacctgactcttcagcagggatctcacactaatatacacctactggtgacgacctacaatctccgcgatgcacctgctgagagcgtcgcataccacgctcagaacaaccctcctgtccccccaaagcctcagcctaaagttcaggaaaaggctgatattcctgtgaagtcatctccccaggcagccgtgccctacaagaaagatgtgggtaagaccctgtgtcctttgtgtttttccattctgaagggcccaatctcagacgccctggcccaccacttgcgtgaacgacaccaggtaatccagaccgtgcatcctgtggagaaaaagctaacctataaatgcatccattgcttaggtgtttatacatcaaatatgactgccagcactattacccttcacttggtccattgtagaggcgtgggaaagacacagaacggacaggacaaaactaacgcaccgagcaggctcaatcaaagtccaagtctggcacccgttaagagaacctatgagcaaatggaattccctctgttgaagaaacgcaagctggacgacgacagtgactctccctccttttttgaagagaaacccgaagagcctgtagtgttggcactcgacccaaaaggtcacgaagatgactcatacgaggctaggaagtcctttctaaccaaatacttcaacaagcagccataccctactcggcgtgaaattgagaagttagctgcttccctctggctgtggaaatccgacatagcctcacatttcagcaataaaaggaagaagtgtgtgcgggattgcgaaaagtacaagccaggggttctcctcggcttcaatatgaaagagctgaataaggtgaaacatgaaatggattttgatgccgagtggttattcgagaatcatgatgaaaaagactcacgtgttaacgcttctaagaccgcagacaagaaactcaacttagggaaagaggatgatagcagctcagattcctttgaaaacttggaggaagagtcaaacgagtcaggctccccttttgaccccgtcttcgaggtggagccaaaaatttccaatgacaatcccgaggagcatgtgctcaaagtcatccccgaagacgcttcagaaagtgaggaaaagctcgatcagaaggaggacggttctaaatatgagacaatccaccttaccgaggaacccactaagctgatgcacaacgcctccgactctgaggtcgaccaagacgacgtcgtcgaatggaaggacggagcctccccctccgaaagcggtcccggatcccaacaggtgtcagactttgaagataatacctgcgagatgaagcccggtacttggtccgacgagagctcccagtccgaagacgcaaggtcctctaagcccgctgccaagaaaaaggccactatgcagggggaccgggagcagctcaagtggaagaatagctcctacgggaaagttgaaggcttctggtccaaggatcagtcccagtggaaaaacgccagtgaaaatgacgaaagactgtccaaccctcagatcgaatggcagaattctactattgacagcgaagatggtgagcaatttgataacatgacagatggcgtagctgagcccatgcacggctcactagccggtgtaaagctgtcttcgcagcaggcctag

SEQ ID NO: 4161 - DNA, 3309 bp, Artificial Sequence
  Description of Artificial Sequence: Synthetic coding sequence
atgttccaattgcccgtcaacaacctgggcagcctgaggaaggcccgaaagaccgtcaagaaaattctgtcagatatcggactggagtactgcaaggagcacattgaggacttcaagcaatttgagcccaatgacttttacctgaagaacaccacttgggaagacgtgggactctgggatcccagtttgacgaagaatcaggattacagaaccaagcctttctgctgttcggcttgccccttttcctccaaattctttagtgcttacaagagtcatttcagaaatgtgcactcagaagactttgagaatcggattctgcttaactgtccatactgcacattcaacgctgacaagaagacgctggagacccacatcaaaatcttccacgcccctaatgcttcagccccatcctctagcctgtcaaccttcaaagacaagaacaaaaatgatgggctgaagcccaagcaggcagatagtgtggagcaggccgtctattattgtaaaaagtgcacttaccgcgaccctctctatgaaattgtgaggaaacatatttaccgcgaacacttccaacatgttgcagctccctatatcgcaaaagccggagaaaagagtttgaacggcgctgtccccttgggttccaatgcccgagaagagtcatccatacactgtaagaggtgtttatttatgcccaagagttatgaagcgttggtccagcacgtaattgaggaccacgagagaatcggataccaagtgacggccatgatcggacacacgaacgttgtcgtgccacgatccaagccgctgatgttgatcgcccctaaaccgcaagataagaagagcatggggttgccaccgaggatcggttcactggcgtctggaaacgtgcgttctctgccttcgcagcagatggtaaacaggctgagcatccctaaaccaaatcttaatagcactggtgtcaatatgatgtcttcagtacacctccagcagaataactacggcgtcaagtcagtgggacagggctatagcgtgggccagtcaatgcgcctgggtttgggcggtaacgctccagtgagcattccccagcagagtcaatccgtgaaacagctgttaccctcgggcaatggacggagctacggtctagggtccgagcagaggagccaagcccctgcaagatatagcctgcagagcgctaatgcaagttctttatcttccggacagctgaagtcgccatccctgtctcagagccaagcaagcagggtgcttgggcaatcatcatctaaacccgcagccgcagctaccgggcctccccctgggaacacgagcagcacccaaaagtggaaaatctgcaccatctgtaacgagttgttccccgaaaacgtgtacagtgtgcacttcgagaaagaacacaaggccgagaaagttccagccgtggcaaattatataatgaagatccacaactttacttccaagtgcctttattgcaatcgttaccttcctactgacacgctgcttaaccatatgctgatccatggtcttagctgcccatattgtagaagcacctttaacgacgttgaaaaaatggcagctcatatgcggatggtgcacatcgatgaagagatgggccctaagaccgattccaccttgagttttgatcttaccctgcaacagggatcccatacaaacatccatctgttggtgacaacgtacaacctgagggacgccccagcggaaagcgtggcctatcacgctcagaacaatcctccagtgcctccaaaacctcagccgaaggttcaggagaaagccgatatcccagtcaagagctcaccccaagccgctgtaccctacaagaaagacgttgggaagaccctatgcccactctgcttcagtatcctgaagggacccatttccgacgcactggcacaccatctccgagagcgacaccaggttatccagacagtgcaccccgttgagaagaaactcacatataagtgcattcattgtctaggcgtctatacttctaacatgacagcgtcgacaattacgctgcacctggtccactgcagaggcgtaggcaaaacccagaacggccaagacaagacaaacgcccctagccgcctgaaccagagtcccagtttagcccctgtgaagcggacttatgagcaaatggaatttcctctcttgaagaagcgcaaactagacgacgactctgattctccttccttcttcgaagaaaagcccgaggagccagtcgtgctggcgctggatcctaagggccatgaggacgactcatatgaagctagaaagtccttcctgacaaaatacttcaacaaacagccttaccccaccaggagggagatcgaaaagttggcagcatccctttggctctggaagagcgacatcgcgtcccatttctcaaataagcggaagaagtgtgtgcgggattgtgagaagtacaaacctggggtgctgcttggctttaatatgaaggagctgaacaaagttaagcacgagatggatttcgacgccgagtggttgtttgaaaaccacgacgagaaggactctagagtcaacgcttccaagactgccgataagaaactgaaccttggtaaagaggacgattcctcgagtgattctttcgagaatctggaggaggagtcaaatgagtctggcagtccattcgatcctgtgttcgaagttgaacccaaaatttccaacgacaacccggaggaacacgtgcttaaagtcatccccgaagacgcttccgagtcagaggagaaactggaccagaaggaagatgggtcgaagtatgaaaccattcacctgaccgaggagcctacaaaactcatgcataacgcgtctgattccgaagtcgaccaggacgacgtggtcgaatggaaggatggggcttctccttctgaaagtggcccaggatcccagcaggtctctgacttcgaagataacacctgcgagatgaagccgggtacctggagcgatgaaagctctcagagcgaggacgccagatcatctaaacccgcagcgaagaagaaagcaaccatgcaaggcgacagagaacagctgaagtggaaaaactcatcctatggcaaggtagagggattctggagcaaggaccagtcacagtggaagaatgcaagcgaaaatgatgaaaggctatctaacccccaaattgagtggcagaattccacaatcgactctgaggacggagagcagtttgataatatgaccgatggcgtggcagagccaatgcatggttcattggctggtgttaaattaagctcccaacaggcgtag

SEQ ID NO: 4162 - DNA, 522 bp, Artificial Sequence
  Description of Artificial Sequence: Synthetic coding sequence
atgtttcagctgcccgttaacaaccttgggtccctcagaaaggcccgaaagactgttaagaaaattctgagcgatatcggcctggagtactgcaaggagcatatcgaggatttcaaacagttcgaaccaaacgatttctatctgaagaacactacatgggaggacgtggggctatgggatcccagtttgaccaaaaatcaggattaccgcaccaagcctttttgctgctctgcatgcccttttagtagcaaatttttcagtgcttataagtcacactttcgcaacgtccacagtgaagactttgagaacagaatccttctcaattgcccctactgcacttttaatgctgataagaagacattagaaactcatattaagattttccatgccccaaacgcatccgctccctctagttccctatctaccttcaaggacaagaataaaaacgacgggttgaaacccaagcaggcggactcagttgaacaggctgtatactattgtaaaaagtgtacatacagatag

SEQ ID NO: 4163 - DNA, 441 bp, Artificial Sequence
  Description of Artificial Sequence: Synthetic coding sequence
atggtgatattgacagaaccagaaggggcacccaacatcacggcaaacctgacatcttccctactgagtgtttgcggttggtcgcagacgattaatcctgaggacgacactgaccctggacacgcagatctcgttctctacattacaaggtttgatctcgaactgcccgacgggaatagacaggtgcgaggcgtcactcagcttggaggtgcctgttccccaacgtggagttgcctcattaccgaggatacaggcttcgacctcggcgttactatcgcccacgaaatcggacacagaatatgtgcgcgaccatctcctgccacccaaactcgctggacaaaggccgctgctgcagcttcctcgttcctgagctggatgggccagaacgtcgcttggagaagtggcgctcctagagtcgccgctgccccatggtggtcctag

SEQ ID NO: 4164 - DNA, 4116 bp, Artificial Sequence
  Description of Artificial Sequence: Synthetic coding sequence
atgcatcagaggcacccacgtgctaggtgccccccactgtgcgtggccggaatcctagcctgtgggtttctgctgggctgttgggggccatcacattttcagcagagttgtctgcaggccttggagccacaggccgtgtcttcctacttgagcccaggggcaccattgaagggtcgtcccccaagccctggctttcagcgtcagagacagcgccagaggcgggctgccggagggattctgcatctagaactgttagtcgccgtgggaccagacgttttccaggcacaccaggaggataccgaaaggtacgtgctgacaaatctgaacatcggggcagagcttctgcgcgatcccagtttgggagcccagtttagggtgcacctggtgaaaatggtgattcttaccgaacccgagggcgctccgaacatcaccgcgaacttaacatcctcactgctgtctgtctgcggctggagtcagacaatcaatcccgaagacgacacagatcccggacatgcagacttggtcctgtacatcacacggtttgacctagaactccccgatggcaatagacaagtgcggggagttactcaactgggaggcgcatgtagtcccacatggtcctgcctgatcactgaggatactggttttgatttgggcgtcaccatcgcgcacgaaattggtcacagtttcggcctggagcatgatggtgctcctgggagcggctgcgggccaagtggtcacgttatggcctccgatggagctgcccctagagcgggtcttgcgtggtccccttgttccagacgccagctgctgagcctgcttagcgccggacgggctcgctgcgtttgggacccgcctagaccacagcctggatccgctggccatcccccagacgctcaacccggactctactactctgctaatgaacagtgcagagtcgcctttggacctaaggcggtagcatgtacgttcgccagggaacatctcgacatgtgtcaggccctgagttgtcataccgaccctttggatcaatcaagctgtagtcggctgcttgtgcctttgcttgacggaacagaatgtggtgtggagaaatggtgcagcaagggtagatgccgctccttggtcgaactcactcctatcgcggctgtgcacgggaggtggagttcatggggacccagatccccttgcagccgaagctgcgggggtggagttgtaacaaggagaagacaatgcaacaaccctcgtcccgcattcgggggacgggcatgcgtgggcgctgatctgcaggccgagatgtgcaatactcaggcatgtgagaagacacaactggaattcatgtctcagcagtgcgctagaacagacggccaaccattacgatcatccccaggaggagcctctttctaccactggggtgccgcagtgcctcactcccaaggggacgccctttgtagacacatgtgtcgggcaatcggggagtccttcatcatgaagcggggtgactctttcctcgacggaacacgttgtatgccttctggccctcgagaggacggcacactgtcgctttgcgtgtccggatcctgtaggaccttcggttgtgatgggcgtatggactcccagcaggtctgggatagatgtcaagtgtgcggcggtgacaactctacctgttcccctcgcaaaggctccttcaccgccggacgcgctagggaatacgttaccttcttaacagttacaccaaacctaactagcgtttatattgcaaaccaccggcctctgttcacccacctcgcggtcagaattggcggtcgctacgtggtggccggtaagatgtctatcagtcctaacaccacttatccttctttgctagaagatggaagggtggaatacagagtggcactcactgaggataggctgcctcggctcgaagagattagaatctggggaccgcttcaggaggacgcagacattcaggtttatcgcaggtatggtgaagagtacggcaatctaacccgccctgatatcacattcacttactttcagccaaagccacgccaggcctgggtctgggcggcagtgcggggaccctgtagtgtgtcgtgtggcgcaggactccgatgggttaactactcctgtctggatcaagctcggaaggaactcgtggaaacagtgcagtgtcaaggtagccagcagcccccagcttggccagaggcctgcgtcctcgagccatgccctccttactgggcggttggagattttggcccatgctcagcttcatgcggaggagggctgcgagagagacctgtgaggtgcgtagaggcccaaggcagtttgttgaaaaccctcccccctgctagatgcagggcgggtgcgcagcagcccgctgtggccctggagacgtgtaatccacagccatgccccgctcgatgggaagtctctgagcctagctcctgcacatcagccggaggagctggcctggccctggagaacgagacctgcgtgccaggcgctgacggccttgaagcccctgtcacagagggcccagggagtgtagacgagaaactgcctgcaccagaaccttgtgtgggcatgagttgcccgccaggttggggccacctggacgccacttccgccggtgagaaagcacccagtccttggggaagtatccgcacaggcgctcaggccgctcacgtatggacccccgctgccggaagttgttcggtatcctgcgggagagggctgatggaattgcggtttctctgcatggacagcgctctccgtgtgcctgtacaagaggagctgtgcggcttggcctctaagcctggctctcgcagagaagtatgtcaagcagtgccctgcccggcacgctggcagtacaaattggcggcttgcagtgtatcctgcggtcggggtgtggttcgcagaattctgtattgtgccagagcacacggcgaagacgacggggaagagatcctgttggatactcagtgccagggcttgccccgacctgagccacaagaggcttgttccctggaaccatgcccgcctagatggaaggtaatgtccctcggaccctgctccgcaagttgcggcttgggtactgctcgtagaagcgtagcttgcgtccagttagatcagggacaggatgtggaggtcgatgaggcagcatgcgctgctttggtgaggcctgaggcatctgttccatgtctcattgcagactgtacttatcggtggcacgtgggcacttggatggagtgttccgtgagctgcggagatggcattcagcggcgaagagatacctgccttggtccccaggcacaggccccagttcctgctgacttctgccagcatctccccaagcctgtgaccgtgcgcggatgctgggcaggtccctgcgtggggcagggcgcatgtggccgtcagcacctcgaaccaactgggactatcgatatgcgtgggcctggtcaggcggactgcgcagtcgcaatcggtcgtccactcggcgaagtcgtcacattaagagtgctggaatccagcctgaactgcagcgccggagacatgctcctgctctggggcagactgacatggaggaagatgtgccgcaagctgctggacatgaccttctcttcaaagacaaacaccttggtggtgcgccagaggtgcgggaggccgggtgggggtgtcctcctgcgttacgggtctcagctggctcctgagacattctatcgagaatgcgatatgcaactctttggaccatggggggaaatcgtgagcccgtctctcagtccggctaccagcaatgcaggcggttgtaggctattcattaatgtggctccacacgcacgcattgcgattcatgcgttggccacaaatatgggtgccggaacagagggggctaatgcttcctacatcctgattcgcgatactcatagcctgaggactacagcctttcacggccaacaggtactctattgggaatcggaaagttctcaagcggagatggagttctcagaaggctttctgaaggcccaggcgtcactcagagggcagtactggacacttcagagctgggtgcctgaaatgcaagatccacagagctggaagggcaaggaaggcacttag

SEQ ID NO: 4165 - DNA, 4023 bp, Artificial Sequence
  Description of Artificial Sequence: Synthetic coding sequence
atgcatcagcgtcaccctcgagctaggtgccctccactgtgcgtcgccggaatcctcgcttgcggctttctcctgggatgttggggcccaagccattttcagcagagctgtttgcaggcacttgagccgcaggcagtcagtagctacctcagccccggagctccactgaagggacgccctccatctcccggtttccaacggcagagacagcgccaacggagagccgctggcggaattctacacctagagttactcgtggctgtgggccctgatgtgttccaggcccatcaggaagacacagagagatacgtgctgactaacttgaatattggggcagagcttctaagggaccccagcctgggcgctcagtttcgggtgcacctggtgaaaatggtcattcttacagagcccgagggggctccaaatatcactgcaaatctcacatccagcctccttagcgtgtgtggctggtcacagacaatcaacccagaagacgacactgaccctggccacgccgatctggtactctatattaccaggtttgatctggagctgcctgatggaaaccggcaggttagaggcgtgactcaactaggtggcgcttgcagccctacttggagctgtttgattaccgaggacaccggctttgacttgggcgtgactatcgctcacgagattggacacagctttggactcgagcacgacggagctccgggatccggatgtggcccatcaggccacgtcatggcctccgatggcgctgcccctagggccggattggcctggtccccctgcagcagacgtcaactgcttagtcttctcagcgctaacgagcagtgcagagtggcttttggacctaaggcagtggcttgcaccttcgccagagagcatctggatatgtgtcaagccctgtcctgtcacaccgatccactggatcagagttcttgttctaggttactggttccactgctcgatgggactgaatgtggagttgaaaagtggtgcagcaaggggagatgccggagcttagtggagctgactccaatagccgctgtgcacggcagatggtcgtcgtgggggcctcgatccccatgtagcagatcttgcggcggtggcgtagttacccgtcgtcgccagtgcaataacccacggcctgcttttggaggacgagcctgcgtgggtgctgatttgcaggctgaaatgtgcaatactcaggcatgcgaaaagactcagctagagttcatgagccagcagtgtgctagaactgacggccagcctttacggagcagcccgggaggggcttctttctaccactggggtgcagctgtgcctcacagccagggagatgctctgtgccgacatatgtgcagggccattggtgagagcttcatcatgaagcggggtgatagctttctggacggcacacgttgtatgccttctgggcctcgagaggatgggaccctaagtctgtgcgtgtccggttcctgccggacattcgggtgcgatgggcgaatggactcgcaacaggtgtgggatcgatgccaagtgtgcgggggagataacagtacttgtagcccccgaaagggttcgttcaccgctgggcgtgcgagagagtatgttacgttcctgacggttactcctaacctgacctccgtgtatattgcaaatcaccgaccattgtttacgcacctggccgtgaggatcggagggaggtacgttgtggccggtaagatgtctatctctcctaatacgacctatccatctctgctcgaagacggacgggtggagtacagagttgctctcaccgaagacaggttgcccagactggaggagatccggatctggggtcccctccaagaagatgccgacatccaggtttaccggagatatggggaggagtatgggaatctgactaggcctgacatcacgttcacctactttcagccaaagccacgacaggcctgggtttgggctgcagtcaggggcccttgtagcgtttcgtgcggcgctggactccgttgggtcaattacagttgtctggaccaggctcggaaagaactagtagagacggttcagtgccaggggagtcagcagcctcccgcttggcccgaagcctgcgtcctcgaaccatgccccccatattgggccgtaggagattttggcccatgcagcgcaagctgtggcggagggctgagagagcgacctgtcagatgtgtggaggcccagggctcactgctaaagactctgccacccgcacggtgtagggccggagcccagcaacctgccgttgcacttgaaacatgcaacccccagccttgtcctgcacgctgggaggtatctgagcctagcagttgtacatcagctggtggcgctggcctggccctggaaaacgagacatgcgttcccggagcggatgggctggaagcacctgtgacagaggggcctgggtcggtcgacgagaagttgcccgctccggaaccctgtgtgggcatgagctgccctccaggatgggggcatctcgatgctacaagtgctggtgaaaaggcgccaagtccttggggctctatcaggacgggagctcaggctgcacacgtgtggacacctgctgcaggaagctgtagcgtgtcctgcggacgcggactgatggaactgcgattcttgtgcatggattctgcactcagggtgcccgtccaagaggaattgtgcgggctcgcctccaagccgggaagtagaagagaggtttgccaggctgtcccctgcccggcacgttggcagtataaactcgcagcctgttcagtgagctgcggccgtggggtggtccgccgaattctgtactgtgcccgtgcccatggcgaagatgacggtgaagagattttgctggatactcagtgtcagggcttgccaagacccgaaccacaggaggcctgcagcttagagccttgccccccacgctggaaggtgatgagcctgggtccatgcagtgcctcgtgtggcctggggaccgctagacgctccgtggcatgtgttcagctcgaccaaggacaggatgtggaagtggacgaggctgcctgcgccgcactcgtgaggcccgaagcctctgtgccgtgcctcatcgctgactgcacgtatagatggcatgtgggaacttggatggagtgctctgtgagctgtggagatgggatacaacgacgacgggacacatgtctgggaccccaagcccaggcccctgtccccgcagacttctgccagcacctccccaagccagtaaccgtccgagggtgttgggcaggcccatgtgtggggcagggtgcgtgcggtcgacagcacctggagcccaccgggaccatcgatatgaggggcccaggtcaggctgattgtgctgtggctataggcagaccactgggagaggttgtgaccctgcgggtgctggagagcagcctaaactgcagcgccggagatatgctgcttctatggggtcgcttgacatggcggaagatgtgtaggaagctactggatatgacattttcttctaagacgaacacactggtggtaagacaacgctgtggtcgacctgggggaggtgtactactacggtatggtagccagctcgcccctgaaactttctaccgagaatgcgacatgcagttatttggaccatggggcgagattgtgtcaccttccctgtcgccggcaacctccaacgccggtggttgccgcctctttattaatgtcgccccacacgccaggatcgccattcatgctttagccacgaatatgggcgcaggcaccgaaggggctaacgctagctatattctcattagagacacccatagtttgcggactaccgctttccatggacaacaggtgctgtactgggaatccgaaagctcgcaggcggaaatggagttctccgagggattcttaaaagcccaggcctccctcagggggcagtactggaccttgcagagctgggtacccgaaatgcaggatccacaatcctggaagggcaaagagggaacgtag

SEQ ID NO: 4166 - DNA, 672 bp, Artificial Sequence
  Description of Artificial Sequence: Synthetic coding sequence
atgcggggtccagggcaggcagactgcgcggttgcaatcggacgccctctcggcgaggtcgtcacccttcgggtgctcgaatcttccctgaactgctccgctggggatatgctgctactctggggccgactgacctggcggaaaatgtgccgaaagcttctggacatgactttttcttcaaaaacaaataccttggtcgtccgtcagcgttgcggcaggccaggcggtggggtgctcctgagatatggatcacagctcgcgcctgagacattctacagagagtgcgatatgcagttatttgggccatggggggagattgtgtctccatcgctctcccccgctaccagcaacgctggcggttgtaggctcttcataaatgtggccccacatgcacggatagcgattcacgcgctggccacaaatatgggcgcaggcacagagggtgctaacgcatcgtacattctaatcagagatactcatagtcttcggacaaccgcgtttcacggtcagcaggtgctgtactgggaaagtgagtcgagccaggctgagatggaattctctgagggcttccttaaagcacaagccagccttcggggtcagtattggactctgcaaagctgggtccctgagatgcaggaccctcagtcttggaaaggaaaggagggcacatag

SEQ ID NO: 4167 - DNA, 1035 bp, Artificial Sequence
  Description of Artificial Sequence: Synthetic coding sequence
atgcaccagcgccacccacgggcacggtgtccccctctgtgtgttgccggaattctagcatgcggattcttgctgggctgttgggggccttctcacttccaacagtcatgtctgcaggccttggagccccaggcggtaagtagttacctttcaccaggggctcctctgaaaggccgacccccttctccaggctttcagcgacagagacagagacagcggcgagcagcaggcggtatactccacctcgaactgttggtcgccgtgggtcctgacgtgttccaggcacaccaggaggacacggaacggtacgtactgacaaacctgaatattggagctgagttgctcagagatccctcccttggcgctcagttccgtgtccacctggtgaaaatggttattctgaccgagcccgaaggcgctcctaacataactgccaacctgacatcttccctcctctctgtttgtggatggtctcagaccatcaacccagaggatgacaccgaccctggccatgccgacctggtcctgtacattaccagattcgacctggagctccccgacgggaatcgtcaggttcgaggagtgacccaactgggcggagcctgctctcccacctggtcctgcctcattaccgaggacacaggattcgatctgggcgttaccatcgcacacgagattggccacagtttcggactggagcacgatggagccccaggcagcggatgtggccctagcgggcatgtgatggcatctgacggcgctgcacctagggctggtctggcatggtccccgtgttcgagaagacagctcctgagtctgttacgaccagttcctcccagtcccctgcccctactggcgacacatttgtgtgccggacgatccctttcccttgggccatcccaagagcccgctcctggagggggaaggggccctcgcactcccgtccctacgcataagcgcccaagattccagacactccccagtagttgtcctctgttgagacctgcgtcatcccgctgcacccctagggactag

SEQ ID NO: 4168 - DNA, 831 bp, Artificial Sequence
  Description of Artificial Sequence: Synthetic coding sequence
atgcaccagcgacatcctcgcgctcgttgtccacctctgtgtgtggccggtatcctggcatgcggattcctcttggggtgctggggcccatctcatttccagcagtcatgccttcaggctttagaaccgcaggctgtttccagctatttatcccctggcgctcccctcaaaggacggcctccttctcctggctttcaacggcagaggcaacgccaaagaagggccgcaggtggaattctccacctagaactcctggtggccgtcggaccagacgtttttcaagctcaccaggaggacaccgagaggtacgtgttgactaatctcaacattggagccgagcttctacgggaccctagtctcggcgcacagttccgcgtgcacctcgtgaaaatggttattcttaccgaacccgaaggagctccgaacataacggctaaccttaccagctcccttctgagtgtgtgtggctggtcccagaccataaatccagaggacgatacagaccccggacacgcagacctggtgctgtatataacgaggttcgacctagagcttcctgacggcaatcgacaagtgagaggtgtgactcagctcggtggggcttgctcaccaacctggtcctgtctgatcacggaggataccggcttcgacttgggagtcaccatcgcacacgagatcggacacaggatctgtgccagaccctcaccagcgactcaaacgcgctggacaaaggctgccgcagcagcatcctcctttctgtcctggatgggacagaatgtggcttggaggtctggggctcctagagtggctgctgccccatggtggtcctag

SEQ ID NO: 4169 - DNA, 4284 bp, Artificial Sequence
  Description of Artificial Sequence: Synthetic coding sequence
atgcatcagaggcaccctagggcgcgatgcccccctctatgcgtggccggaatcctcgcttgtggctttctgttggggtgttggggacccagtcatttccaacagtcctgcttgcaggcgctggagccacaggccgtgtcgtcttatctgtcccctggcgctcccctgaagggtcggccaccatctcctggtttccaaagacaaagacaacgccagaggcgtgcagcgggaggaatcctgcacctggagctgctcgtcgccgtaggcccagatgtttttcaggcccatcaagaggataccgagcgctatgtcctgactaatctgaacatcggggcagagctcctgcgggaccctagcctgggggcacaattccgtgtccatctcgtgaaaatggtcatcctgacagagccagagggggctccaaatattacagctaacttaacttcctctctcctgagcgtgtgcggatggagccagactataaaccctgaggatgataccgatcccggacacgccgatctagtgctgtacattactcggtttgacttggagctgccggacggcaataggcaagtgagaggcgtcactcagctaggcggtgcttgcagtcccacgtggtcctgcttgatcaccgaggacaccggatttgacctgggggtaacaattgcccatgagattggccactcattcggcctcgagcatgatggggcacctggcagtggctgcggtccaagcggacacgtgatggcttcagacggcgctgctcccagagccggactcgcatggtcaccatgtagccgaagacagctgctcagccttctgagcgccggtagagccagatgcgtgtgggatccccctcgaccccaaccagggtctgctggccacccccctgatgcacagcctggtctgtattattccgcaaatgagcaatgtcgagttgccttcggtcctaaggcagttgcatgtacctttgctcgcgagcacctggatatgtgccaggctctcagctgtcacaccgacccactggaccagtcttcatgttctcggctcttagtgcccctgcttgacggcaccgagtgcggcgtcgagaagtggtgttcaaaagggagatgtagaagtcttgtcgagcttacacccattgctgctgtgcatggtcgctggtccagttggggccctcgatccccgtgcagccgaagttgcggaggcggagtggtaactcgccgaaggcagtgcaataatcctcggccagccttcggcggtcgcgcatgcgtgggagctgatctgcaggccgagatgtgtaacacccaggcctgtgagaagacccagctggagttcatgagtcagcaatgtgccaggacggacggtcagcctctcagatccagccctgggggagccagtttctaccattggggggctgcagtcccccatagccaaggtgatgcattatgtcggcatatgtgtagagctattggcgaatcatttattatgaagagaggggactcatttcttgacggtactcgctgcatgccgtctggaccacgcgaggacggtacgttgagtctctgtgtgtctggctcatgccggacatttggctgtgatggcaggatggattcacagcaggtatgggaccgctgccaagtttgcggaggcgacaactcaacatgctcaccacgcaaagggagttttaccgctggacgcgcacgtgagtatgtgaccttcctgacagtgactcctaacctgacatcggtgtacatcgccaatcatcgtccactcttcacacacctggccgtgcggatcggaggcagatacgtggtggcgggaaaaatgtccatctctcccaacaccacttacccttcccttctggaggacggacgggtcgaataccgagtggccctgacagaagataggttaccccgtctagaggaaatcaggatctggggtcctttgcaggaggatgctgacatacaggtctataggcggtatggagaggagtatggcaatttaacgcggcctgacataaccttcacatacttccagccaaaacccagacaggcatgggtttgggccgcagtacgtggaccatgctccgtctcatgcggcgctggacttagatgggttaactattcctgcctggaccaggcgagaaaggagctcgtggagacggtgcagtgtcagggctcccaacagccaccggcttggccagaagcatgtgtgctggaaccatgccccccttactgggccgtcggggacttcggaccgtgctccgctagttgcgggggtggattgagagagagacctgtcagatgcgtggaagctcagggatccctgctgaagacccttccaccagctaggtgtagagctggcgctcagcaaccagccgttgctttagaaacatgtaacccccagccctgcccggcaagatgggaagtatcagaaccctctagttgcacctcagctggcggtgccggacttgccctggagaacgagacttgtgtccccggtgcagacggattagaggcaccagttaccgagggacctggttccgtcgacgagaagctgcccgctcctgagccctgcgtcggaatgtcatgccctcccggatggggccacttggacgccacatccgcaggtgaaaaagctccatctccgtggggaagcattaggacgggcgcacaggcagcccacgtctggacacccgcagcaggttcttgctcagtcagttgcggccgaggcctgatggagctccgctttctttgtatggattcagccctgagggtgccagtccaggaggaactctgcggactcgcctctaaacccggtagcaggagggaggtttgccaggcagtgccgtgtccggctagatggcagtacaagctcgctgcttgttccgtatcatgcggcaggggagtggtgcgcagaatcttgtattgtgccagggctcacggcgaagatgatggagaagagatcttacttgatactcagtgtcagggccttccccgacctgagccccaggaggcctgctccctggaaccatgtccacccagatggaaggtgatgtccctgggtccctgctctgcatcatgtggattgggtaccgctagacgtagtgtagcctgcgtgcagttagaccaggggcaggatgtggaggttgatgaggccgcatgcgccgcacttgtgcgaccagaggcttcggtcccgtgccttattgcagattgcacatacaggtggcatgtgggcacatggatggaatgttctgttagctgtggcgatgggattcaacgccgacgagatacatgcctgggccctcaggcgcaggcaccggttccagccgatttttgccaacatcttccaaagccggtgaccgtgcggggatgctgggctggcccatgcgtgggccagggcactccatcactcgtcccccacgaggaagcagccgctcccggtcgcaccactgcgacgcccgcaggggcaagcctggaatggtcacaggccaggggcctactatttagcccagccccacaacctcgtagactcctgccaggcccacaggagaatagtgtccagtccagcgcttgtggaaggcagcatttggagccgactggaacaattgacatgcgcggacccggtcaagctgattgcgcggtagcgattggtagacccctgggagaagtggtcaccctgagggtgttggaatctagcctgaattgctcagccggtgatatgctgttgctctggggcagactgacctggagaaagatgtgccggaaactgctggatatgaccttcagctcaaagacaaacaccctggtcgttagacagcggtgtggaaggcctggcggaggcgtcctcctgcggtacggctcccagctcgcgcctgagaccttctacagggagtgcgatatgcagttgttcggcccatggggcgagatagtgtctccttctctgtccccagctacttccaatgcaggagggtgcaggctgtttattaacgtggcaccacacgcaaggatcgccattcacgcactggctacgaatatgggggctgggacagagggggcaaacgccagctacatcctcatccgggatacacattccttacgcacaacagccttccacgggcagcaggtgttgtactgggaatcggagtcctctcaagccgagatggaatttagcgaaggctttctgaaggcccaggcctctctcaggggacaatattggacattgcagagctgggtgccagagatgcaagatcctcagagctggaaaggcaaggagggaacttag

SEQ ID NO: 4170 - DNA, 1095 bp, Artificial Sequence
  Description of Artificial Sequence: Synthetic coding sequence
atggatatgtgtcaggctctctcctgccacaccgatcccctggaccaaagttcctgctccagactgctcgtcccattgctcgacggaacagagtgcggcgtggagaaatggtgctctaaaggacgctgtaggtcactcgtcgaactgactccaatcgccgcagtacacggcaggtggtcctcgtgggggcctagatccccctgttcacgtagctgtggcggtggcgtggtgacccgccgtcggcaatgcaataatcctcgaccagcgtttggcggtcgtgcttgcgtcggtgcagatcttcaggctgaaatgtgtaatactcaagcctgcgaaaagactcagttagagttcatgtcccagcagtgcgcccgtaccgacggccagcccctgaggagctctcccggaggcgcttctttctaccactggggtgcagcagtgcctcactcccagggggacgcactttgcaggcacatgtgcagggccatcggcgaatcttttatcatgaagaggggagattcgttccttgacggaacgcgttgcatgccgagcggaccgcgagaggacggcacgctgtcactgtgtgtcagcggtagctgccgcaccttcggctgcgatggacgaatggatagccagcaagtctgggacaggtgccaagtttgtggaggtgacaatagcacttgttcacctcggaaaggcagcttcacagcgggaagggcgcgtgagtacgtcactttcctgaccgtgacacccaatctcacttccgtctacatcgccaatcatcggcctctctttactcacttggccgtccgcattggcggacggtacgtggtcgctggtaagatgtctatctctccaaacaccacctacccttcactcctagaagacggtcgcgtggagtatagggtagcgttaactgaggatagattaccaaggctggaggagattaggatttggggcccactgcaggaggacgctgacattcaggttggaggcgtgagggctcagctcatgcacattagctggtggtcccgacccggactgggagagagggatctgtgtgctaggggtcgatggcctggaggttctagcgattag

SEQ ID NO: 4171 - DNA, 1095 bp, Artificial Sequence
  Description of Artificial Sequence: Synthetic coding sequence
atgccttatcagtaccctgccctgacccctgaacagaaaaaggagctgagcgatatcgctcatcgcatagtagcccctggcaagggtattctggcagccgacgaaagtaccggcagtatcgcgaagcgtctgcagagcatcgggacagaaaacacagaggagaatcgccgtttctatagacagctgcttctaaccgccgacgaccgggtgaacccctgcataggcggtgtaatcctgttccacgaaacattataccagaaagcagatgatgggaggcctttccctcaggtgattaagtctaaggggggagtggtcgggattaaggtcgataagggcgtggtccctctggctggaactaacggcgagaccacaacacagggcctggatggcctgtccgagcggtgcgcccagtataagaaagatggtgccgatttcgccaagtggaggtgcgtattgaagatcggagagcataccccctcagccttagctatcatggagaatgccaacgtattggcacgctatgcctcaatttgccagcagaacggaattgttcccatcgtggaaccggagatactgccggatggggaccatgatctcaagagatgtcagtacgtcacggagaaagttctcgcagctgtgtacaaagctcttagcgaccatcatatctacctggaaggaactctgctgaagccaaacatggtgacacctggtcacgcttgtacgcagaagtttagtcacgaagagattgccatggcaacagttacagctctgcgccgaacagtgcccccagccgtcaccggaatcactttcttgtctggcggacagagcgaggaggaggcttctattaatcttaacgccattaataagtgtccattactgaagccctgggccttaaccttttcatacggccgagcactccaggcctctgccctcaaagcatgggggggtaagaaggagaacctgaaggccgcacaggaggaatacgtgaaacgcgctctggccaactctttggcttgccaggggaaatataccccctccggacaagctggtgccgcagcctcagaatccttgttcgtcagcaatcatgcctattag

SEQ ID NO: 4172 - DNA, 1095 bp, Artificial Sequence
  Description of Artificial Sequence: Synthetic coding sequence
atgccttaccagtatcccgcactcactccagagcagaagaaagagctgagtgacatcgctcaccgtatcgtggctcccggaaaggggatactcgccgctgacgaatctacgggatcaattgcaaagcggctgcaatccatcggcaccgagaacaccgaagaaaatcggaggttttatagacagttgctgctcacagcagatgaccgggtgaatccctgcattgggggtgtgattctgttccatgagaccctgtaccagaaggctgatgacggaagaccctttcctcaagttattaagagcaagggaggcgtggtgggaataaaggtggacaagggagttgtccccttagccggaactaacggcgaaacgacaacgcaggggctcgacggcttatctgaacgatgtgcccagtacaaaaaggatggagctgattttgccaagtggcgctgcgtgctgaagattggcgagcacacgcccagtgctttggcaatcatggagaacgctaacgtgctggcaagatatgccagcatatgtcagcagaatgggattgtgccaattgtcgaacccgaaattttgccagacggcgaccacgaccttaaacgctgtcagtacgtcacagagaaggtccttgccgcagtttacaaagcactctctgaccatcacatctacctcgaggggaccctcctgaaacccaacatggttaccccgggacacgcctgcacccagaaattttctcatgaagaaattgccatggctaccgttacggccttgcgcaggaccgtgcctccagccgttacgggtatcacattcctgtctggcggtcagagtgaggaggaggcatcaattaacctgaacgcaatcaataagtgcccactgttgaagccatgggcactgacattttcatatggcagggccctgcaggcctccgctttgaaagcctggggtgggaagaaggagaatctcaaagctgcccaagaggagtatgtgaagcgagccctggccaacagccttgcctgccagggtaagtatacaccgtctggtcaagcaggggcagctgcctcagaaagccttttcgtttctaaccatgcgtattag

SEQ ID NO: 4173 - DNA, 1257 bp, Artificial Sequence
  Description of Artificial Sequence: Synthetic coding sequence
atggctcgtagaaagccagagggatctagtttcaacatgacccacctgtcaatggctatggcgttcagtttcccccctgtggcctctggccagttacacccccaacttgggaacacccaacaccagacagagttggggaaggaattggccactaccagcaccatgccttaccaataccccgctcttacaccagaacaaaaaaaggagttgagcgatatcgcccacaggattgtagctccaggtaaggggattctggcagccgatgagtcgactggtagcatagctaaacgcctgcagtctatcgggacggagaatactgaagaaaatcggcgtttttacagacagctgttactcaccgctgatgatcgggtgaatccatgtatcgggggtgtgattctgtttcatgaaaccctgtatcagaaggcagatgacgggcgaccattccctcaggttattaagtcaaaggggggagtagtcggcatcaaggtggataagggcgtggtcccccttgccggaacaaatggcgaaactacaacacaaggcctggatggattgtcagagcggtgcgcacagtacaagaaggacggagccgattttgccaagtggagatgtgttctgaaaatcggagagcatactccaagtgctctggcgatcatggaaaacgctaatgtacttgcacggtacgccagcatatgccagcagaacggtattgtgccaattgtggagcccgagatcctccctgatggtgatcacgacctgaaaaggtgtcagtatgtgactgaaaaagtgcttgccgctgtgtataaggctcttagtgatcaccacatctacctagaagggacacttctcaaaccaaatatggtgacccctgggcatgcctgtacccaaaaattttcacacgaggagatagcgatggcgaccgttactgcacttcggaggaccgtgccccctgcggtcacagggattacattcctctccggaggtcagagtgaggaagaagcgtctatcaatcttaatgcaattaataaatgcccattactgaaaccatgggctctgaccttctcctacggcagggccctgcaggcatccgcacttaaagcttggggcggtaagaaagaaaatctcaaggccgcacaggaagaatatgtgaagcgcgcactcgccaattccctggcgtgtcagggaaagtacacacccagtgggcaggctggggcagcagcctctgagtccctctttgtgtccaaccatgcctattag

SEQ ID NO: 4174 - DNA, 1095 bp, Artificial Sequence
  Description of Artificial Sequence: Synthetic coding sequence
atgccctaccagtacccagctttgacgccggagcagaagaaagaactttccgacattgcccaccggatcgtagccccaggtaagggcattctagctgccgacgagagcactggtagcatcgcaaagcggttacagtccattgggactgagaatactgaagagaatcgcagattttatcgacagttgctgctcaccgccgacgaccgggtaaatccttgcatcgggggtgtcattctttttcatgaaacgctgtatcagaaggcagacgatggcaggcccttcccccaggttatcaaaagcaaaggtggggtcgtaggaataaaggtggataaaggtgtggttcctctggccggaaccaacggggagaccaccacgcagggcctcgacggactaagcgagaggtgtgcgcagtataaaaaggacggcgctgactttgccaagtggaggtgtgtcctgaagattggtgaacacactccatcggccttggccattatggagaacgccaatgtcttggcaaggtatgccagcatatgccaacagaatggtatagtgcctattgtggagcccgaaatccttcccgacggcgaccacgatttaaaaaggtgccagtacgttaccgagaaggtgctggccgctgtctacaaagcactctccgaccatcacatttatttagagggaaccctgcttaaaccaaacatggtgacaccaggccatgcctgcacacagaagtttagccacgaggagatcgcgatggctaccgtcaccgcactgcgtcggacggtcccaccagctgtcacaggcataacatttctgagcgggggtcaaagcgaagaagaagcctccattaacctaaatgctatcaataagtgtcctctcttgaaaccatgggctttaaccttttcatacggcagagccctgcaagccagtgctttaaaggcttggggaggcaagaaagaaaacttgaaggcagcccaggaggaatatgtgaagcgagccctcgccaatagccttgcgtgtcaggggaagtacaccccgtccggtcaggctggcgctgccgcaagcgaatctctctttgtgagtaaccacgcctactag

SEQ ID NO: 4175 - DNA, 1095 bp, Artificial Sequence
  Description of Artificial Sequence: Synthetic coding sequence
atgccttatcagtaccccgcactgaccccggagcagaaaaaagagctgtccgacatcgcccaccgaatcgtggccccaggaaaaggcatcctcgcggcagatgaatcaaccggatcaattgccaaaaggctgcagagcatcgggaccgaaaacaccgaagagaatcgcagattttacaggcagctgctgttgactgctgacgacagggttaacccttgcattggtggtgttatcttgtttcatgaaacgctgtatcaaaaagcggacgatggcaggcctttcccccaagtgatcaagagcaaaggcggtgtggtcggcattaaggttgacaagggggtagttcctctggccggaacaaatggggagactactacccagggcctggacggactctctgagagatgcgcacagtataagaaagacggcgctgatttcgcaaaatggagatgtgtattgaagatcggggagcacactccgagcgccctagctatcatggagaatgcaaacgtactggctagatacgcgtccatctgtcagcagaacgggatagtcccaatagtggagcctgaaattctccctgatggggaccacgacctgaagcggtgtcagtacgtcaccgagaaggtacttgccgcagtgtataaggctctcagcgatcatcacatctacctggagggaacacttctgaagccgaacatggtaaccccagggcacgcctgcacccagaaattttcccacgaggagattgccatggctaccgttaccgctctacggagaaccgtcccacctgccgtaactggaattacctttctgagcgggggtcagtcagaggaagaagcatctataaatctcaatgcaataaacaaatgcccgctcctgaaaccgtgggccttgacattttcttatggacgggctctgcaggcaagcgcactcaaggcttggggaggcaaaaaggagaatttgaaagccgctcaggaagagtatgtaaagagggcccttgctaacagccttgcctgccagggtaaatacactcccagcggtcaagctggcgcagcagcgagtgagagtctattcgtgtccaaccatgcctattag

SEQ ID NO: 4176 - DNA, 1257 bp, Artificial Sequence
  Description of Artificial Sequence: Synthetic coding sequence
atggccaggagaaagcccgaaggttctagctttaatatgactcacttgtctatggcaatggcctttagtttcccgcctgtcgcctccggccagctacaccctcagctcggcaacacacagcaccagacggaactcggaaaggagctagctaccacctctactatgccataccagtaccccgcactcacaccggaacaaaagaaggagcttagcgatatcgcccaccgcatagtggccccaggaaagggaatcctcgccgctgacgagtccacaggaagtattgccaagcggctacaatccatagggacggaaaatactgaagagaacagacggttttatagacagctgctcctgaccgccgacgacagagtcaacccctgtattggtggtgtgatcctctttcacgaaacactataccagaaggcagacgacggtcggccatttccacaggttatcaagagcaagggtggagttgtcggcataaaagtagataaaggcgtcgtgccactcgctggcaccaacggtgagactacaacgcagggtctggatggacttagtgaacgctgcgctcagtacaagaaggacggtgcagattttgctaaatggaggtgcgtcctgaagattggcgagcacacacctagtgccttggccattatggagaatgccaacgtcctggccaggtacgcctctatatgccaacagaacggaattgtgcccattgttgaacctgagattttgcctgacggcgatcacgatctgaaacgctgccagtacgtcactgaaaaggtcctcgctgctgtgtacaaggccctcagcgaccaccatatttacttggaaggaaccctcttgaagccgaatatggtaacacccggacatgcttgcacgcaaaagttctctcatgaggaaatcgccatggcaacggttactgctttaagaaggactgtccctcccgcagtaacaggaattacctttctgagcggcggacagtccgaggaggaagctagcatcaatcttaatgcgattaacaagtgtcctcttcttaaaccatgggcgctgaccttctcctacggcagagcgctacaggccagcgctttgaaggcttgggggggaaagaaggaaaacttaaaagctgcgcaagaagagtacgttaagagagctctcgctaattcactggcttgtcaggggaaatacacaccttctggccaggcaggagctgccgcttctgaatctctcttcgttagcaatcacgcgtattag

SEQ ID NO: 4177 - DNA, 1095 bp, Artificial Sequence
  Description of Artificial Sequence: Synthetic coding sequence
atgccatatcaatatccggctctgacacctgagcagaagaaagagttatccgatatcgctcatcggattgtggctccaggaaagggcattcttgccgctgacgagtcaaccggctcaatcgcaaaacgcctccagtccatcgggacagaaaataccgaggagaatcgtcgcttctatcgccaactcttacttaccgccgacgatcgcgtcaatccctgtattggtggtgtgattctgtttcacgagaccctgtatcagaaagccgacgacggcagacccttcccgcaggtgattaagtccaaagggggtgtggtcggaatcaaggtcgacaagggtgtggtgcccctagccggtaccaacggtgaaacaaccactcagggactggacggtttatcggagagatgcgcccaatacaaaaaagatggcgcagactttgcgaaatggagatgtgtgctgaagattggagagcacacaccatctgcactggccatcatggagaatgcgaacgtgctggccaggtacgctagtatctgtcagcagaatggtatcgttcccatagtcgagcccgaaatactgccagacggagatcatgacctgaaacggtgtcaatacgtgacagagaaagtattagccgcagtgtacaaagctttgtcggaccaccatatatacctggagggcacactactcaaaccgaacatggttactccagggcatgcttgcacccagaaatttagccatgaggaaattgcaatggcgaccgtcacggcattgaggcggacagtgccacctgcagtaacaggcattacatttctgagcgggggacagtccgaagaagaggcaagcatcaatcttaatgccataaacaagtgtcctctcttgaagccctgggcattaacctttagttacggtcgggcacttcaggccagtgctctgaaggcctgggggggtaaaaaagaaaacttaaaggcggcacaagaggagtacgtgaaaagagctctggccaacagcctggcctgtcagggaaagtacacccccagcggccaagctggagccgcagcaagcgaatcgcttttcgtcagcaatcatgcttactag

SEQ ID NO: 4178 - DNA, 1344 bp, Artificial Sequence
  Description of Artificial Sequence: Synthetic coding sequence
atgagcgcatctaagattccattgttcaagatgaaagatctcatcttgatactgtgtttgctcgagatgtccttcgccgtgcccttcttcccacaacaaagcgggactcctggcatggccagcctctcactggagacaatgcgccaacttggatcccttcagcgtcttaacacactttctcagtactccagatatgggttcggtaagtccttcaatagtctttggatgcacggcctgctgccaccccacagtagtctcccttggatgcgaccaagagagcatgagacacaacagtacgagtacagccttcccgtgcatcccccaccacttccttcacagccttctctcaaaccccagcagcccggactgaaaccgttcctgcagagcgccgctgccacaactaatcaggccaccgcgctgaaggaggctttgcagcccccaattcacctgggtcatttaccattgcaagagggtgagctgcccctggtgcagcagcaggtcgcacccagcgacaagccacccaagcccgaactgccaggggtagattttgctgacccgcaagggccttctctgcctggcatggatttccctgatccacagggaccaagtttgccgggtttggattttgccgaccctcagggcagcaccattttccagatcgcgcgtcttatctctcacggacccatgccgcaaaataagcagtcccccctgtaccccggaatgctttatgtgccatttggggcaaatcagttaaacgctcccgcacgccttgggatcatgtcctccgaagaggttgcaggagggagagaagacccaatggcctatggggctatgttcccagggtttgggggtatgcggccaggttttgaaggtatgccccacaatcctgctatgggaggagactttacattggaatttgactcaccagtggctgctactaaaggacctgaaaacgaagaaggcggagctcagggcagccctatgcccgaagcgaatcccgataatctcgagaatcctgccttcctcaccgagctggaacctgcaccccacgccggactgctagcgctccctaaggacgatatccctggattaccccgtagccctagcggcaaaatgaaaggactcccctcagtcacgcctgccgcagctgaccctctgatgacccccgaactagcagatgtttaccggacttacgatgccgatatgactacaagcgtggactttcaggaagaagctaccatggataccaccatggcaccaaactcacttcagacctcaatgccaggaaataaggcccaagagccagagatgatgcacgatgcctggcattttcaggaaccttag

SEQ ID NO: 4179 - DNA, 1299 bp, Artificial Sequence
  Description of Artificial Sequence: Synthetic coding sequence
atgtccgcttcaaagatccccctgtttaagatgaaggatctcatcctgatcctgtgccttctcgagatgtctttcgcggtgcccttcttcccccagcagtcaggcacacctggcatggctagcttgagcttggaaacaatgagacagctcggatccctgcaacgtctgaacactttatcccagtattcaaggtatggtttcggtaaatcctttaacagcttgtggatgcatggtctgctacccccacattctagcctgccatggatgcggccacgagaacatgagacccaacagccatctctgaagccccagcagccaggtttaaagcccttcctgcaatcagctgcagctaccacaaatcaggcaaccgccttaaaagaggctctgcagccacccatccatctcggacacctgccgctgcaggaaggcgaactgcctttggttcaacaacaggtggcgccatcagacaaacctcccaaacccgagttgcctggcgtggactttgcggatccccagggaccttctttgccaggaatggattttcccgaccctcagggcccatcactgcctggtttggatttcgccgatccccaagggtcaactatttttcaaatagccagactgatcagccacgggccaatgccccagaataaacaaagccccctctatcccggaatgttatacgtaccgttcggcgcaaatcaactcaacgccccagcgagactgggaataatgtcttctgaagaggttgcaggtggcagggaggacccaatggcgtacggggctatgtttcctggcttcgggggtatgcggccaggtttcgagggaatgccccataatccagccatgggaggtgactttacactggaatttgacagccctgtagcagcgacgaaaggaccggagaacgaggaaggaggagctcaaggaagccctatgcccgaagcaaatccagataacttggagaatcccgctttcttgacagagctggagcctgcaccacacgctgggttgctcgcattgcccaaagacgatataccaggtcttcctaggagccccagtgggaagatgaagggcttgccctcagtcacccccgctgctgctgacccattgatgactccagaactggccgacgtgtacagaacctacgacgccgacatgactacatctgtggacttccaagaggaggccactatggatactacgatggccccaaattctctccagacatccatgccgggaaacaaagcccaggaacctgaaatgatgcatgacgcttggcacttccaggagccttag

SEQ ID NO: 4180 - DNA, 1341 bp, Artificial Sequence
  Description of Artificial Sequence: Synthetic coding sequence
atgagcgcgtccaaaatccctctgtttaagatgaaggacttgatactgatcctctgtctactcgaaatgtctttcgctgtacctttctttcctcagcaaagtgggactccaggcatggcttcattgtctctggagactatgcgacagctgggctcactccagagattaaatacactgtcccagtactctcggtacgggttcggtaagtcttttaattccttgtggatgcatggcctgctgccaccacatagcagcctgccatggatgcggccacgcgaacacgagacccagcagtacgagtactccctgcctgtgcatccccctcctctgccatctcaacctagtcttaagcctcagcaacccggactcaaaccctttctccagagcgccgcagcaaccacaaatcaggccactgccctgaaagaagccttgcagccaccgatccatctgggacatctcccattgcaggaaggggagctgccactggtgcaacagcaggtcgctccttccgacaaaccacccaagccagaacttagggttgatttcgctgatcctcagggtccttctctaccaggtatggatttccctgatccgcaaggaccttctctccctgggctggactttgctgatccacagggatctaccatattccagattgccagactgattagccacgggcctatgccccagaacaagcaaagcccactgtacccgggtatgttgtacgtcccttttggagctaatcagctgaatgccccagccagactgggaattatgtcaagcgaggaagtcgctggcggaagagaggaccccatggcatacggggctatgttccctggcttcggaggtatgcgccctggatttgagggaatgccgcataatcctgctatgggcggtgatttcaccctggagtttgatagccctgtggccgcaacaaaaggcccagaaaacgaggagggaggggcacaggggagccccatgccagaggcaaaccccgacaacctcgaaaacccagccttcctgacggagcttgagccggctccccacgccggtctgctggccttgcccaaagacgacatacctggcttaccccgatctccttctggaaagatgaagggcctgcccagtgttaccccggctgccgctgatccgctcatgactcccgagcttgccgatgtttaccgaacatacgatgctgacatgactacctcggtggacttccaagaggaggcaactatggacaccactatggcaccaaattccctccaaacatccatgccagggaataaggcacaggaacctgagatgatgcatgatgcatggcacttccaggagccctag

SEQ ID NO: 4181 - DNA, 528 bp, Artificial Sequence
  Description of Artificial Sequence: Synthetic coding sequence
atggggacctggatattgtttgcctgcctgttgggagccgctttcgcaatgccggtcctgactccactaaagtggtaccagagcatccgcccaccgtatccatcatatggctacgagcctatgggaggttggctgcatcatcaaatcattcccgtgctgtcccaacaacacccccctactcataccttgcagccacaccatcacatccctgtggtccccgctcagcagcctgtgataccacagcagcccatgatgccagtcccaggacaacactctatgaccccgatccaacatcatcaacccaacctgccaccacccgctcagcaaccctaccagccccagcccgttcagcctcagcctcaccagccaatgcaacctcaacctcctgtgcaccccatgcagcccctacccccacagccccctttgcctcctatgtttccaatgcagccacttcccccaatgctgcctgacctcaccctcgaggcgtggccttccacggacaaaacaaagcgcgaagaggtggactag

SEQ ID NO: 4182 - DNA, 618 bp, Artificial Sequence
  Description of Artificial Sequence: Synthetic coding sequence
atgggcacgtggatactgttcgcctgcttattgggtgctgccttcgcaatgccactgccgcctcaccctggtcatcccggttatataaacttcagttatgagaattctcattcccaggcaattaatgtcgacagaacagctctggtcctgacgcctctcaagtggtatcagagcatccgacccccttatccaagctacggttatgagccaatgggagggtggctacaccatcagattattccggtcctgtctcagcaacacccgccaacccatacactgcagccccaccatcacattccagtggtgccagcgcaacagccggtcatcccacagcagccaatgatgccagtgcctgggcagcactccatgactcctatccaacatcatcagccaaatctgccaccacccgcacagcagccctaccagcctcagcccgtccagccccaacctcaccagcctatgcagccacagccgccagtacaccccatgcaacctttgccccctcagcctccgttaccccctatgttccccatgcagcctttgccaccgatgctgcccgatttaacgttagaagcttggcccagtacagataaaaccaagagggaggaggtggactag

SEQ ID NO: 4183 - DNA, 576 bp, Artificial Sequence
  Description of Artificial Sequence: Synthetic coding sequence
atgggcacatggatcctgttcgcatgtctgctgggggcagccttcgccatgcctctgcccccacaccccggacaccctgggtacattaatttttcttacgaagtgctcacccccctgaaatggtatcagagcatccgtcccccatatcccagttacggctacgagcctatgggcggatggctccaccatcagatcattccggtcttatctcagcagcatccacccacacacaccttgcagcctcatcaccatatacccgttgttccggcacaacagcccgtaatcccccagcaacctatgatgccagtgccaggtcagcactctatgaccccgattcagcatcatcagccaaacttacctcccccagcacagcagccgtatcagccccagcccgtgcagccccagccacaccagccgatgcagccccaacctccagtgcatcccatgcagccactccccccacaacctccactgcctcccatgttccctatgcagccactgccccctatgttgcccgacctcactctcgaggcttggccgtctactgataaaacaaaaagagaggaggtagactag

SEQ ID NO: 4184 - DNA, 4023 bp, Artificial Sequence
  Description of Artificial Sequence: Synthetic coding sequence
atgttccgcgtgggatttctcatcattagtagcagttcatcgttgtctcccctcctgctagtgtcagtcgtgagggttaatacaacaaattgtcataaatgtctcctgtctggtacctatatttttgccgtcttattagtttgcgtggtgttccattctggcgctcaggaaaagaactacacaatccgagaggaaatcccagaaaatgttttgatcggcaacttgctaaaagatctgaatctctccctaattcccaataaatccctgactactaccatgcagttcaagctcgtctacaaaacaggcgatgtccccctgatacgaattgaagaggatactggcgaaatttttacgaccggcgctcgaatcgacagagaaaagttgtgcgcgggaatccccagagatgagcattgcttctatgaagtcgaagtcgccattctgccggatgaaatcttcagacttgttaaaatcaggtttcttattgaggacataaatgacaatgcccctctgttccccgctacagttatcaacatctctattccggaaaactcggcgattaacagcaaatacaccctacccgctgctgtggaccccgacgtaggcattaacggagtccagaactacgaattaattaaatctcagaacatttttggattagatgtcattgaaaccccagagggcgacaagatgccccagctcattgtccagaaggagttggatagagaagagaaggacacttatgtgatgaaagtaaaagtggaggacgggggattcccacagcgctccagcaccgccatcctccaggtcagcgtgacagataccaatgataaccaccccgtgttcaaggagactgaaatcgaggtgagcatccctgagaacgcccctgtgggcacatcggtaactcagcttcacgctactgatgccgacatcggcgagaatgcaaaaatccactttagcttctctaacttagtgtcaaatattgccaggcggctgttccatttaaatgcaaccaccggcctcataaccatcaaagagcccctggatagagaagagacccctaatcacaaattactggttttggcatctgacggaggcctgatgcccgctagagccatggttctggtaaacgtcaccgatgttaacgataacgtgccttctatcgatattagatatattgtcaatcctgtgaatgacaccgtagttctttctgaaaacatccctctgaataccaagatcgcccttatcaccgtgactgacaaggacgcggatcataacggaagagtgacttgctttacagatcacgaaattcctttccgcctacggccagtgttcagcaatcagtttctgcttgagaatgccgcatacttagactacgagtcaacaaaggaatatgctattaaattgcttgctgctgatgccggaaaacctcctttaaatcagagtgctatgttgtttatcaaagttaaggatgaaaacgataatgctccagtcttcacccagtccttcgtgactgtctcaattcctgagaacaactcccccggtattcagttaatgaaggtgtccgctacagacgccgactccgggccaaatgcggagattaattacctgctcggacccgatgcccctcctgaattctccttggatagaagaacaggcatgttgactgtcgtcaagaaacttgaccgtgagaaggaggataagtatctcttcaccatcctagctaaggataatggagtccctccccttaccagtaacgtgactgtttttgtaagcattatagatcaaaatgacaatagcccagtgtttacgcacaacgagtacaaattctacgtgcccgagaacctgccgaggcatggaacggttgggttgatcaccgttacagacccggattacggcgataattctgcagtgaccctgagcatactcgacgagaatgatgacttcaccattgactcacagactggtgtgatccggcctaatatatctttcgaccgggaaaagcaggaatcctatacgttttatgtgaaggccgaggacggcggaagagtttcgaggagttcttctgccaaagtgacgattaacgtggtggacgttaacgataataaaccagtattcatagtccctccttacaactactcctatgaactggtgttaccttctaccaaccccggtaccgttgtgttccaagtcattgctgtggataatgataccgggatgaatgccgaggtccgctactcgattgttggtggcaacactagagatctgttcgcgatcgatcaggagacaggcaatatcacactgatggaaaagtgcgacgtcacagatttggggttacaccgcgtactggtgaaagcgaacgacctcggccaacccgactcgctattctctgtggtcatcgtgaacctgtttgtgaacgagtctgtcaccaacgcgacactcattaacgaactcgtccggaagagcatagaggcaccagttacgcctaacacagaaattgccgacgtatccagccccacatctgactacgtcaaaatactggttgccgctgtggcaggcacaatcacggttgttgtagtcatctttataaccgccgtcgtgaggtgtagacaggctccacatttgaaggctgcccaaaagaatatgcagaattcagaatgggccacacctaatcccgaaaatcgccagatgattatgatgaagaagaagaaaaagaagaagaaacactcacccaagaatcttttacttaacgtggtgaccatcgaggaaacaaaagccgatgacgtggactccgacgggaaccgcgtaacccttgatcttccaattgatttggaggagcagactatggggaagtacaattgggtgactacccccaccaccttcaaacccgactctcccgacctcgcaaggcactacaaaagtgccagcccgcagcccgcttttcaaattcaaccagagacaccccttaacctcaaacatcacataatacaggagctgcctctagataatacattcgtcgcctgcgatagtatatcaaactgcagctcaagttcctctgacccctatagcgtttctgattgtgggtatcctgtgacaacctttgaagttcctgtttcagtccatacacgcccaagccagaggagagtcacatttcatctgccagagggctcccaagagagttcttctgacggcggacttggagatcatgacgccggaagccttacatctacctcccacgggctgccccttggttacccccaggaggaatacttcgacagggcaactcctagtaacaggaccgagggggatgggaactcagatcccgagtccaattttattagcggaatgcgggaaaagatcactgtgcagcctactgtagaagaggcctccgataactgcacacaagagtgtctcatatacggccattctgacgcgtgctggatgcccgctagcttagaccactcgagtagttcacaggcacaggctagcgccttatgtcacagtccaccactgtcacaggcatctacacaacaccacagcccacctgtaacgcagaccatcgtgctgtgccattccccgccagtgacacaaacaattgccctgtgtcactcgccacccccaatacaggtgtctgcactgcaccacagcccaccacttgtccaagggacggccctgcaccattctccaccgtctgcacaggcctccgctctttgctactctcccccactggcacaggccgctgccatctcacattccagttccctgccgcaggtgattgccctgcatcgatcccaggctcagagctcggtgtctttacaacagggttgggttcagggtgccaatggtctatgtagtgtggatcaaggcgttcagggatctgcgacctcccagttttacacgatgtcagaacggctccacccctcagatgactctatcaaggtcattccccttaccacattcgcgccacgccagcaggcgaggccttccaggggcgactctccgatcatggaaacacatcccctgtag

SEQ ID NO: 4185 - DNA, 621 bp, Artificial Sequence
  Description of Artificial Sequence: Synthetic coding sequence
atggggacatggatcctgttcgcctgcctggtgggggctgccttcgcaatgcctctgccaccacacccgggtcatccgggatacattaacttcagctacgagaactcacattcccaggccattaacgtcgatagaatcgccctagtgctgacaccactcaaatggtatcagagcatgatacgacccccatacagcagctatggatacgaacccatgggaggatggctccatcaccagataattccggtagtgtcccagcaacaccctctcacccatacccttcagtctcaccatcacatacctgtggtcccagcccagcaaccacgagtcaggcagcaggcccttatgcccgtgccgggtcagcagtccatgacaccaacacagcaccaccagcccaacctccctcttccagcccagcaaccatttcagcctcagccagtacagccacagcctcaccagcctatgcaaccgcagccacccgtgcaacccatgcaacccctcctgcctcaaccaccacttccccctatgttccctcttagaccgttgccgccaatcctgcccgacctgcatctagaagcatggcccgctactgacaaaacaaaacaagaggaagtcgattag

SEQ ID NO: 4186 - DNA, 618 bp, Artificial Sequence
  Description of Artificial Sequence: Synthetic coding sequence
atgggaacttggatcctctttgcatgcttagtaggtgccgcatttgcaatgcctttgccgccacatcctggccaccctggctacatcaatttcagttatgaaaactctcactcccaggccattaacgtggaccggatcgctctcgttctcactcccctgaaatggtaccaatctatgatcaggcccccatatagctcatatgggtacgagcccatgggcggatggctccaccaccagattattccagtagtctcacagcagcacccgctaacacacactcttcaatcgcatcaccacatacccgtggtcccagcccaacagccgcgtgtcagacagcaggccctcatgcctgtaccgggtcagcagagtatgacacctacccagcaccaccagcctaatctgccacttcccgctcaacagccgtttcagccacaacccgtgcagcctcagccacatcaaccgatgcaacctcaaccaccagtccagcccatgcagccgctgctgccacagccacctctccctcctatgttccctcttaggccactcccgccaatcctgccggatctgcacctggaggcatggccagctacggataaaacaaaacaagaggaggtctag

SEQ ID NO: 4187 - DNA, 4599 bp, Artificial Sequence
  Description of Artificial Sequence: Synthetic coding sequence
atgggtcatagtaaacagatccgcattctgctcctgaatgagatggagaagttggagaagactttatttcgattagagcaggggtatgagttacagtttcgattgggtccgactctgcagggtaaggccgtgacagtctacaccaactaccctttccccggtgagacttttaacagggagaagtttcggagtctagattgggaaaatccaaccgagcgggaggacgattcggacaagtactgtaaacttaatttgcagcaatctggatccttccagtattatttcctgcaagggaacgaaaagagtgggggaggctacattgtggtagatccgatcttacgcgtaggtgccgacaaccacgtgctgccattagattgcgtgacgctccagacatttctcgcgaaatgcctaggtccttttgatgagtgggagagccgactgagggtggcaaaggagtccgggtataacatgattcattttacgcctctgcagaccctaggtctaagccgcagttgttattcgctagcaaaccagctcgagttgaacccagatttcagccgaccaaacaggaaatacacatggaatgatgtgggtcagcttgttgaaaaactgaagaaagaatggaacgtaatctgtataacagatgtcgtgtacaaccatacagcggctaactccaagtggatacaggagcacccagaatgcgcttataacctagttaactccccacacttgaagccagcctgggtgcttgatcgggcactctggagattctcatgcgacgtggcagaagggaagtacaaggagaaaggcatccctgcactcattgaaaacgaccaccacatgaacagcatacggaaaattatctgggaggacatatttccaaagctcaagctatgggaattcttccaggtggacgtaaataaggctgtggagcaattcagaagactgttaacacaggaaaaccggagagttacgaaatcagaccctaaccagcacctcacaattatacaggaccctgaataccggcgatttggatgcaccgtggatatgaacatcgccctcaccaccttcatacctcacgacaaaggcccagcggcaatcgaagagtgttgcaattggtttcataaaagaatggaagaactgaattccgagaagcatcgtttgataaactaccatcaggaacaggcagtgaactgcctcctcgggaatgtgttttacgagagactagcgggtcacgggccaaagctagggcctgttactcgtaaacatcctttggtgacccggtattttacatttccatttgaagaaatcgacttttcgatggaggagtccatgatccaccttccaaataaggcctgcttcttgatggcccacaacgggtgggtgatgggagatgacccgctaagaaatttcgcagaacccggatcagaggtgtacctgaggcgcgagttgatttgttggggcgattcagtgaagctgcggtatgggaataagccggaggactgtccatacctctgggcacatatgaagaaatatacagagattacagctacatatttccagggcgtgaggttggataattgccactcaactcctttgcatgtggctgagtacatgttggatgccgctagaaatttgcaaccgaacttatacgttgtcgccgaattatttactggatccgaggacctggacaacgtgttcgtgacaaggctggggatcagcagcttaattcgtgaagccatgtccgcgtacaacagtcatgaggagggtagactagtgtaccggtacgggggagagcccgtgggatcattcgtgcagccttgcctgcgaccactgatgcctgctatcgctcacgctctatttatggacattactcatgataacgaatgccccatcgtacaccgcagcgcatacgacgccttaccatctactacaattgttagcatggcttgctgcgccagcggctccacaagaggatacgacgagctggtgccacatcagatttcagtcgtctcagaggaaaggttctatactaagtggaatcctgaggcgctgcctagtaacaccggtgaggtgaatttccagtcaggaataattgctgccagatgtgccatcagtaagttgcatcaggagcttggggctaaaggctttatccaggtgtacgtggatcaggtcgatgaggacatagtcgctgtcacacggcattcaccgagtatacatcaatccgttgtggccgtgtcacgaactgcctttaggaacccaaagacttcgttttactccaaggaagtgcctcagatgtgtatcccaggcaaaatcgaggaggtcgtccttgaggccaggacaatcgagagaaacacaaaaccttatcggaaagacgaaaattccataaatggcactcccgacataacagtggagataagggagcacatccagcttaacgagtccaagatcgtgaaacaggcaggggtggccaccaagggccctaacgaatacatacaagaaatcgaattcgaaaatctgtctcctggttccgtcataatcttcagggtaagtttggacccccacgcccaagtggctgtaggaatcctcaggaatcacctgacccagtttagtcctcacttcaaaagcgggtcccttgctgtcgacaatgctgacccgattctgaagattcccttcgcatcactagcctctagactgaccttggccgagctcaatcagatattgtacaggtgtgaatcagaggagaaggaagacggaggcggatgttatgatatcccaaattggtcagccctgaagtacgccggactgcagggactcatgagcgtattagccgaaatcagaccgaagaatgacttgggacaccccttctgtaacaatttgaggtctggcgactggatgattgattatgtttcaaacaggttgatttctaggtcgggaactatcgcagaggtgggaaaatggctgcaggccatgttcttttatctcaagcagataccccgatacctaattccttgttattttgacgctattcttataggagcttatactacactcttggatacagcctggaaacagatgagttcctttgtgcagaacgggtctacctttgtgaagcacctgtctctaggctcggtgcagctctgcggcgtgggcaagttcccaagcctgccaatcctctcgcccgcactcatggatgttccatatagactgaacgagatcaccaaagagaaggagcagtgctgtgtaagccttgccgcaggtctgcctcacttctcttccgggattttcaggtgctggggcagagatacgttcattgccctccggggaatcttactcattaccgggagatacgtagaggctaggaacattattctcgcttttgccggtactttgaggcatggcctcatcccaaacctgctcggggaggggatatatgcccgttataactgtagggacgccgtctggtggtggcttcagtgtattcaggactattgtaaaatggtgccaaacggcctggacatattgaaatgtccggtgagccggatgtacccaacagacgacagtgctcccctgccggctggtactctggaccagcctttgttcgaagtcattcaggaggccatgcagaaacacatgcagggaatacagtttcgcgagcgaaacgctggaccacaaatcgacaggaacatgaaggacgaggggttcaacatcaccgccggtgttgatgaagaaaccggattcgtgtacggaggcaatcgtttcaactgtgggacctggatggataagatgggagaatcagatcgggctcgaaaccgtggaattccagcgacccccagggacggaagcgctgtggaaattgttggtttatctaaaagtgccgtgagatggcttctggaacttagtaagaagaatatattcccctaccatgaagtcaccgtgaagcggcacggtaaagccattaaagtatcctatgacgagtggaacagaaaaattcaggataactttgaaaaactctttcacgtttcagaggatcccagcgacctgaatgagaaacaccccaatctggtccataagaggggcatttacaaggactcatacggggctagttctccgtggtgcgactatcagctgcgacccaacttcactatcgctatggtggtggccccagagctgttcacaacggagaaggcttggaaagcccttgagattgctgagaagaagcttctgggcccactcggtatgaagactttggaccctgatgacatggtctactgcggaatctatgataatgcactcgacaacgacaattataacttggctaagggatttaactaccaccagggacccgagtggttgtggccaatcggatactttttgagagccaagctctacttttcacgcttgatgggcccagagacaactgctaaaacaattgtattggtgaagaacgtcctgtccaggcattatgtgcacctcgaacggtccccatggaaggggttgcctgaattgactaacgagaacgctcaatactgccccttttcctgtgaaacacaagcttggagcatagctacgattctcgagacgctttacgacctctag

SEQ ID NO: 4188 - DNA, 4551 bp, Artificial Sequence
  Description of Artificial Sequence: Synthetic coding sequence
atggctcctatcctgtctattaacctctttattgggtacgagctgcagttcagattggggccaacgctccaggggaaggctgtaacagtctacaccaactacccctttccgggagagacatttaatagagagaagttcagatcgctggattgggagaatccaactgaaagggaagatgattcagataagtactgcaagttgaacctccagcagtccggctccttccaatactactttttgcaggggaatgagaaatccgggggtggatacattgttgtggaccccatcctgagggtgggcgctgataaccacgtgctccctctggactgcgttacactgcaaacttttctggcgaagtgcttagggccatttgacgagtgggagtctagattgcgtgtggccaaagagtcaggatataacatgatccacttcacacctctgcaaacccttggcctaagccgcagctgttacagcttggccaaccagttggagctgaatcctgacttcagtaggcctaacaggaagtatacctggaatgatgttggacagcttgtagaaaaactgaaaaaagaatggaacgtgatttgtattacagatgtcgtctataaccacacagccgcaaactcaaaatggatccaggagcatcccgagtgtgcttacaacttagtgaacagccctcacctgaaaccagcgtgggttctcgaccgggcactttggcgcttttcctgtgacgtcgcagaaggcaaatataaggaaaaaggtatccctgcgctgatagaaaatgaccatcatatgaatagcatcagaaaaattatctgggaagacatttttccaaagctgaagctctgggagttttttcaggtggacgtgaacaaggccgtcgagcaattcagaagattattaacccaagaaaacagacgtgtgaccaaaagcgacccaaatcagcacttgacaatcatccaggatcctgagtatcgcaggtttgggtgcacagtcgacatgaatatcgccttgacaactttcattccgcacgataaagggcctgccgctatcgaggaatgttgtaactggttccacaagaggatggaggagctcaatagcgaaaagcaccgtcttattaactatcaccaggagcaggccgtgaattgcctcctggggaatgtgttctacgagcgacttgcgggtcatggccctaagctgggccctgtgacccgcaagcatcctctggtgacgcgatacttcactttcccttttgaagagatcgacttctctatggaggaatccatgattcacttgccaaacaaagcttgttttctcatggcacacaacggctgggtcatgggagacgatcccctccgtaacttcgcagaaccagggtcagaggtatacctgcgaagggagttgatttgctggggagattctgtgaagttgagatacggaaataagcccgaggactgcccgtacctttgggctcacatgaaaaagtacactgagataaccgcgacctatttccaaggagtgagactggacaattgccactcgactccacttcatgtcgctgagtacatgcttgacgcggctaggaacttgcaaccaaacctctacgtagtggcagagctgtttaccggaagtgaggatctcgacaacgtgttcgtgacacgtctgggcatttcgagcctgatacgcgaagccatgtcggcctacaatagccacgaggagggcaggctggtctatcgctatgggggtgaaccggtgggaagtttcgtgcagccatgcctgcgccctctaatgccagccattgctcatgctctttttatggatatcacccacgacaatgaatgtcctatcgtccaccgctctgcctacgatgctctaccttccaccaccatagtttctatggcttgttgcgcttctgggagcacacggggatacgatgaactggtgccacaccagatttctgtggtatccgaggaacggttctacacaaaatggaaccctgaggcgctgccgagtaataccggggaggtgaatttccaaagtggaattattgctgcaaggtgcgccatctccaaattgcaccaagaattgggggcaaagggttttatccaagtgtatgtagaccaggtggatgaggatatcgtagctgttaccaggcacagcccctccattcatcaaagcgtggtcgctgtatctagaaccgccttcaggaaccctaaaacctctttctactctaaagaggtgccccaaatgtgcatcccgggaaagatcgaggaggtggtcctagaggcacgcaccattgaaaggaataccaaaccgtaccgaaaggacgagaattccattaatggcacacctgatatcaccgtcgagatccgagaacatatccagctcaatgagtctaaaattgtcaaacaggccggtgtcgccactaagggacctaatgagtacatccaagaaatcgaatttgaaaacctttcccccggatcagtgattatttttagagtttccttagaccctcacgcccaagtggctgtggggatcctgcgaaatcatctcacccagtttagtccgcactttaagagcggttctttagccgtagacaatgccgacccgatccttaaaattcccttcgcaagcctcgcctcccgcttgaccctggctgagctcaatcagatcctttacagatgtgagtcagaggagaaagaagacgggggaggctgctacgatatacccaactggtcagctctcaagtacgcaggtttacagggcttaatgagtgtgttagctgagatccgtccaaaaaatgatctcggccaccctttttgtaataacctgagaagcggcgattggatgatcgattacgtcagcaacagattgatctcaaggtcagggacaattgcagaagtgggcaagtggctccaggcaatgtttttttaccttaagcagatcccaagatacctcatcccatgctacttcgacgccatcttaattggagcctatactactctgctggacaccgcatggaaacagatgtcctctttcgtccagaatggatcgacattcgtgaagcacttgtcacttggatccgtccagctctgcggagtggggaaatttccctccctccccattctgtcccccgcacttatggacgtgccctatcgactgaacgagataactaaggaaaaagagcagtgctgcgtcagtctcgcagccggactgccacacttttctagcggaatcttcagatgctggggtcgggatacttttatagcattgcgcggtatccttcttattaccggtagatatgtggaggccagaaacatcattctggcgttcgccggaaccttgagacacggcctgatcccaaaccttctaggcgaggggatttatgccaggtataattgtagagatgcagtgtggtggtggcttcagtgcattcaggactactgtaagatggttcctaatggcctggatatcctgaaatgccctgtatcgagaatgtaccctaccgatgacagcgcccctctgcccgctggcactcttgatcaacccttgtttgaggtaatccaagaggctatgcagaaacatatgcaggggatccagtttagggaacgaaacgctggtccacagattgataggaacatgaaagatgaagggttcaacatcaccgcaggagtcgacgaagagaccggcttcgtttatggtggcaatcgttttaactgtggaacctggatggataagatgggagaaagcgacagggctagaaatagagggatacctgcaacccccagggacggatctgccgtggaaatcgtgggcctgagcaaatccgccgtacgctggctcctggagttatctaagaagaatatcttcccgtaccacgaagtaaccgtgaaaaggcatggcaaagcaatcaaagtgtcatacgacgagtggaacaggaaaatccaagataacttcgaaaaactttttcatgtttctgaggacccctccgatctgaatgaaaaacatcctaacttagtccacaagcgcggtatctataaagattcctacggcgctagttctccctggtgtgattaccagcttcgacctaattttaccattgccatggtggtagctccagagctgtttaccacagagaaagcctggaaggccctcgagattgccgagaaaaagttactggggcctcttggaatgaagacactggatcccgacgatatggtatattgcggtatatacgataacgcactagacaacgacaattacaatctggcgaaaggcttcaactaccaccagggccctgagtggttgtggcctatcgggtactttctgagggccaaattgtatttttcacggctgatgggcccagaaactacagcgaaaacaatagtgcttgtgaagaatgtgctcagccggcactacgtccatcttgagaggtctccgtggaagggattgcctgagctgaccaacgagaatgcacagtattgccctttcagctgtgaaacgcaggcctggagcatcgctacaattcttgagacactgtacgatctgtag

SEQ ID NO: 4189 - DNA, 4548 bp, Artificial Sequence
  Description of Artificial Sequence: Synthetic coding sequence
atgtcgctgctcacgtgcgccttctatctcgggtacgagctccagttccgactcgggcctactcttcaggggaaagctgtgacagtttacactaactacccgttccccggagagacctttaacagggagaaatttcgttcattagactgggagaacccgacagagcgggaggacgattcggataaatattgtaagctaaacctgcagcagtccgggtctttccaatactacttcctgcagggcaatgagaaaagcggcggtggatacatagtggttgatccaatcttgcgggtgggagccgataaccacgtattaccgctcgattgtgtgactttacagactttcctggctaagtgcttgggtccatttgatgagtgggagtccaggctccgcgttgctaaggagtctggatacaatatgattcactttacccctctgcagacccttggcctgagtcgaagctgttacagcctggccaaccaactggagctcaatccagacttcagccgccctaaccggaagtatacgtggaacgacgtgggccaactggtggagaagcttaagaaggagtggaatgtgatttgtatcactgatgtggtatacaaccacaccgccgctaacagcaaatggatacaggagcatccagaatgcgcttataatctagtgaacagtccgcatctcaaaccagcctgggtgctggaccgggctctatggaggtttagttgtgatgtggccgagggaaaatataaagagaagggaatacccgctctcatcgagaacgaccaccacatgaatagcatcagaaaaataatctgggaagatatctttccgaaattaaaattgtgggagtttttccaggtggatgtgaataaggctgtggagcagtttagaagactgttaactcaggaaaacaggagagtcaccaaaagtgaccctaaccagcatctgacaattatccaagaccctgagtacaggcggtttggttgtaccgtggacatgaacatagcgttaaccactttcattccccacgacaagggtccagctgcgatagaggagtgttgtaattggtttcacaagaggatggaggagctgaattctgaaaaacaccgccttattaattaccatcaggaacaggctgtcaactgcctgctgggcaatgtgttttacgagcggttggccggtcacgggcctaagctgggtcctgtgacacgcaaacacccccttgtgacccgttattttacatttcctttcgaggaaattgatttttccatggaggaatccatgattcacctgccaaacaaggcctgctttctcatggcccataatggctgggtgatgggagatgaccccctgagaaattttgcagaacccggaagcgaagtttacttgcgccgtgagctgatctgttggggggacagcgttaagcttaggtacggcaataagccagaagattgcccctacctgtgggctcatatgaagaaatatacggaaattaccgccacatactttcagggagttcgtcttgacaattgccatagcactccactacatgttgcagagtatatgctggatgcggcacgcaatttgcaaccaaacctgtacgtggtggccgaattgtttacggggtcggaagaccttgacaatgtttttgtcacgcgtctaggaatcagctccttaattcgggaagctatgagtgcttacaactcacatgaggagggcaggttggtctaccgctacggcggtgagccggtgggctcattcgtgcagccttgtctgagaccactgatgccggcaatagcacatgcactgttcatggacatcactcacgataatgagtgccccatcgtgcataggtctgcttacgatgcactaccttccacaactatcgtgagcatggcctgttgcgcgtccggcagtaccagaggatacgatgaactggtccctcatcagatctctgtcgtaagcgaggagcggttctacacgaagtggaatccagaagccctgccatccaatactggtgaggtaaactttcagtccggaatcatcgccgctcggtgtgcaattagcaagcttcaccaggagctgggagcgaaaggatttatccaggtttacgtggaccaggttgatgaggatattgtcgctgtaactagacacagccccagcatccaccagagcgtggtggcagtctctagaactgcatttagaaaccctaagactagtttttactccaaagaggtccctcagatgtgtatccctggtaaaattgaagaagtagttctggaggctcgcactatcgaacgtaatacgaagccttatcgcaaagacgaaaatagcatcaacgggaccccagacattactgtggagattcgcgagcatatccaattaaatgaaagcaaaattgtgaagcaggctggggtcgcaacgaaggggccaaatgaatacattcaagagatagagtttgaaaacttgtctcctggatcagtgattatctttagggtgtcactggacccccatgctcaggttgcagtgggtattctgagaaaccacctcacgcagttctcgcctcatttcaaaagcggaagcctggccgtggacaacgccgaccccattctgaagatcccgttcgcatcattggccagtcgtctgactctcgcagaactcaatcagatcctctatagatgcgaaagcgaggaaaaagaggacggtgggggttgctacgatatcccaaactggagcgccctgaaatatgctggtcttcagggactcatgtcagtcctcgccgaaattcggcctaaaaacgatctcggacatcccttttgcaacaatctaagatccggtgactggatgattgactacgttagcaatcggctgatcagtcggtcaggcacaatagccgaagtaggcaagtggctgcaggccatgttcttctacctgaaacaaattcctcgctacctaatcccgtgttactttgacgccattttgattggagcctacactacactgctggatactgcttggaagcaaatgagcagcttcgtgcagaacggtagcacattcgtaaagcacctgagtctggggtccgtgcagctttgcggggtaggtaagtttcccagtctgcctattttgagccccgcactgatggatgtaccctaccgcctcaacgaaatcactaaagagaaagaacagtgctgcgtgtccctcgccgctggtctccctcacttctcctccggtattttcagatgctggggtagagatacctttatcgcactgcggggtatattgttgataaccgggaggtacgttgaagctaggaatataattctggcttttgctgggacattgaggcatggactgatccccaacctgctgggcgagggaatttatgcaagatacaactgccgggatgcagtctggtggtggcttcagtgtatccaggactattgtaaaatggtacccaacggcctcgacattctgaagtgtccagtcagtagaatgtaccccaccgacgactcagctcctttgcctgccggaactctggatcagccccttttcgaagtgattcaggaggcaatgcagaaacatatgcaggggatacaattccgcgagcgcaatgccggtccccagatagataggaacatgaaagacgagggatttaatattacagccggagtggacgaggaaaccggtttcgtgtatggtggcaataggtttaactgcgggacttggatggacaaaatgggcgagtcagaccgcgctagaaaccggggaattcccgcaactcctcgcgacgggagcgccgtggaaattgtaggactatccaagagtgccgtccgttggctgctggaactgtccaagaaaaacatcttcccgtaccatgaggttacagtgaaaagacacgggaaggcaataaaggtcagctacgacgaatggaaccgcaagattcaggataactttgagaagcttttccatgtatcagaagatccatcagacctaaacgaaaaacatcccaatctggtccacaagcgcggaatctacaaagactcttacggagcgtcctctccctggtgcgactaccaacttcgcccaaacttcaccatcgctatggtggtggccccagagttatttactaccgagaaagcctggaaagcactggagatcgcggagaaaaaactgttggggcctttaggtatgaagacactcgatccggatgatatggtgtattgtggcatctacgacaatgcacttgataatgacaactataatctggctaaggggttcaactatcaccagggacccgagtggctgtggcccatcggatatttcctcagagctaaactgtacttctcaagactcatgggacccgaaactacggcgaagaccatcgtattggttaaaaatgtcttgagcagacattatgttcacctggagcgctctccatggaagggtttaccagaattaacaaacgagaacgcccagtactgtcccttttcttgcgagacgcaagcttggtccattgccactatcctggagacactctatgatctgtag

SEQ ID NO: 4190 - DNA, 4599 bp, Artificial Sequence
  Description of Artificial Sequence: Synthetic coding sequence
atggggcactccaagcagattcggatccttctgctgaatgagatggagaaattggagaagacgctgttcagactggaacaggggtacgaactgcaattcagactcggtcccactttacagggcaaagcagtgacagtgtacaccaactacccgtttcccggagagacgtttaatagggagaaatttcgttccctcgactgggagaaccccaccgaaagagaggacgacagcgacaagtattgcaagctgaatctccagcagtccggctcctttcagtactactttctccaaggcaatgaaaaaagcggaggtgggtacatcgtggtagatccgattttgcgagtcggcgctgacaatcatgtgttgcccctcgattgtgtcaccctgcaaacttttcttgctaagtgcctgggaccattcgatgagtgggaatctcgtttgagggtcgctaaggagagcggatacaatatgattcattttacaccgctccagacacttggactcagcagatcttgttactcccttgccaatcagctggagctgaatcctgatttttcaagacctaaccggaagtatacgtggaacgacgtggggcagctcgttgagaaactgaaaaaagagtggaacgttatctgcattacagatgtcgtgtacaaccatacagcagccaactccaagtggatccaagagcacccggagtgcgcttataatctggttaattctccacatctgaagcccgcatgggtccttgacagggctctctggaggttctcatgcgatgtggctgaggggaaatataaagagaagggtatccctgccctgatagagaacgaccatcatatgaactctattaggaaaattatctgggaggacatttttccaaaactaaagttgtgggagttttttcaggtcgacgtaaataaagctgtggaacaattccgaaggctgctgacacaggagaacaggagagtcaccaagagcgatccgaatcagcacctgactattatacaagatcccgagtataggcgatttggatgcacagtggatatgaatattgctctcacaacctttatcccccatgataaaggacctgctgccatagaggaatgttgtaactggttccacaaacgtatggaggaactgaattcagagaagcatcgtctcatcaattatcatcaggagcaggccgtaaactgcttgctgggcaatgtcttttacgagagactcgcgggacacggacccaagcttggaccagttactagaaaacatccactagtcacacgctacttcacgtttccattcgaggagattgatttctcaatggaagaaagcatgatacacctgccaaataaggcctgcttcctgatggctcataacggatgggttatgggagacgaccccttacgtaacttcgcagaaccgggttctgaagtgtacctgagaagagagcttatatgttggggtgactcagtcaagctgaggtatggaaacaaacctgaggactgtccttacctctgggcccacatgaagaaatacacagagatcacggctacatacttccaaggtgtgcgactggataattgccactctacccccctacacgtggccgagtacatgctagatgctgctagaaatctgcagcctaatctatatgtggttgccgaactatttacaggcagcgaggacttagataatgtcttcgtgactcggctgggcatctcatccttaatacgcgaagccatgagcgcctacaattctcatgaggaagggaggctggtataccgctatggaggggaacccgtggggtctttcgtacagccctgcctacgaccgttaatgccagcaatcgcccatgctctcttcatggacataactcatgataatgagtgtccgatcgtccaccgatcggcctatgatgctcttccctccacgactattgtgtcgatggcctgttgtgcgtccgggtccacaagagggtatgacgaacttgtccctcatcaaatttcagtagtctctgaggagcggttttacacaaaatggaaccccgaagccttaccaagcaatactggagaagtaaactttcagtctggcattatagccgcaagatgtgccatctctaagcttcaccaggagctgggcgcaaaagggtttattcaagtctatgttgatcaggtggacgaggacatcgtggcggtaacgcgacacagcccttccatccaccagagtgtagtggcagtatcccggaccgcttttcgcaatcctaagaccagtttctactcgaaagaggtaccccagatgtgcatccctggaaagattgaagaggttgttttagaagctagaaccattgaacggaatacgaagccctataggaaggatgagaacagtattaatggaactccggacataaccgtggagattagggagcatatccagcttaatgagtcgaagatcgtgaagcaggctggagtggcaaccaaaggccctaacgaatacattcaagagatcgagttcgagaacctcagccccggttctgtgattattttccgggtatccctggatcctcatgcacaggtcgcggtgggcatcctccggaaccatctcacccagttcagcccgcattttaagtccggtagcctggcggtggataacgccgatcccatcctgaagattccattcgcgtcgctcgcatcacgcttgacactggccgagctgaatcagattctctacagatgcgagtcggaggagaaggaggacggaggcggatgctatgatattcccaactggtccgctcttaagtacgctggacttcagggcttgatgtctgttctggctgagatccggcctaagaatgacctaggtcatcctttttgtaacaatcttaggagcggcgattggatgattgattatgtgtcaaataggctgatttcccgctcaggaactatcgccgaggtcgggaaatggcttcaggccatgttcttttacctgaagcagatcccacgttatctgattccttgttatttcgacgcgattcttattggggcttacacgactctcctggataccgcatggaaacagatgagtagttttgtgcagaacggttcaacattcgttaagcacttgagcctcggcagcgtccagctgtgtggcgtgggcaagttcccaagtctccctattctgtcccccgctctgatggatgttccatacaggcttaatgagattactaaggagaaagaacagtgctgtgtgagtttggccgcaggtctgccacacttctcctcggggatttttagatgctggggcagagacacattcatcgcactgcggggtattttactgataacagggaggtacgttgaggctcgaaacataattctcgcattcgccggtacactgaggcatgggctcatacctaacctgctgggagagggcatttatgcacggtataattgccgggacgccgtttggtggtggctccagtgcattcaggactactgtaagatggttcctaatggtctggacattctcaagtgtccagttagccgcatgtaccctaccgatgattcggcaccgcttccagcagggaccctcgatcagcccctcttcgaggtaatccaggaagcgatgcagaaacatatgcagggtattcagtttcgggaaaggaatgccggacctcagatcgatcggaacatgaaagatgaggggttcaatataacggcgggagtggatgaggagaccggattcgtctacgggggtaacagattcaattgcgggacttggatggacaagatgggcgaatccgaccgcgctcggaaccgcggaatacctgctactccccgtgatggaagcgccgtggagattgttgggcttagtaaaagcgcagtccggtggctgcttgaattgagtaaaaagaacattttcccttaccacgaagtgacagtcaagcgacatgggaaagctattaaagtgtcttacgatgagtggaaccggaagatacaggataacttcgaaaagctttttcacgtatccgaagatccgtcagatctcaacgagaaacaccctaacctcgtgcataagcggggaatttataaggacagctacggtgcatcctctccgtggtgcgattatcaactcagacccaactttactattgccatggtggtggctccagagctattcactacggagaaggcctggaaagctctggagatcgcagaaaagaaactcttgggcccactgggcatgaaaactctggacccagacgacatggtgtactgtggaatctatgacaacgctttagataatgacaactacaatctggccaaagggttcaactaccaccagggcccagaatggctgtggccaatcggatatttcctgcgggctaagttgtacttctcccggctgatgggtccggaaactaccgctaaaaccatcgtcctcgttaagaacgtgctatcaaggcactacgttcatcttgagagatcaccatggaagggcctgccggaactgactaatgagaacgctcagtattgtccattcagttgtgagacccaggcctggtcaattgctacaatcctggagactctctacgatttgtag

SEQ ID NO: 4191 - DNA, 4551 bp, Artificial Sequence
  Description of Artificial Sequence: Synthetic coding sequence
atggctccaatactctccattaacctgtttataggttatgaattgcagttccgactggggccaacactccaagggaaggcagtgacggtatataccaattaccccttccctggggaaacattcaaccgcgagaaattcagaagtctagattgggaaaaccctacagaacgcgaagacgattcggataaatactgcaagctcaacttacagcaatctggctcatttcaatactactttctccaagggaacgaaaagagcgggggtggatacatcgtcgtcgatccaatcctgcgggtcggagccgataatcacgtgttgcctctcgactgtgtgacccttcagacgtttctggccaagtgtttaggacctttcgacgaatgggaatctagactcagggtcgctaaggagagtgggtacaacatgatccactttaccccgctgcagaccctgggtttatcacggtcttgctactccctggctaatcagctggagctcaaccccgatttcagcaggccaaatcggaagtacacctggaacgatgtcggccagcttgtggagaagttgaaaaaagaatggaacgtgatttgcattacagatgtggtctacaatcacacggctgctaactccaagtggatacaggagcaccccgaatgcgcttacaacctggtgaatagtccacacctgaaaccagcctgggtgctcgacagggccttgtggagattctcctgtgacgtcgcagagggtaagtacaaagagaagggcataccggcactaatcgaaaatgaccaccacatgaatagcatcaggaaaatcatttgggaggacatcttccctaagttgaagttatgggagtttttccaggtcgacgtgaataaggctgtcgagcagtttaggcggctcttaacacaggagaaccgccgtgtgacaaagtcagatcccaatcaacatttaaccattatccaggatcccgaataccgcagatttgggtgcacggtggatatgaacatcgctcttactacctttatacctcatgataaaggaccagctgccattgaagaatgctgcaattggtttcataagagaatggaagagcttaattccgaaaaacaccggctgattaattaccaccaggagcaggcagtgaactgccttctgggcaatgttttttatgaacgcttggcgggacatggcccaaaattgggcccagtgaccagaaagcacccattagtaacccgctatttcacctttccttttgaggaaatagattttagcatggaggagtccatgattcacctcccaaataaggcttgtttcttgatggcccataatggctgggtgatgggcgatgacccgctgcgaaattttgcggagcctggctccgaggtctatctgcgccgtgaactaatttgctggggagactctgtcaagctcagatacggcaacaaacccgaggattgtccctacctgtgggcccacatgaaaaagtataccgagattacagcgacttatttccagggtgtccggctcgacaattgccactctaccccactgcatgtcgccgaatacatgttggatgccgcacggaacctgcagcctaatctctatgtcgtggctgagctgtttacaggcagcgaggacttagacaacgtgtttgtcacacgtcttggaattagcagcctgattcgagaggccatgagcgcatataattcgcacgaggagggcagacttgtctatcgctacggaggcgaaccagtaggctccttcgtgcaaccatgcctccgcccactaatgcctgccatcgcacacgctttgttcatggatatcacacacgataatgaatgccccatcgtgcatagatcagcatatgatgcactcccgtccaccaccattgtctcaatggcatgctgcgcttcaggctctacgagaggttatgacgagctggtcccccatcaaatcagcgtggtgtctgaagaaaggttctacacaaaatggaatccagaagcccttcccagtaacaccggggaagtcaacttccagagtggcatcatagctgcacggtgtgcgatatcaaagctgcaccaggagcttggcgcaaagggttttattcaggtttacgtcgaccaagtcgatgaggatatcgtggctgtgacacggcactctccctcgattcaccagtctgtcgtggccgtctccagaacagcctttcgcaatcccaagacaagcttttactctaaggaggtgccacagatgtgtattccgggtaagatagaggaggtggtactcgaggccaggacgattgaaagaaacaccaagccatataggaaggacgaaaactccattaatggaacacctgacatcacagtcgagatccgcgaacatattcagcttaacgaaagcaaaatcgttaaacaggcaggagtggcaacaaagggcccaaacgagtacatccaggagatagaatttgaaaacctctcacccggttcagtcattatctttagagtgtctctggacccgcatgcccaagtagccgtgggaatcctgaggaaccacctgactcagtttagcccacatttcaagtcaggaagtctggccgtagataatgcagatcctatcttaaagatccccttcgcatcactggctagccggctgaccttagccgagctaaaccagatcttatacagatgtgagagcgaggaaaaggaggacggaggaggttgttacgacattcctaattggagtgcactcaaatacgctggcctccagggactgatgtcggtactggccgagataaggcctaaaaacgatctgggacatcctttctgtaacaacctcaggtctggcgactggatgatcgactatgtgagcaatcgactaatctcaaggtcgggaactatcgcagaggtgggaaagtggctgcaggcaatgttcttctacctcaagcagattcctaggtatcttatcccctgctactttgacgccatattaatcggagcctatactacactactcgacacagcctggaaacaaatgtcttcctttgtccagaacgggtccacgttcgtgaagcacctgagtctgggtagcgtgcaactgtgtggagtcggaaaattcccctctcttccaattctgtcaccagcgctaatggatgtgccgtatcggcttaacgaaattactaaggagaaggaacagtgttgcgtgtcactcgcggctggcctgccacacttctccagtgggatcttccgctgctggggtcgggacacatttatcgccctgaggggcattcttctgattactggaaggtacgtggaggcgagaaatatcatcttggcattcgcaggaaccctccgtcacggcctcatccctaatctactgggagaaggcatctatgcaagatataattgcagggacgccgtttggtggtggctgcagtgcatacaggactattgcaagatggtgcccaacggtcttgacatattaaaatgtcctgtgagtaggatgtatcctactgatgattccgcaccactgccagcaggcacgctggaccagcctctcttcgaggttatccaggaagcaatgcagaaacatatgcagggaatccagttccgagagaggaacgctggccctcagatagacaggaatatgaaggatgagggctttaatataactgccggtgtggatgaagaaaccgggtttgtttacggtgggaacaggtttaattgcggaacctggatggacaagatgggtgagagtgaccgtgcacgaaacaggggaatacccgctacccccagagatggatccgccgtcgaaatagtgggcctgtccaagagcgccgtgaggtggctcctggaactttctaaaaagaatatatttccttatcacgaagtgaccgtcaaacgccatggaaaagccatcaaggtgtcctacgacgagtggaataggaaaatccaggacaattttgagaaactgttccacgtatcagaggaccccagtgatcttaacgaaaaacaccctaacttggtccacaagagggggatctataaggatagctacggcgcaagctcaccgtggtgcgactatcagctgaggcctaatttcactatagccatggtggtggccccagagctcttcacaaccgaaaaggcgtggaaagctctggagatcgctgaaaaaaagcttcttggtcctttgggaatgaaaacgctggatccggatgacatggtctactgtgggatctacgataacgccctagataatgataactataacctggcaaaggggttcaattaccatcagggaccagaatggttgtggccaattgggtacttcctgagggccaaactttattttagccgcttgatgggcccagagacgaccgctaagaccatcgtgctggtgaagaatgtgttgagccgccattatgttcacttggagaggtccccctggaaagggttacctgaactcactaatgaaaacgctcagtattgtcctttttcgtgtgagacccaggcatggagcatcgccaccatcctggagactctgtacgatctatag

SEQ ID NO: 4192 - DNA, 4599 bp, Artificial Sequence
  Description of Artificial Sequence: Synthetic coding sequence
atgggccacagcaaacagataagaattctgctgctaaatgaaatggagaaactggaaaaaactttgtttcgccttgagcagggctacgaattgcaatttcggctgggacccacactccaaggaaaggctgtgaccgtctacactaattacccattcccaggagagactttcaatcgggagaagtttcgatccctggattgggaaaacccaactgaaagggaggatgattcagataagtattgcaagctaaatctccagcagtccgggagttttcagtattatttcctgcaggggaacgaaaagagtggagggggttacattgtcgtcgatcctattctgcgagtgggcgcagataaccacgtgctcccccttgactgtgtgaccctacagaccttcttagcaaagtgcctcgggccattcgacgagtgggaaagccgcctgcgcgtagccaaggaatccggttataacatgatccactttactcctttgcagaccctgggactgagtcggagctgctatagccttgctaaccagctcgaattgaacccagacttctcgcggcctaacaggaagtacacttggaacgatgtgggccagcttgtagaaaagttgaaaaaagagtggaatgtaatttgcatcaccgatgttgtctacaatcatacagccgcaaacagcaaatggatacaggagcatcccgaatgtgcctacaatctggtcaattcgccccatttaaaacccgcatgggtcctcgatagagccttatggaggttttcatgtgacgtggctgaggggaagtataaagaaaaagggattccagccctcattgaaaatgatcatcatatgaatagtatcagaaaaattatctgggaggacatttttcctaaattgaaattgtgggaattttttcaagttgacgtgaacaaagccgtggagcagttccgtagacttctaacccaggaaaaccgccgagtgacaaagagcgatcccaaccagcacttgacgatcattcaggaccctgaatatagacggttcggctgcactgtggatatgaacattgcccttaccacatttatcccacatgacaaaggccctgccgcaatcgaggagtgctgcaactggtttcacaaacggatggaagaactgaatagcgagaagcaccggttaatcaattaccaccaggagcaggccgtgaattgtttactgggtaacgtattttacgaaagattggcaggacacggcccaaagctgggccctgtcaccagaaaacacccgctggttacgagatattttacgttcccgttcgaggagattgacttcagcatggaggagtccatgatccacctccctaataaggcatgcttcctaatggcgcacaatgggtgggtgatgggcgacgacccactgaggaatttcgctgaaccaggctcagaagtttatctcaggcgtgaactcatttgctggggagactcagtgaaactgcgatacggaaataaaccagaggattgtccttacctgtgggcccatatgaagaaatataccgagataactgctacatacttccagggcgtgcggttggacaattgtcactctactcccttgcacgtggcagagtatatgctggacgctgccagaaatttgcagcccaacctgtatgtggtggccgagctgttcactggcagcgaggacctggacaacgtgttcgtgacaagactgggcatttcttcactgattagggaggctatgagcgcctacaactcccatgaggagggacgactggtgtataggtatggcggagagccagtgggatcgtttgttcagccctgcctcaggcctttaatgcccgcaattgcgcacgctctctttatggatattactcacgataatgaatgtccgatagtgcaccggtctgcctacgacgctctgccatcgaccaccattgtctctatggcttgctgcgcctcgggcagtactcgtgggtatgacgagcttgtccctcaccagatctccgtcgtgtccgaagagcggttctataccaagtggaatcccgaggcattgccaagcaacactggggaagtgaatttccaatcagggataatcgccgcaaggtgcgccatttcaaaactccatcaggaattgggggcaaaaggcttcattcaggtatatgttgaccaggtagatgaagacatcgtcgccgtgacgaggcactcgccatctatccaccagtcagtggtggcggtttccagaactgccttccggaaccccaagacatctttctatagcaaggaggtgcctcagatgtgcattccaggaaagattgaagaggtggtcttagaagcacggaccatcgagcggaatacaaagccctacagaaaagacgaaaattccatcaacggtacacccgacatcacagtagagatcagggagcatatacaactgaatgagtccaaaatcgtaaaacaagccggagtggcaactaaaggtcctaatgagtatatacaggaaatcgaattcgaaaacttgagtcccggtagcgtgattatcttcagggtctcgctggacccccatgctcaggtggcggtggggatcttgcgaaatcatctgacccagttcagtccccacttcaagagtgggtctttggcagtggacaacgccgatccaatccttaaaatacccttcgcctccctcgcatccaggcttactcttgccgagctgaaccagatcctttacagatgtgaaagcgaggagaaggaagacggaggcggatgttatgacatcccaaattggtccgcccttaaatacgccggtctccagggactcatgagtgttctggcagagatcaggcctaagaacgatcttggacaccctttctgtaataatttgcgcagtggagattggatgatcgactacgtcagcaaccgccttattagcagaagcggaaccatcgctgaggtggggaaatggctccaggccatgttcttctatctgaaacagatccctcggtacttaataccttgttattttgacgccattctgatcggtgcctacacgacactccttgatactgcttggaagcagatgagtagctttgtgcaaaacggctccacatttgtcaaacacttgagtctgggctccgtgcaactatgcggcgtggggaagttcccatccctgcccatcttgagccctgctttgatggacgtgccatacaggctgaacgaaatcactaaagaaaaggaacagtgttgtgtaagccttgccgctggcttaccacatttttcttccggcattttcagatgttggggccgagacacgtttatcgccctaaggggaattttgttgattactggacgctacgtcgaggctcgcaacatcattctcgcctttgctgggaccctgaggcatgggctgattcccaatctgcttggcgagggcatttacgctagatacaattgccgggatgcagtgtggtggtggttacagtgcatccaggactactgcaagatggttcctaatggtttagatattctgaagtgcccagtgagtcgcatgtacccaacagacgacagtgccccattgcctgctgggactttggatcagcctctcttcgaagtgattcaggaagcgatgcagaaacatatgcagggtatccaattccgtgagaggaatgccggaccgcagattgatagaaacatgaaagatgaaggcttcaatatcacggctggggtggatgaggaaaccggattcgtctacggtggtaacaggttcaattgtggcacatggatggacaaaatgggagaatcggatcgagcacgtaatcgcggtatcccagctactccacgggacggatctgctgtagaaattgtaggactgtcaaaaagcgcggtgaggtggctcctcgaactctccaagaaaaacatttttccgtaccacgaggttacagtgaagcggcatggaaaggccatcaaagtctcgtatgatgagtggaataggaagatccaggataactttgaaaagctgttccacgtctcagaagacccgtcagacctcaacgaaaagcatccaaatctcgttcataagagaggaatatacaaggattcttacggtgcatcaagcccatggtgcgactaccagctgagaccgaattttactattgcgatggttgtggcgccagagctgttcaccacggaaaaagcctggaaggcactcgagatcgcggagaaaaagttgctagggcctttagggatgaagaccttagatcctgacgacatggtttactgtggcatctacgataatgcgctagacaacgacaactacaacctggcgaagggctttaactatcaccagggaccagaatggctttggccgattgggtattttctaagggctaagctgtatttctcacgtctgatgggaccagagacaacggccaagacaatcgttttggtgaagaatgtgctgtccaggcattatgtgcatctagagaggtctccttggaaaggactgcctgagcttactaacgagaacgcacagtactgcccattcagttgtgagacacaagcttggagcattgcaactattttagaaactctctatgatctctag

SEQ ID NO: 4193 - DNA, 4599 bp, Artificial Sequence
  Description of Artificial Sequence: Synthetic coding sequence
atggggcattctaagcagatccggatcttgttactaaatgaaatggaaaaactggaaaagactctcttcaggctcgagcaaggttacgagcttcagtttcgcctaggtccaacccttcagggcaaggcggttacagtgtataccaattatccattccctggggagacatttaatcgtgagaagtttcgctctttggattgggagaacccaaccgagagagaagacgactctgacaagtattgtaagctgaatctccagcagagcggctcctttcagtactattttctccaggggaatgagaagtctggcggtggatatatagtcgtggaccctattttgcgggtgggggcagacaatcatgttctgccccttgactgcgtgactttacaaacttttctggctaagtgcctcggaccgtttgacgagtgggagagccgccttcgcgttgctaaggaaagcggatacaatatgatacatttcacaccccttcagacgctgggactgtccagatcatgctacagcctcgcaaatcagctggaattgaaccctgatttctccagaccaaatagaaaatacacatggaatgatgtgggccagctggtcgaaaagctgaagaaggagtggaatgtcatttgcataactgatgttgtctacaaccacaccgctgctaactcaaagtggatccaggaacatccagaatgtgcctacaaccttgtgaactctcctcacttgaagcctgcctgggtccttgaccgtgcgctctggcgattctcttgtgacgtggcagagggcaagtacaaggaaaagggaattcctgcgctgatcgagaatgaccaccatatgaacagtattcggaagatcatatgggaagacatcttccctaagctgaagctgtgggaattcttccaagtcgacgtgaacaaggccgttgaacagtttcgacggttgttgacacaggaaaatagacgggttactaaatctgaccccaatcaacacctgacgataattcaggatcccgaatatcggcgtttcggctgtacagtcgacatgaatattgctctgaccacattcattcctcatgacaagggtcctgctgccattgaggaatgttgtaattggtttcacaagcggatggaggaattaaattccgagaagcacagattgatcaactaccaccaggagcaggccgtgaactgcttactgggaaacgtcttttacgaaagattggcgggacatggccctaagcttggcccagtgacgcggaaacaccccttggtgacacggtatttcacatttccctttgaggaaattgatttctccatggaagaatcaatgatccatctgcctaataaggcttgcttcctgatggctcacaatggctgggtcatgggggacgatccactccgtaacttcgccgaacccggttccgaggtttatctaagacgggagttaatatgttggggggacagcgtcaagctcagatatgggaataagcctgaagattgcccgtatctgtgggctcatatgaaaaaatataccgagataacagcaacctactttcagggagtacgattagataattgtcacagcactccactgcacgtagctgagtatatgctggacgcagccaggaacttgcagcccaatttgtatgtcgtagctgagttattcaccgggtccgaggaccttgataacgtgttcgtcaccagactggggatcagttccctgatcagagaagctatgtctgcttacaactctcatgaggagggccgacttgtgtatcgctatggcggagaacccgtaggttcttttgtccagccctgcctgaggccattgatgcccgctatagcgcatgctctgtttatggatataacccacgacaatgaatgtcccatagtgcacagaagcgcatatgacgccctgccttcgactaccatagtttcgatggcctgctgtgctagcggctccacacgaggatacgatgagttagtacctcaccagatttcagtcgtctcggaagaacgcttttatactaagtggaatcctgaggcgcttccatctaatactggagaggtgaattttcagtccgggatcatcgctgccaggtgtgcgatcagtaaactgcaccaggagctgggtgctaaaggctttatccaagtctacgtggaccaggtcgacgaggatattgtagcagttacccgacattcaccgtctatacaccagtcagtggtagctgtctccagaaccgcgtttagaaatcctaaaacatcattttacagcaaggaggtgccgcaaatgtgcatccctggcaagatcgaagaggtggtgctggaggccaggacgatcgagaggaacacaaagccctatcgcaaggatgaaaattcaattaatggaaccccagatataaccgttgagatcagagaacacatccagctgaacgaatcaaagatcgtgaaacaagccggtgtggccactaaaggtcctaacgagtacattcaggagatcgagttcgagaatctaagccccggttccgtgattattttccgagtgtctctggatccccatgcgcaggtggcagtcggaatcctgcgcaaccaccttactcagttctccccgcactttaagtctggatccctagccgtagacaacgctgatccaatccttaaaatccccttcgcttccctggcctcccgcctaacccttgcagaactcaaccagattttatacagatgtgagtctgaagagaaggaagatggaggcggttgttatgacattcccaattggtcagcgctgaagtacgcaggactgcagggtctgatgtctgtcctggcagaaattcggcctaagaacgacctcggccaccccttttgtaacaacctgagatctggcgattggatgatagactacgtctccaatcgcctcatatctcgctccggtacgatcgcggaggtgggtaaatggctgcaggccatgtttttttatctgaagcagattccgcgttacttgatcccctgttactttgatgcaattctgatcggtgcatacactacccttctggataccgcctggaagcagatgagttcattcgtccagaacggctccaccttcgtaaagcacttgtccctgggatcggtgcaactgtgtggagtgggcaaatttccatccctgccaatcctatctcccgcactgatggatgtgccctaccgattaaatgagatcaccaaagaaaaagaacagtgttgcgtgtctcttgctgctggcctgcctcatttttcctcagggatcttccgctgttggggcagagatacatttatcgctctcagaggaattcttctgattacgggtcggtacgtagaggccagaaacataatccttgcgttcgccggaacattgcgacacggactgatacccaacctgctgggcgaaggaatttacgccaggtacaactgtagagatgccgtgtggtggtggctccagtgtatccaggactactgtaaaatggtgcccaacggactcgatattttgaaatgtcccgtgagtcgcatgtatcctacggatgacagtgcccctttgccggcaggcaccctcgaccagccgttgttcgaggtcatccaggaggccatgcagaaacatatgcagggcattcaattccgggaacgcaacgccggtccacagattgatcggaacatgaaggatgagggttttaatatcacggccggtgttgacgaggagacagggttcgtgtacgggggaaataggtttaactgtgggacctggatggacaagatgggagaaagcgatagggcacgcaacagggggatccccgcaacacctagggacggttctgccgtggagatcgtcgggctctcaaaatcggctgttcgttggctgctggagttatccaaaaagaatatcttcccatatcatgaagtgactgtaaagaggcacggtaaagcaattaaggtctcatacgatgaatggaatcgcaagatccaagataacttcgagaaactctttcacgtgtctgaagatccaagtgacctgaacgagaaacaccctaacctagtccataagcgtggcatctataaggattcatatggagcctcgagcccttggtgtgactatcaactgcggcctaacttcacaattgctatggtggtagctcctgaactgttcactactgaaaaggcctggaaggcgctagagattgccgagaagaaactgctggggcctttaggtatgaagaccctcgaccccgatgacatggtttactgcggtatctatgacaacgctctggacaacgacaattataacctcgcaaaagggtttaactatcatcagggccctgaatggctctggccaattggatacttcctgagggccaagctctacttcagtaggttgatgggaccagaaactaccgccaagacaatcgtgctggtgaagaacgtcctgagccgtcactatgtgcatctggagcgaagtccatggaaggggctgccagaacttactaacgagaatgcgcagtattgtcccttctcttgcgaaactcaggcgtggtcaatagcgaccattctagagactctctatgacctgtag

SEQ ID NO: 4194 - DNA, 672 bp, Artificial Sequence
  Description of Artificial Sequence: Synthetic coding sequence
atgaacaaacccctgctgtggatctcagtgctgactagcttgttggaggcttttgctcatacggatctgagtggcaaagtcttcgtcttcccgcgtgagtcggtcactgaccacgttaaccttataacccccctggaaaagcctctccagaactttacgctgtgcttccgggcttactctgacctcagccgagcgtattccctcttttcttataatacacagggacgggataacgagctgttggtgtacaaagagcgcgtcggagagtactccttatatatcggacggcacaaggtcacatcaaaggtgatagaaaagttccctgctcccgttcacatctgcgtgtcttgggaatcatcatcaggcattgctgagttttggattaatggcacccccctggtaaagaaaggcctccgacaaggctactttgtcgaggctcagccgaaaatcgtgctcgggcaggagcaggattcttacggaggcaaattcgatcgtagccagagttttgtgggagagattggagatctgtatatgtgggactctgtgttgccccctgaaaacatcctatccgcgtatcaggggacccccctcccagccaacatcctcgattggcaagcactcaactacgagatcagagggtatgttattattaagcctctggtatgggtgtag

SEQ ID NO: 4195 - DNA, 2418 bp, Artificial Sequence
  Description of Artificial Sequence: Synthetic coding sequence
atgtcgagcagctcctggctgctgctgagcctggtggccgtcaccgccgctcaatccacaatcgaggaacaggcgaagacctttttggacaagttcaatcacgaagctgaagacctgttctatcagtcctccctcgcgtcttggaattataatacgaatattacagaagaaaacgtccagaatatgaacaatgccggagataaatggtcagcctttctcaaggagcagtctacgctggctcagatgtaccccctccaggaaatccaaaatctgacagtgaagctgcagttgcaagctctgcagcagaatggttctagtgttctttccgaagataagagcaagcgcctgaacaccattctgaacaccatgtccactatttactcgaccggcaaggtctgtaatcctgacaacccacaggaatgcctcttactcgagccaggcctaaatgaaatcatggcaaattccttagactacaatgagcggctatgggcatgggaatcttggcgtagcgaagtgggaaagcaactgcggcctttatatgaggaatacgtcgtgttaaagaatgagatggccagggccaaccactacgaggactacggcgactactggcgtggggactacgaagtgaatggagtcgacggatacgattactctcgaggccaactgatagaggacgttgaacatacatttgaagaaattaaaccgctgtatgaacatcttcacgcatatgtgcgggctaagttaatgaatgcctacccatcctacatttctcctattggctgccttccagcccatctgctaggagacatgtggggaagattttggactaatctctatagcctgaccgttcctttcggacagaaacccaatatcgatgtcacagacgccatggtcgatcaagcctgggacgctcagagaatcttcaaagaagccgaaaaatttttcgtgtcagtcggcctgcccaacatgacgcaggggttctgggagaattctatgctgacggacccaggaaacgtgcagaaagcagtgtgtcaccctacggcctgggaccttggcaagggcgattttcggatcctgatgtgcaccaaagtgaccatggacgactttcttactgctcaccacgagatgggacatatccagtacgacatggcatatgcggcacagccatttcttctgcggaatggagcaaatgaagggttccacgaggccgtcggggagatcatgtccctgtcagccgctacaccaaaacatcttaagtctattgggctcctgtcccccgattttcaagaggacaacgagacggagataaatttcttactcaagcaggcacttactatcgttggaaccctccctttcacctatatgctggagaaatggagatggatggtgtttaagggcgaaatccccaaggaccaatggatgaagaagtggtgggaaatgaaacgggagatcgttggtgtggtggaacccgtcccacacgacgaaacctactgcgacccagcgtctctgttccatgttagtaatgactactcctttattcggtattacacaaggactctgtaccaatttcagtttcaggaggccctctgtcaggctgcaaagcacgagggccctctacataaatgtgacattagtaactccaccgaggcgggacagaaactgttcaacatgctgagattggggaagtcggaaccctggacactcgctttagagaacgtggtcggcgcaaagaacatgaacgttcgtcctctgctcaactacttcgagcccctgttcacctggttaaaggaccagaacaagaattctttcgtcggctggagcactgattggtccccatatgccgatcagtcgatcaaggtgaggatctctctgaaaagcgctctaggagacaaggcctatgagtggaacgacaacgagatgtatctctttaggtcctctgtggcttacgctatgcggcagtatttcctgaaggttaagaatcagatgatactcttcggcgaagaggatgttcgggtcgccaaccttaaaccacggatctctttcaatttctttgttacagcaccaaaaaacgtctcagacatcatacctcgaacagaggttgagaaggcaatacggatgagcaggtctcgcatcaatgacgcctttagattaaacgataacagcctcgagtttcttggcatccaacctaccttaggccctcccaatcaaccgcctgtgtccatctggctgattgtttttggcgtagtgatgggcgtaattgtggttggcatcgtgattttgatctttacggggatccgcgatcgcaagaaaaagaacaaggctcgctcaggcgaaaatccttacgcctccatagatatttcaaagggtgagaacaatccagggttccaaaataccgatgacgtccagacctccttttag

SEQ ID NO: 4196 - DNA, 2418 bp, Artificial Sequence
  Description of Artificial Sequence: Synthetic coding sequence
atgagctcctcctcttggctgttgctttcactggtggcagtaaccgccgcacagtccaccattgaagagcaggctaagaccttccttgataaatttaatcacgaggccgaagatctgttttatcagagctccctagcctcgtggaactataacaccaacattacagaggagaacgtacagaacatgaacaatgccggtgacaagtggtctgcttttttgaaagaacagtcaaccctcgctcagatgtatccacttcaggagattcagaacctgacagtgaagctgcagctgcaggccctgcaacagaatgggtcatcagttttgtccgaagataaaagcaaacggcttaacaccatactgaatacgatgagcacaatttatagcactggcaaggtctgtaatcccgacaatccccaggagtgtctgctgttggaacccggattaaatgagatcatggccaactctctcgactataacgaacgcttatgggcatgggaatcctggcgttcagaagtgggcaaacaacttaggccactatacgaagaatacgttgtactgaagaatgagatggctcgagctaatcactacgaagattatggagactactggcgcggagattatgaggtcaatggtgtggacgggtatgactattcccgaggacagttaatcgaggatgtcgaacacacgtttgaagagatcaaacccctctacgaacacctgcatgcttatgtgagggctaagttgatgaacgcataccccagttatatctctccaatcgggtgtctgccggctcatctgctcggcgatatgtggggacggttctggacaaatctatactctctaacggtccctttcggccagaagcccaacatcgatgtgacagacgctatggtggatcaggcgtgggacgcccaacgcatcttcaaggaggcagaaaaatttttcgtcagcgtgggactgcccaacatgacacagggcttctgggagaattcaatgctgacagaccccggtaatgtgcagaaagcggtgtgccacccaaccgcctgggatctgggaaaaggggactttcgcatcctgatgtgcaccaaggtgaccatggacgatttcctcactgcccaccatgaaatgggccacatccagtacgatatggcgtacgccgctcagccctttcttttgcgaaacggggctaacgagggctttcatgaggccgtcggcgaaattatgtccctttcggccgcaactccgaagcaccttaaatccataggcctccttagccccgacttccaggaagacaacgaaacagaaattaatttcctgctgaaacaggccttaaccattgtgggaaccctgccttttacgtatatgctagaaaaatggcgctggatggttttcaagggtgagattcctaaggatcagtggatgaagaagtggtgggagatgaagcgcgagatagtgggagttgtggaacccgtcccccacgacgaaacgtattgcgatcccgctagtttattccacgtatccaatgattactcattcatccgctattacactaggaccctctaccagtttcagttccaggaggcgctatgccaggccgctaaacatgaaggccctcttcataagtgcgacattagcaattctacggaggcgggacagaaactgtttaatatgttgagactcggcaagtcggaaccatggactctggcacttgaaaacgtggtgggggcaaagaacatgaacgtgaggccactgctcaattactttgaacctctgtttacttggctcaaagatcagaataaaaatagcttcgtggggtggtccactgactggtccccatatgcagatcagagtattaaagtgagaatttctttgaagagtgcacttggagacaaagcttacgaatggaacgataacgaaatgtacctgttccggtcaagcgtcgcttatgccatgaggcagtatttcctgaaagttaaaaatcaaatgattctctttggcgaggaggacgtcagagtggcgaatctgaagcccagaatttcattcaattttttcgtgactgctcctaagaatgttagtgatatcatccccagaaccgaggtggaaaaagcgattcggatgagtcggagtcggattaatgatgcattcaggttaaatgacaacagcctggaatttttgggcattcaacccactctcggccctcctaatcaaccacctgtgagcatctggttgatcgtgttcggcgtcgttatgggcgtcattgtggtggggatcgtgatcctgatcttcactggaattagggatagaaagaagaaaaacaaggccaggagtggggaaaatccctatgcctctatagatatcagcaagggcgaaaataaccctggatttcagaatacagatgatgtgcagactagcttttag

SEQ ID NO: 4197 - DNA, 804 bp, Artificial Sequence
  Description of Artificial Sequence: Synthetic coding sequence
atgaaggcagcagtgctcacacttgctgtgctgtttctgaccggttcacaggctcgacatttttggcagcaggacgaaccgcctcaatcaccgtgggatcgcgtcaaagatctggccacagtatacgtcgatgtcctgaaagacagtgggagagactacgtgagccagtttgaaggcagtgctcttggtaaacagctgaatctgaaactgctggacaactgggatagcgtgacttccacatttagcaaactccgcgaacagttaggcccagtcacacaggagttctgggacaacctcgaaaaagaaactgaggggttgcgccaagaaatgagcaaggatttggaggaggtgaaagcgaaggtgcagccatatctagacgattttcagaagaaatggcaagaagagatggagctctataggcagaaagtagagccccttcgcgctgagcttcaggagggggctagacaaaaattgcatgagttacaagagaagctgtcgccactgggtgaggagatgagggacagagctcgagctcatgtcgatgccctgcggactcacctcgcaccttattccgatgaacttcggcagtgtctcgctgcccgactcgaagccctgaaagaaaacggaggagcacgactcgctgagtaccacgccaaagccacggagcacttatccactctgtccgaaaaagctaagcccgcattggaagatctgaggcaggggctcctccctgtactggagtcttttaaggtgtcttttttgagcgctctggaggagtacaccaagaagctgaacacacagtag

SEQ ID NO: 4198 - DNA, 804 bp, Artificial Sequence
  Description of Artificial Sequence: Synthetic coding sequence
atgaaagcagccgtactcacgttggccgtgttgttcctgacagggagtcaggctcggcatttttggcagcaggacgagcccccacagtctccctgggatagagtaaaagacctagccaccgtgtacgttgatgtcctgaaggacagcggtagagattatgtatcccaatttgaaggaagtgccctgggcaagcagctcaatctcaaactgttggacaattgggatagtgttacgtcaaccttcagcaagctcagggagcagctgggccctgtgacccaggagttctgggacaacctagagaaggagaccgaaggattgcgccaggaaatgagtaaagatctggaggaagtgaaagctaaagtgcagccatacctggatgattttcagaaaaaatggcaggaggagatggaactgtatagacagaaagtcgagcctctacgggcagagcttcaggagggagctcgacagaagcttcatgagctgcaggaaaagctgagccctctgggggaggaaatgagggactgtgcgagggctcatgtggacgcgctcagaacacatttagcaccctacagtgatgaacttaggcagagattggccgcaagactcgaagctcttaaggagaatggcggtgccagattggctgagtaccatgcaaaagccaccgaacacctgtccacactgagcgagaaagctaagcccgcacttgaggatctgcgccagggcctgctgcccgtgctagaaagctttaaggtttcattcctaagtgccctggaggaatacactaagaagctgaatactcaatag

SEQ ID NO: 4199 - DNA, 804 bp, Artificial Sequence
  Description of Artificial Sequence: Synthetic coding sequence
atgaaggctgcggtgctgaccctggccgtcctcttcctgaccggctcccaggcacggcatttctggcagcaggacgagccccctcagtcaccctgggacagggttaaggatctggctaccgtctacgtggacgttcttaaagatagcggcagggattacgtgtcccagttcgagggatctgcactggggaaacaacttaacttgaagctgctcgataattgggactcagtgaccagcactttctccaagctccgggaacaactaggacccgtaactcaggagttttgggacaatcttgaaaaggagactgagggactcaggcaggaaatgtccaaggacctcgaagaagtcaaagcaaaagttcaaccctacctggacgattttcaaaaaaagtggcaggaggagatggagctgtaccgacagaaagtcgagccactaagagccgagctgcaagaaggtgcgcgtcagaagctccatgagctccaggagaagctgtcaccgctgggagaagagatgagagacagggccagagcccacgtggacgccctcagaacccatctggcgccatacagcgacgaactgcggcagcggctggcagccagactcgaagctctcaaggaaaatgggggagcaaggcttgctgagtaccacgctaaagctaccgaacacttaagtactcttagcgagaaagcaaaacctgcgttagaagacctaagacaggggttgttgccggtactggagagctttaaagtatctttcctgtctgccctggaggaatacacaaaaaagcttaatactcagtag

SEQ ID NO: 4200 - DNA, 804 bp, Artificial Sequence
  Description of Artificial Sequence: Synthetic coding sequence
atgaaggctgcagtcctcacacttgcagtgctgttcctgacgggctcacaggctcgccacttctggcagcaggatgagcctccccaaagcccatgggaccgggtcaaagatcttgctaccgtgtacgtagatgtcctgaaggattcaggtagggactacgtgtctcaattcgaaggcagtgccctgggcaagcaattgaacctcaaattgttggacaactgggactctgtcacctctacattttccaagttacgggagcagcttgggcctgtcacccaggaattttgggataatctcgaaaaagagactgaaggtctacgacaggagatgagcaaagatctagaggaagtaaaagctaaagtgcaaccctatctggacgactttcaaaagaaatggcaagaggagatggagctctacagacagaaggtcgagccactgcgggctgaactgcaagaaggggcaagacagaagctccacgagttgcaagaaaaactctccccactaggcgaagaaatgagggatcgcgctcgcgctcatgtggatgccctacgcacccacttagcaccttattccgatgaactgcggcaacggttagctgcaagattggaggcgctcaaagaaaacggaggtgcaaggcttgcggagtaccacgcaaaggccactgaacacctgagtacactgtccgagaaagcaaaacctgccctagaggacctcagacaaggcctactgcctgtcttggaatcctttaaggttagcttcctgagtgcccttgaggagtataccaagaagcttaatacacagtag

SEQ ID NO: 4201 - DNA, 804 bp, Artificial Sequence
  Description of Artificial Sequence: Synthetic coding sequence
atgaaagctgctgtgctgacccttgcagtgctgttcctgacaggcagtcaagccagacacttctggcaacaggatgagccccctcagagcccctgggatcgtgttaaagatctcgccacagtttatgttgacgtgctaaaggactccggccgtgactatgtctctcagtttgagggctcggcattgggcaaacagcttaatctcaagttgctcgacaactgggactctgttacgtcaaccttttccaaattaagagaacagctcggccctgtcacacaagagttttgggataatctggagaaggaaaccgagggcttacgacaggagatgtctaaggacttagaggaggtgaaagctaaagtgcaaccgtacctagatgatttccaaaagaagtggcaggaggagatggaactgtaccgacagaaagtggaacctctccgagctgaattgcaggagggcgctcgccaaaaactccacgagttacaggagaagctttctcctctcggcgaggaaatgcgcgaccgcgcaagggctcatgtggacgccctgcggactcaccttgctccctatagtgacgaactcaggcagcgcttagcagcgagattggaggccttaaaggagaacggaggggctaggctggcagagtatcacgccaaggcaactgaacatctgtccaccctgtctgaaaaagcaaaacctgcgctcgaggatttgcgtcagggattgcttccagtgctggagagtttcaaagtctcatttctctccgccctggaagagtataccaagaagctcaacacccagtag

SEQ ID NO: 4202 - DNA, 804 bp, Artificial Sequence
  Description of Artificial Sequence: Synthetic coding sequence
atgaaagccgctgttctgaccctggctgtcctgttcctgaccgggagccaggctcgacatttctggcagcaggacgagccaccgcaaagcccgtgggaccgcgtgaaggatcttgctacagtgtacgtggatgttcttaaagactcgggacgtgattacgtgtcccagtttgaggggtccgccctgggcaaacaattgaacctcaagctgctggataattgggactccgtgacctccactttttccaagctgagagagcagcttggtccagtcacgcaagaattttgggacaatcttgagaaggagacagaggggcttaggcaggagatgagtaaagatttggaggaagtcaaagccaaagtacaaccctacctggatgacttccagaaaaaatggcaggaggagatggaactctaccggcagaaagtggaacccttacgtgcagagctgcaagagggcgcacggcaaaagctccacgaattgcaggagaaattgtctcccctaggcgaagaaatgcgagaccgggcacgagctcatgtcgatgcgctgcggacccacttagcaccttattctgacgaactcaggcagcgcctcgcagccagattagaagcccttaaggaaaacgggggagctcgcctggccgagtatcatgcaaaagcaactgagcatctgagtacgctgagcgaaaaggccaagcctgcactcgaggacctgcggcaggggttgcttcccgtgttagaaagtttcaaggtgtcgttcctgagcgcattggaggagtatactaaaaaacttaacacacaatag

SEQ ID NO: 4203 - DNA, 1653 bp, Artificial Sequence
  Description of Artificial Sequence: Synthetic coding sequence
atgacaggagacaaggggcctcaacgtctcagcggctcttcctacggatccatatctagccctaccagcccaactagtccgggaccacagcaagcgccaccacgggagacatacctcagcgagaaaattccaattccggataccaagcccggaacgttttctctccgcaagttatgggcgtttacaggtcccggattccttatgagtattgcttttttagatccaggtaatatagagtcggatctccaggccggagctgtagcagggtttaagttactctgggtgctgttgtgggccacagtccttgggctgttgtgtcagcggctggcggctaggctcggggtggttacagggaaggacctgggagaggtgtgccacctctattatcccaaggtacctagaactgtactgtggctgactattgagctggccattgtgggttccgacatgcaagaagtgatcggaacggctattgctttcaatctcttgagtgctggcaggatacccctctggggcggagttttaattactatcgttgacacatttttttttttattcctggacaactatggcctacgaaaacttgaggcctttttcggtttgcttataaccattatggcactcacgttcggatatgaatatgtggttgctcgcccagagcagggcgctctgctgagaggactctttctcccgtcctgcccagggtgtgggcacccagaactgctgcaagcggtcgggatcgttggagccataatcatgcctcataacatctacctccacagtgcacttgtcaagtcacgcgagatcgatagggctcgccgtgccgacatcagagaagctaatatgtactttctcatcgaagctaccattgccctgagcgtgtctttcataatcaacctgtttgtgatggctgtctttggtcaagccttttaccagaagactaaccaggcagctttcaatatttgtgctaacagctctctgcacgattatgcaaagatatttcctatgaacaatgcgacagtcgcggttgacatttaccaaggtggcgtcattctggggtgcctatttggccctgccgcactgtatatttgggctatcggactattggcagcaggccaatcgtccacgatgactggcacctatgcaggccagttcgtcatggagggctttctcagattacgatggtcgcggtttgccagggtgcttctgaccaggtcttgcgccattttgccaactgtcctagtagctgtattccgcgacctcagggaccttagcgggctgaacgacctccttaatgtcctccagagtcttctgttaccttttgctgtccttccaatccttacttttactagcatgccaacactcatgcaggagttcgctaatggtcttcttaataaggtagtcacctcttccatcatggttctcgtgtgtgcgatcaacttgtatttcgttgttagttatttgccctccctacctcatcccgcttactttggcctcgccgctttactggcagctgcataccttggactgagcacatatctcgtctggacatgctgcctagcacacggcgctaccttcctggcccacagtagccaccatcattttctgtacgggttactggaggaggaccagaaaggagagacctcaggatag

SEQ ID NO: 4204 - DNA, 13035 bp, Artificial Sequence
  Description of Artificial Sequence: Synthetic coding sequence
atggacccccctagaccagccctgctcgccctgttggcactcccagctctgctgttactgctcttggccggtgctcgggctgaggaagagatgctcgagaatgtttcccttgtgtgcccaaaagatgccaccaggtttaaacacctccgcaagtacacctacaattacgaagcggagagcagctccggagtcccgggaaccgccgactctagatcggcaactagaatcaactgcaaagtggaactggaggttcctcaactttgctcattcattctgaagacatctcagtgcacactgaaagaagtgtacggatttaacccggaaggtaaggccctgttaaaaaagactaaaaactccgaggagtttgcggcagcgatgagcagatatgaactcaaattagccattcctgaaggaaagcaagtgttcctgtaccccgagaaagatgaaccgacctacatcctgaatattaaaagaggaattatttccgccctgttggtgccaccggagaccgaggaggctaagcaggtgctttttcttgatacagtctacggcaattgctctactcatttcaccgtcaaaaccaggaaaggaaacgtggctaccgagatctcgactgaaagggatctgggccagtgtgataggttcaagcccatcaggacagggattagccccctggcattgatcaaggggatgaccaggcctcttagcacccttatctcttctagccaatcctgtcagtatacactggacgcaaaaaggaagcacgtggccgaagccatctgcaaggagcagcatctttttctgcccttcagttataagaacaagtacggtatggtggctcaggtcactcaaacgcttaagctggaggacacaccgaaaatcaactcacggttcttcggcgaggggacaaagaagatgggccttgcctttgagagcactaagtctacatcacccccaaaacaagccgaagcagtgcttaaaactctgcaagaacttaagaagttgacaatctctgagcagaacattcagagagccaatttgttcaacaagctggtaactgagctgaggggtctatcagacgaggcagtgaccagtctgttacctcaactgatcgaggtgagttcacctattacgctccaggctcttgtacagtgcggacaaccacaatgcagcacccacatcctccagtggcttaaaagagttcacgccaacccactcctgatcgatgtggtgacgtaccttgttgccctaatacccgagccttctgctcagcagttgcgggaaatattcaacatggcccgagaccagcgaagccgggcaactctttacgcgctctctcatgccgtcaataactatcataagactaaccctacagggacacaggagctgttggatatcgccaattatctgatggaacagatccaggacgactgtaccggtgacgaggattacacctatctgatcctgagggtaataggtaacatggggcagaccatggagcagctgacgcccgaattgaagagctctatactgaagtgtgtacaatctactaagccaagccttatgatccagaaggccgcaatccaggctctccgtaaaatggagccgaaagataaggaccaagaggtcctgctgcagacttttcttgatgatgcctcgccaggcgataagcgcctggctgcttacctcatgcttatgcgctccccttcccaggctgatatcaacaagattgttcaaatcctgccatgggagcagaatgagcaagtcaaaaactttgtcgccagtcacatcgccaacattctgaatagcgaggagctggatattcaggacctgaaaaagctcgttaaggaagcattgaaagagtcgcagctgccgactgtgatggactttcggaagtttagtaggaactaccagctgtataaatccgtgtcgctcccctccctcgaccctgcatcagccaagatcgaaggtaacctcatttttgaccctaataattaccttccaaaggaaagcatgctgaaaactactctgaccgccttcgggtttgctagcgccgatctcattgaaatcggtttggaaggcaagggcttcgaacctacgctagaggcgctcttcgggaaacaagggttctttcccgactctgtgaacaaggccctgtactgggtgaacggtcaggtgcctgacggcgtgagcaaggttctcgtggatcacttcgggtacaccaaggacgataagcacgaacaggatatggtgaacggtatcatgctgagcgtggaaaagctgatcaaggacctcaagtctaaggaagtccccgaagctcgcgcttacttaagaatcctgggcgaagagctgggatttgcctctctacatgacctccagctgttaggaaagctgttgttgatgggcgctagaacactacaaggaattcctcagatgattggcgaagtcattcggaaagggagtaagaacgatttttttttacattatatatttatggagaatgcctttgaactgcctacaggagctggtctccagctgcagatctcatcatcaggagtgattgcgcctggcgctaaggccggagtgaagttggaggtcgccaacatgcaggctgaattggtggcgaagccttccgtgagcgtggaatttgtgactaatatgggcattattattcccgacttcgccaggagcggcgttcagatgaacacaaactttttccacgagtccggtctggaagcacacgttgccctgaaggctggtaaactgaaatttatcatcccaagcccaaaaagaccagtgaaactgctgtccgggggaaatacgctgcacctggtttccaccacgaagactgaggttatcccacctctcattgaaaacagacagagttggtccgtgtgcaagcaggtgtttcccggattgaactactgtacatcaggcgcttactccaatgcgtcaagtaccgatagcgcttcctactaccctctgaccggggataccaggctagaattggagttgagaccaaccggtgaaatcgagcagtatagcgtctcagcaacatatgagcttcagcgggaagatcgcgcactggtggacacactcaaattcgtcacccaggccgaaggtgcaaaacaaaccgaggcaactatgacatttaagtacaatagacagtcaatgacattgagttctgaggtgcagattccagacttcgatgtcgacctcggcacaattttgcgggtgaatgatgaaagcactgagggaaaaaccagctataggctaactcttgacatacaaaataaaaagatcactgaagtcgcccttatgggacacttgtcctgtgacaccaaggaagaacggaaaatcaaaggggtcatttccattcccagactccaggcggaggctcggtcggaaatcctcgcgcattggtcccctgcaaaactgctgctccagatggatagctctgctacagcttatggcagcactgtgtccaaaagagtggcgtggcactacgacgaggagaaaatcgaattcgaatggaatacagggactaatgtggataccaagaagatgacaagcaacttcccagtcgacctcagcgactacccaaagtctctccatatgtacgccaatcgtctattggatcacagggtcccgcagacggacatgacctttagacatgtaggatctaaacttatcgtagcaatgtccagctggttacagaaggcttccgggagcctcccttacacacagacattacaagatcacctcaacagtcttaaagaattcaacctccagaatatgggcctcccagatttccatattccggagaacttgtttctgaagagcgatggacgcgtgaagtacacgctgaataagaactcgctgaagattgagattccactgcccttcggcggaaaaagtagtcgggatcttaaaatgctagagacagtaagaactcccgctctccatttcaaatctgtggggtttcaccttccttctcgggaattccaagtgcccacatttactatccccaagctgtatcaacttcaggtgccactcttgggcgtgctggacctttcaacaaatgtgtactcaaatttgtacaactggagcgcaagctacagcggagggaacacctcaaccgatcacttcagcttgagggcccgttatcatatgaaagcagatagcgtggtcgacttgttatcgtacaatgtccagggctcaggggagaccacatacgaccataaaaacacgtttaccctgtcgtacgatggctctctgaggcataagtttctcgattccaatatcaaattcagccacgttgagaagttgggcaacaatcccgtgtccaagggtttgctgatcttcgatgcctccagttcctgggggccacagatgtcggcttcagtacacctcgatagcaagaagaaacagcatctattcgtcaaagaggttaaaatcgacggccagtttagagttagctccttctatgccaaaggaacatatggcctatcatgccagcgggatccaaataccggcaggctgaacggggagagtaacctgcgattcaactcttcatacttgcagggaacaaatcagataactggaagatacgaggatggcacgctcagtctgacgtccaccagtgacctgcagtcaggcattattaagaatacggcatcgctcaaatatgagaactacgagttaaccctcaaatctgacactaacggtaagtataagaacttcgcaacctcaaacaaaatggatatgaccttctctaaacagaacgctctgttgagatccgaatatcaggcagactacgaatcactaaggtttttcagtctgttgtccggctctctgaacagccatggtctggaactcaacgctgatatcttgggtacagacaagatcaactccggggctcacaaggccactctgcgtattggccaagatggaatcagtacctctgctaccacgaacctcaaatgttctctgctagtactggagaacgagctcaacgctgagcttggcctttctggggctagcatgaaactgactactaatggccgtttcagagaacacaatgccaagtttagtctggatggcaaggcagccctcacagaattgtcgctcggcagcgcctaccaggcgatgatcctaggagtggactcaaagaacattttcaacttcaaagtgtctcaggagggcctgaaactgtcaaacgacatgatggggagctacgccgagatgaaattcgaccacacaaacagcctcaatattgccggactctctctggacttttcttcaaagctcgacaacatatattcaagcgacaagttttacaagcagacagtgaacttacagctacagccctactcactggtaaccaccctgaattctgatttgaaatacaacgcactggacctgaccaacaatgggaaactccggctggagccgctgaaactgcacgtcgccggaaatctcaaaggcgcatatcagaacaacgagatcaaacacatctacgccatatcatctgctgccctgtctgcttcttacaaagccgacaccgtggccaaagtacaaggcgtggagtttagtcaccgactgaatactgacatcgcagggcttgctagtgcaattgatatgagcacgaactacaattccgattcattgcacttttcaaatgtattccggtctgttatggctccattcactatgaccatagatgcccacaccaatggcaatggtaagctggccctgtggggcgagcacactggccagctgtactcgaagttcttattaaaagcagaacccctcgctttcaccttttcccacgattacaaagggagtactagtcaccacctcgtctctagaaaaagcatctctgcagcattagagcacaaagtctccgctctgcttacccccgctgagcagacaggtacgtggaagttgaagacacagttcaataacaacgagtattctcaggatctggatgcctacaataccaaggacaaaataggcgtggagctgaccggcaggacactggcagacctgacactcctggattctcctattaaggtgcctctgctgctgtctgaaccaattaatatcatagatgctcttgagatgagagacgccgtggagaaaccacaggaatttacaatcgtggcctttgtgaagtatgataaaaaccaggacgtccactctatcaatctgccattcttcgaaaccttacaagagtacttcgagagaaaccgccagacgataattgttgtgcttgaaaatgtacagaggaacctaaagcacattaacatcgatcagtttgtaagaaaatacagggccgcattggggaagctcccccagcaggccaatgactacctgaacagcttcaactgggagcgccaagtttcacacgccaaggagaaacttacagcactcactaaaaagtacaggataactgagaatgatattcagatagcgctcgatgatgctaagatcaacttcaatgaaaaacttagccaacttcagacatatatgatccagttcgatcagtacatcaaggatagctatgacctgcatgatctcaaaatagcaattgccaatattattgacgagattatcgagaagcttaagtcactcgatgagcactaccatatccgcgtgaacttggtcaaaacgatccacgatttgcacctttttatcgaaaacattgacttcaataagtctggctccagtaccgctagttggattcagaacgtggacacaaagtaccagataaggatccagatccaggagaagttacaacagttgaaaaggcacattcagaacatagatatccagcatctggccggtaagctgaagcaacacatcgaggccatcgatgtacgggtattgctagatcaactgggaactaccatcagcttcgagcgcatcaatgatatcctggaacacgtgaagcactttgtgatcaatctgattggggattttgaggttgcggaaaaaattaatgcttttcgtgctaaggtgcacgagttaatcgagcgctatgaggtggatcaacagatccaggtactcatggataagcttgttgaactggcacaccagtataagcttaaggagacaattcaaaagctttccaatgtcttgcaacaagttaagattaaggattattttgagaagctagtgggcttcatagacgatgcggtcaagaagcttaatgagctgagctttaagacgtttattgaggatgtgaataaatttttagacatgctgataaagaaactaaagagttttgactaccatcagttcgttgatgaaacaaatgacaagattagagaggtgacccaaagactgaacggcgagatacaggccttggagctcccgcagaaagcagaggcccttaaactgtttctcgaggagactaaagccaccgtcgccgtgtacctggagagtctgcaggacacaaagattacactgattattaattggctgcaagaggctctctcgagcgctagtctggcgcatatgaaagccaagttccgagagacattggaagatacgcgcgaccgaatgtaccagatggacatccagcaggaattgcaaaggtatctgagtctggttggacaggtgtactccacgcttgttacgtacatttccgattggtggacactcgccgcaaagaatttgaccgacttcgctgagcagtactcgatccaggattgggctaaacgaatgaaggctctggtggagcagggatttacggtgccggaaattaaaaccatccttgggacaatgccagcatttgaggtgtctcttcaagccctgcaaaaagccactttccagactccggacttcattgtgcccctgacagaccttcggatcccttccgtacagataaacttcaaggatctcaaaaatataaaaatccccagccgcttctcaactcccgagtttaccatactgaatacgtttcacatcccaagcttcaccattgatttcgtcgagatgaaggtcaaaatcatccggactatcgatcagatgctgaactcagaactccagtggcctgtgcccgacatctacttaagagacctgaaggtggaggacatccctctggcacggattaccctacccgactttagattacctgaaatcgccattcctgaattcataatcccaacactgaacctgaatgattttcaggtgccggacctccacattcccgagtttcaactgccccatatatcgcacaccattgaggtccctacattcggcaagctctacagtatcctcaaaattcagtcacccctgttcacgctggatgccaatgcagatatcggaaacgggaccaccagtgcaaacgaagccggaatagccgcatcaattacagccaagggtgagagcaagctcgaagtgctcaatttcgactttcaagcaaatgctcaactatcaaatccaaaaattaacccgctggccctcaaagaatctgtcaaattttcgagtaagtacctgcgcactgagcatggctccgagatgttattttttgggaacgccattgaagggaaatctaacacagtggctagtctacacactgagaagaatacactagagctctccaatggagtgatagtaaagatcaataaccagctaacgctggactcgaacaccaagtattttcataagctcaacataccgaagctggattttagctctcaagctgacctacgtaacgagatcaaaaccttgctcaaggctgggcacatcgcctggacgagctccgggaagggtagttggaaatgggcctgccccaggttctccgacgagggtacccacgaatcacagatcagtttcaccatcgagggcccactgacaagttttggcctatctaataaaatcaactcaaagcacctgcgcgttaatcagaatttggtgtacgagtctggcagtttgaacttcagtaaattggagatccagtcacaggtggacagtcaacacgtggggcattcggtgttgacagcgaaagggatggcgttgtttggggaaggcaaggctgaatttaccgggaggcacgacgcgcaccttaacggtaaggtgataggaactctgaagaacagcctttttttcagtgctcagcccttcgaaattacggcatccacaaataacgaggggaacctgaaagtgcgttttccccttcgtctgacgggcaaaatagacttcctgaacaattatgccctatttttgagccccagcgctcaacaggccagctggcaagtgtcagctaggttcaatcaatataaatataatcagaactttagcgccggaaataatgagaacatcatggaggcccatgtcggaatcaacggagaagccaacctggactttctcaatattccccttacaattccagagatgcgcctgccctataccatcatcactactccacctctgaaagacttttccctctgggaaaagaccggtcttaaggagttcctgaagacgacaaaacaaagtttcgatctgtccgtgaaggcccagtataaaaagaataagcaccggcatagtataacgaacccactggctgttctgtgtgaatttatatcccagagcatcaagagcttcgatcggcactttgaaaagaatcgaaacaatgcgttggactttgtgaccaagtcctacaacgagaccaaaattaaattcgataagtataaggcagaaaaatctcacgatgaactccccaggacgtttcaaattcccggatacactgtcccagtcgtgaatgtggaggttagcccctttaccattgaaatgtcagcatttggttacgtgttcccaaaggctgtgtctatgcctagctttagcatcttgggaagcgacgtcagggtgccttcgtacaccctgattctgccgagtctcgaactgcccgtactgcatgtgccaagaaatttgaagctaagtctaccagacttcaaggagctatgtaccatatcacacattttcattcctgctatgggtaatatcacatatgatttttctttcaaatcatccgtaataaccttaaatacaaacgctgaactgtttaatcaaagcgacatagtcgcccatctgctgagcagttccagtagtgtgatagacgctttgcaatacaagctggaggggaccactaggcttactcgcaagagaggtcttaagttggctactgctctgagtctttccaataaatttgttgagggatctcataactctaccgtttcactgacgaccaaaaacatggaggtatctgtcgccaccaccaccaaggcgcaaattcctatcctgcggatgaactttaagcaggaactcaatgggaacaccaagtctaagcctacagtgtccagctccatggagtttaaatacgactttaattctagtatgctctatagtacagccaaaggggcagtggaccacaagttgtccctcgagagtctgactagttacttttcaatcgagtcatcaacaaagggggacgtgaaagggtccgtgttgtcccgcgaatacagtggtactatagcctctgaggccaacacctacttgaactcaaaatcaacaaggtctagcgtgaagctgcagggaacctctaaaattgacgatatatggaacctggaagtgaaggaaaactttgccggagaggctactctccagcgcatctactctctctgggagcattcaacaaaaaatcacctccaactggaaggactattcttcactaatggagagcataccagtaaagcgactttggaattatccccctggcagatgagtgcacttgtgcaagtccatgcatcgcagccttccagtttccacgattttccggacctgggacaagaagtcgctcttaatgctaatacaaagaaccaaaaaatcaggtggaaaaatgaggtacgtatacattccggttcatttcagagccaagtcgaattgtcaaacgatcaagaaaaggcgcacctagacatcgccggatctctggaaggacatctgaggtttctgaaaaatataattctgccagtgtacgacaagtctctgtgggattttcttaagttggacgtaaccacttctattggccgtaggcagcatcttagagtgtccaccgctttcgtgtatactaagaacccaaatggatattctttttctattccagtcaaagtccttgcggataagttcatcattccgggactgaagctcaacgacttgaactccgttctggtaatgcctaccttccatgtccctttcaccgatcttcaggttcctagttgcaagctggattttcgggaaattcagatctacaagaagttacggacttcatcgttcgcccttaaccttcctacactgcctgaggtgaaatttccggaagtggacgttcttactaaatattcccaacctgaagactctctgatcccattttttgagatcaccgtacccgagtcacaactgactgtttcacagttcaccttgccaaagagtgtcagcgatggtatcgcagcccttgatctgaatgccgtagccaataaaattgccgatttcgaactgcccactatcattgtgcctgaacaaaccatcgagattcccagcattaagttcagcgtgcccgctgggattgtgatcccctccttccaagccttgacagctcggtttgaggttgacagcccagtttataatgcaacatggtcagcctcattgaaaaacaaagcagactatgtagaaacggtgctggatagtacttgttctagtacggtgcagttccttgagtatgaattgaatgtgctaggcacccataaaattgaggatgggactcttgcttcaaaaacaaagggtacctttgcacaccgggacttcagcgccgagtacgaagaggatggcaagtatgaaggactccaggaatgggaaggcaaagcccacttaaatattaagtcacccgcattcacagatctgcatctccggtatcagaaagacaagaagggaatctcaacatcagccgcatctcctgccgtgggtaccgtggggatggatatggacgaggatgatgacttcagcaaatggaacttctactacagcccgcaaagttcgccagacaagaagcttacaatatttaaaaccgaactgcgggtacgggagtctgatgaagagactcagatcaaggtgaattgggaggaggaagctgcctcaggcctgcttacaagccttaaggacaacgtgcccaaagccaccggagtgttgtacgactacgtaaacaagtaccactgggagcacacagggttgactctgagggaggtatcttcaaaacttcgaaggaacttacagaataacgcagagtgggtataccagggagctatcagacagatagatgacatcgatgtgagatttcagaaagcagcaagcggcactacaggaacgtaccaggaatggaaagacaaagctcagaacttgtatcaggaactgttgacccaagagggacaagccagctttcagggcctcaaggacaatgtgttcgacggtctggtgcgcgtaactcaggaattccatatgaaggtcaagcatcttatcgattctctgattgactttctgaattttccgaggttccagttcccaggaaaacctgggatctatacacgggaggaactatgtaccatgttcatcagagaggtggggaccgtcttatcccaggtttactccaaggtccataacggcagcgagatcctgttctcctacttccaagacctcgtcattacattacccttcgaactgcggaagcataagctgatagatgtaatcagcatgtatagagaattgcttaaagacttatctaaagaggcccaggaggtgtttaaagctatacaatcgctaaaaaccacagaagtactgcgaaacctccaggatcttttgcagtttatctttcaactgatcgaagacaatatcaagcagttgaaggaaatgaaattcacctacctgataaattatatccaagatgagatcaacaccattttctctgattatatcccatgcttctac

SEQ ID NO: 4205 - DNA, 798 bp, Artificial Sequence
  Description of Artificial Sequence: Synthetic coding sequence
atgaaaaaggaggtctgctcggtggccttcctcaaagccgtgtttgctgaatttcttgccaccctcatcttcgtcttcttcggcttagggtcggcgctgaagtggccctctgctctgcctacgattctccagatcgccctcgcctttgggctggccatcggaacactagcacaggcactggggccagtcagtggagggcacatcaaccctgccattacactagcgctgctggttgggaatcagatctcactgctgcgcgcatttttctatgttgccgctcagcttgtaggagccatcgccggtgctggaattctgtacggggtggccccactgaacgcacgcggaaacctggccgtgaacgctctgaataacaacaccacacagggccaggcgatggtggtcgaacttatcctgactttccagctggctctatgtatcttcgcaagcacagacagtagaagaacgtctcctgttggctctcctgcattgtcaataggccttagtgtgacactcggtcaccttgtggggatttacttcaccggatgtagcatgaatccagcccgtagctttggacctgctgtggttatgaaccgattttctcccgcacactgggtgttctgggttggcccaattgtgggcgctgttttagcagccattctgtacttttacctcctgttccccaacagcttatcactgagcgagcgggtggctattataaaggggacctatgaacccgacgaagattgggaggagcagagagaggaacgcaaaaagactatggaattaacaacccggtag

SEQ ID NO: 4206 - DNA, 993 bp, Artificial Sequence
  Description of Artificial Sequence: Synthetic coding sequence
atgtcggccaaatccagaactattggaatcattggggctccttttagcaaaggccaaccaagagggggtgtcgaagagggcccaacagttttacggaaggcaggacttctcgagaaattgaaagagcaggtgacgcagaacttcctcattctcgagtgcgacgtcaaggactacggggaccttccattcgcggatatccccaacgactctccctttcaaattgtgaagaaccccagaagtgtgggcaaggccagtgagcagctcgctggcaaagtggcagaagtgaaaaagaacggtcgtattagcctggtgctcggcggagatcattcattagcgattgggagcataagtgggcacgctagggtccatccggatttgggcgttatctgggtggacgcacataccgatatcaatacaccgctaacaactaccagtgggaatctgcacgggcagccggtgtctttcctattgaaggaactgaaggggaaaattccggacgttccgggattttcttgggtgacgccgtgcatttctgcaaaggacattgtctacattggactgagggatgtagatcctggtgaacactacattttgaaaacccttggaattaagtacttctctatgaccgaggtggacaggctgggcattggtaaggtgatggaagagaccctatcttacctgctcggacgtaagaagcgacccatccacctcagctttgacgtggacgggctggatcccagttttacaccagccaccgggacccccgtggtgggcggtctgacctacagggaagggttatatatcaccgaagaaatatataagactgggctgttgtcaggccttgacatcatggaggtcaatccttccctcgggaagacccctgaagaagttaccagaacggtaaatactgctgtggcgatcacactggcctgctttggcctggctcgggaaggtaaccacaagcctatagactatctcaatccccctaaatag

SEQ ID NO: 4207 - DNA, 969 bp, Artificial Sequence
  Description of Artificial Sequence: Synthetic coding sequence
atgtcagctaagagtaggaccatcggtattattggagccccattctctaagggtcaaccgaggggtggcgtcgaagaaggcccaactgtgttacgcaaggccggattgctggagaagctgaaggagcaggaatgtgacgtgaaagattatggggatctcccgtttgccgacatccctaacgattctcctttccagatcgtcaagaatcctagaagtgtgggtaaagcctctgaacagctcgcaggcaaggtcgctgaagttaagaagaatgggaggatttctctggtgctgggaggcgaccattctctggctatcggctctatcagcggacatgcgagagtgcatcctgatttgggtgtcatttgggtggacgcccacacggatatcaatacacccttgaccacaacctcagggaacctgcacggtcaaccagtctcatttctgttaaaggagctcaaggggaagatccctgatgtgcccggattttcctgggtcacaccatgtatatccgccaaggacatcgtttacatcggcctccgcgacgttgacccaggggaacactatatcttgaaaaccctcggcattaaatatttttccatgactgaggtggacagactgggcattggaaaagtcatggaggaaaccctgtcctacctgttaggcagaaagaagaggcctatccacctctctttcgatgtagatggacttgatccctcctttacccccgctaccggcacgccggttgtgggcggattaacatatcgggaggggctgtatattaccgaagagatatataagacgggcttactgtctggcctggacatcatggaagtgaatccctccctgggcaaaacacctgaagaagtgactaggactgtcaacaccgccgtggccataacactggcatgtttcggtttggctagggagggaaaccacaagcccatcgattacctgaacccgcctaaatag

SEQ ID NO: 4208 - DNA, 711 bp, Artificial Sequence
  Description of Artificial Sequence: Synthetic coding sequence
atgtcagcgaagtcacgaacaatcggcattatcggcgctcctttttccaagggccagcccagaggaggcgtggaagagggccctaccgtcttgaggaaggcaggactcctcgaaaagctgaaggaacaggagtgcgatgttaaggattacggggacctcccttttgcggacattccaaatgatagtccctttcagattgtaaagaaccccaggagtgtgggtaaggcctctgagcagttggcaggtaaggtggctgaagtgaaaaagaacggcagaatttctctggtcctgggcggtgaccactctctcgccatcggatctatttctgggcatgccagggtgcaccccgatctgggagtcatttgggtggatgcccacaccgatatcaatacaccactcactacaacatccggtaatctgcacggacagccagtgagttttttactaaaagaactgaagggaaaaatccccgatgttcccggttttagctgggtgacaccatgtatatccgcaaaggatattgtgtatataggcttgagagatgtagatcccggtgagcattacatcttaaaaaccttgggcatcaagtattttagtatgactgaagtgacgcggactgtcaataccgcagtcgccatcacacttgcctgttttggacttgccagagaaggtaatcataagccaattgattatttgaacccacctaaatag

SEQ ID NO: 4209 - DNA, 1395 bp, Artificial Sequence
  Description of Artificial Sequence: Synthetic coding sequence
atggcctccgagtctggaaaactgtggggcggacgttttgtaggcgctgtggatcccatcatggagaagttcaatgcttcaattgcttacgataggcatctgtgggaagtcgatgtgcaaggatccaaagcctactcaagaggcctagaaaaggctggccttctgacaaaagccgaaatggatcagatcctgcatggcttggacaaggtcgcggaggagtgggctcagggtacttttaagctgaacagcaatgatgaggatattcatacagcaaacgaaagacggctcaaagagttgatcggcgctacagcaggcaagctgcataccggtaggtccagaaatgatcaggtggtcactgatctccgtctttggatgcgccaaacttgctctaccttgtccggtctcttatgggagctgatacgcacgatggttgaccgcgctgaggctgagagagacgtcctttttcctggatatactcatctgcagcgcgctcagcctattcgctggagtcattggatcctgtcacatgcggtcgcgctgacaagggattccgagaggctgttggaagtgcgcaaacgtatcaatgttttaccattaggcagtggcgcaatcgccggaaaccccctcggcgttgatagagaactgctgcgggctgagcttaactttggtgctatcactttgaactcaatggacgcaacctcagaacgcgacttcgttgctgaatttctgttttgggcatcactctgcatgacacacttgagtaggatggctgaggacctgattctgtactgcacgaaggagttttcctttgtgcagctgagcgacgcctactcaacaggctcctccctcatgcctcagaaaaagaatcctgacagtctggagctgatccgctccaaggccggacgcgtgttcggtaggtgcgccggtcttttgatgaccctaaagggtctgccttctacatacaataaggaccttcaggaggacaaggaagcagtcttcgaggtgagtgatacaatgagcgcagtgcttcaggtcgccaccggagttatctcaactctgcagattcatcaggaaaacatgggccaggcactcagcccagacatgttggctacagacctcgcttattatctggttcggaagggaatgccatttcggcaggcgcacgaggcatctggtaaagccgtgttcatggcagaaactaagggcgtcgccctaaaccagctgagcctccaggaattgcaaacaataagcccgctattttccggagatgtgatctgtgtttgggactacgggcattccgttgaacagtatggcgctctgggagggactgcaagaagcagtgtggattggcagattagacaggtgcgggcactcctgcaagcgcaacaggcatag

SEQ ID NO: 4210 - DNA, 1317 bp, Artificial Sequence
  Description of Artificial Sequence: Synthetic coding sequence
atggctagtgagtcaggtaagctgtgggggggacgatttgtaggggctgtagatcccattatggagaagtttaacgcgtcaattgcttatgaccgtcatctatgggaggtggatgtgcagggctccaaagcgtacagtcggggtttagagaaagcgggtctgctgacgaaagcggagatggatcaaattctgcatggccttgacaaggtagcggaggagtgggcccaggggacctttaagttgaatagtaacgatgaagatatacataccgctaacgaaagacgactgaaagagctgatcggggcaaccgccggaaaactccacacagggcgtagtagaaatgatcaggtggtgaccgatctccgcctgtggatgcgtcagacatgcagcaccctgtctggcctgttatgggagttaatcagaaccatggtcgatcgagccgaagccgagcgtgatgtactgtttcccggatatacgcatctacagagggcccagccaattcgatggtcacactggattctgtccggcgcaattgcgggaaatcccttgggcgtggatcgggagctgttacgggcagaacttaatttcggagcaatcaccttaaacagcatggatgccactagcgagcgcgacttcgttgcagagttcttgttttgggcctccttgtgtatgacccacctgtcgagaatggcagaagacctgattctgtactgtactaaagaattcagttttgtacaactatccgacgcttactctacaggctcgtctttgatgcctcagaagaaaaaccctgacagcttggaattgatcagaagcaaggccggaagggtgttcgggagatgcgcaggattactgatgaccctgaagggcctcccttccacgtacaataaagacttgcaggaagacaaggaagccgtctttgaggtgagtgacactatgagtgccgtcttgcaagtggcgacaggtgtgatctccactttacagatccatcaggaaaatatggggcaggccttgtcgcccgatatgctagctacggaccttgcttactacctggtacgcaaaggcatgcccttcagacaggctcacgaggcctcgggaaaggctgtgttcatggctgaaactaaaggggtcgccctcaaccaattgagcctgcaggaattgcagaccatttctccgctgttcagcggggacgttatatgcgtttgggactacggccatagcgtcgagcagtacggcgcactgggagggacagcaagatctagtgtggactggcagattcgacaggtgagggctctgttacaggcacagcaggcttag

SEQ ID NO: 4211 - DNA, 1335 bp, Artificial Sequence
  Description of Artificial Sequence: Synthetic coding sequence
atggcttctgagtcgggcaaattgtgggggggaaggtttgtgggggctgttgacccaattatggagaagtttaacgccagtatcgcatacgataggcacctgtgggaggtggacgttcaaggatcgaaggcatactcgcgcggtctggagaaagccggactattgacgaaggcagaaatggaccagatattacatggcctggataaggtggccgaagaatgggcacagggtaccttcaaacttaacagtaacgatgaggatattcatactgccaacgagagacgcttgaaggaacttatcggggctaccgctggaaaattgcataccggacgttcaaggaatgaccaggtcgtgaccgatctccgactgtggatgcgacaaacatgctcaactctctcagggctattgtgggagctcatccggactatggtggacagggcagaagcagagagggacgtgctgttccccggatatacacacctacagcgagcacaacccatcaggtggagccactggatcctgtcacacgccgtggccctaacccgtgactccgagaggctccttgaagtcaggaaacggattaacgtacttccattagggagcggtgcgatcgctgggaatccactaggggtggacagagaattgttgcgggctgagctgaatttcggcgcaatcacactgaactctatggacgctacttctgaaagagattttgtcgccgaattcctgttttgggcatccctgtgcatgacccatctcagcagaatggctgaagatttaattttgtattgcactaaggaattttcatttgtgcagctgagcgatgcctacagcaccggaagtagtttgatgccccagaagaagaatcctgattccttggagttaataagaagcaaagccggtcgggtctttggcagggaagacaaggaggcagttttcgaagttagtgacacaatgtcagccgtactgcaggttgccaccggggtgatttccacactgcagatccatcaggaaaacatgggacaggctctgagccctgatatgctggctaccgaccttgcctactatttagtgaggaaaggaatgccatttaggcaggcccacgaagcatcgggtaaagctgtgttcatggccgaaacaaagggggtcgcactgaaccagctttctctgcaggagttgcagacaatcagccccctctttagcggagatgttatatgtgtttgggactacggacactcagtcgaacagtacggagccctcggaggaaccgcgcgatctagcgttgactggcaaatacggcaggtgcgtgccctgctacaggcacagcaggcctag

SEQ ID NO: 4212 - DNA, 1395 bp, Artificial Sequence
  Description of Artificial Sequence: Synthetic coding sequence
atggcatccgagtccggcaagttgtggggcggtcggttcgtgggcgcagtggaccccatcatggagaaatttaatgcctcaattgcatacgatcgacacctctgggaagtggacgtacaaggctcgaaagcttacagccgcggtttagaaaaggctggcctgcttacaaaggccgagatggaccagatcttacatggtttggacaaagtggcagaagaatgggcccagggtaccttcaaacttaactccaacgacgaggatatccacaccgcgaacgagcgcagactgaaggaactcatcggagcaaccgctggaaaattgcacaccggcagaagccgcaacgaccaagttgttacagatctgcggctgtggatgcggcagacctgtagcaccctcagcggactactgtgggaactgatacgaacaatggtggatcgggcagaggccgagcgagacgtgttatttccaggctatactcatctgcagcgggctcagcctattcggtggtcgcactggatcctgagccatgctgttgcattgacgcgtgactccgaacgtttgctggaagtccggaagaggattaatgttctgcccttgggtagcggagcaattgcaggcaaccctctgggggttgatagagaactcctgcgtgccgagctcaatttcggtgccatcacactgaacagtatggacgcgactagcgagagagactttgttgcggagttccttttctgggcaagcctgtgcatgacgcacctgtcaaggatggctgaggaccttatcctgtactgtacaaaagaattctctttcgtacaactctctgatgcttattcgacaggtagttcactgatgcctcagaaaaagaatcccgactccctggagctgatccgttcaaaagctgggagggtgtttggtaggtgcgctgggctcctcatgactctcaaaggcctgcctagcacatacaacaaagacctgcaggaggataaggaagctgtctttgaggtaagtgacactatgtctgccgtgctgcaggttgccacaggagttatcagcacgcttcagatccaccaggagaatatgggtcaggccctgtctcccgacatgctcgcaacagacctggcctattatctcgtgaggaagggaatgcctttcagacaggcgcatgaggcttctggcaaggctgtcttcatggctgagaccaaaggagtggccttgaatcaactgagcctgcaggagcttcaaactatttcacccctcttcagcggggatgtgatatgcgtgtgggactacgggcacagcgtcgagcagtacggtgcactgggtggcacggcacgctcttcagtggactggcagatccgccaagttcgggcactgctgcaggcccagcaggcgtag

SEQ ID NO: 4213 - DNA, 297 bp, Artificial Sequence
  Description of Artificial Sequence: Synthetic coding sequence
atggaaaaatttaatgctagcatagcgtacgaccgccacctctgggaagtcgacgtgcagggctcaaaggcgtactccagaggcctagagaaagccggactgctaacgaaagcggagatggaccagattctccatgggctcgataaggtggcagaagaatgggcccagggaacttttaagctgaacagcaatgacgaggacatccacaccgcaaatgaaagaagactgaaagaactgattggcgcaaccgctgggaagctccatacaggaaggtcccgaaacgatcaagtgctgtag

SEQ ID NO: 4214 - DNA, 1239 bp, Artificial Sequence
  Description of Artificial Sequence: Synthetic coding sequence
atgtcttccaagggaagtgtagtgcttgcctacagtggaggcctggatacatcctgcatcctcgtatggctgaaggagcagggatacgacgtgatcgcttaccttgctaacatcggccagaaggaggacttcgaggaggccaggaagaaagcacttaagctgggagccaagaaggtattcatcgaagacgtttcacgtgagtttgtggaagaatttatttggccagcgattcagagctccgccttgtatgaagataggtatctcctggggacatctttggctcggccatgcattgccaggaaacaagtagaaattgctcagcgcgaaggagctaagtatgtgtcgcatggtgctacgggcaagggcaacgatcaggtgcggtttgaactgtcatgctattctcttgctccacagatcaaggtaatagctccctggagaatgccggaattttataatcgctttaagggacgcaacgacttgatggaatatgctaaacagcatggaattccaataccggtaaccccaaaaaatccctggtctatggatgaaaatctgatgcacatttcttatgaagccggaattctggagaatccgaaaaatcaggcacccccaggcctgtataccaagacccaggaccctgcaaaagctccaaacacacctgatattcttgagatcgaatttaagaaaggcgtgccggtcaaagtgactaatgtgaaggatggaaccacccaccagacatcactggagttgtttatgtacctcaacgaagttgccggtaagcacggagtcggcaggattgacatcgttgaaaacaggtttatcggtatgaagtcccggggtatctatgaaacacctgctgggactattctctaccacgctcacttggatatagaagctttcaccatggaccgggaagttcgcaagatcaagcaggggctgggtttgaaatttgccgagctcgtgtacacggggttttggcactcgcccgagtgcgagtttgtgcgacattgcatcgctaagtcacaggagcgggtggagggaaaggttcaggtctctgtgctcaagggacaagtgtacattctggggcgtgagagccccctgagtctttataacgaggaacttgtgagcatgaacgtgcaaggggactacgagcccacagacgcaactgggtttatcaatatcaattcactgcggcttaaagagtaccatcggcttcagtccaaggtgactgctaagtag

SEQ ID NO: 4215 - DNA, 1239 bp, Artificial Sequence
  Description of Artificial Sequence: Synthetic coding sequence
atgagcagtaaaggatctgtggtgctcgcttactccggagggctggacacgtcgtgtatcttggtatggttgaaggagcagggttacgacgtgatcgcatacctggcaaacatcggccagaaagaggacttcgaggaggcccgaaagaaggccctgaaactgggcgctaaaaaagttttcattgaggacgtatctagagagttcgttgaggagtttatatggccggcaattcaaagtagcgccctttatgaagaccgataccttttgggaacatccctggcccgaccatgtattgctcgcaagcaagtggagatcgcacagcgagagggagcgaagtacgtcagccacggcgctacagggaagggcaacgatcaggtgcgcttcgagttgagttgctactcacttgcgcctcaaatcaaggtaatcgctccgtggcgtatgcctgaattttacaaccggttcaagggcaggaacgaccttatggaatacgcaaagcagcacggtatacccataccagtaacaccgaaaaacccctggagcatggacgagaacttaatgcatatctcttacgaggcgggaatcctggagaacccgaagaaccaggcccctccgggactgtacacgaaaacgcaggacccagctaaggcaccaaacactccggacatccttgaaatagaattcaagaagggcgtgccagtgaaggtcaccaatgtaaaggatgggactacccaccagacttcactggaattatttatgtacttgaatgaggtggctggaaagcatggagtaggcaggattgatatagtggaaaataggtttattgggatgaagtctcgcggaatctatgaaacacccgctgggactattctctatcatgcccacctcgacatagaggcatttaccatggaccgggaggtgcgtaaaattaagcaagggctcggactcaaattcgcggagcttgtgtacaccgggttctggcatagtcccgaatgtgagtttgtgaggcattgtatcgcgaaaagccaagagcgggtggagggcaaggtgcaggtgtcagtcctcaagggccaagtgtacatcctgggcagggaatcgccgctgtcactctacaacgaggaattggtttccatgaacgttcagggagactacgagcccaccgacgcgactgggtttataaacattaacagcttgcgacttaaagagtaccacagactccagagcaaggtgactgctaagtag

SEQ ID NO: 4216 - DNA, 510 bp, Artificial Sequence
  Description of Artificial Sequence: Synthetic coding sequence
gaacccggacctttgcagctaatggtggttgcggaggcccagggagggaagcatggagtcgggagaattgatattgtggaaaacagattcattgggatgaaatcgcgtggcatttacgaaacaccagcaggtacaatcttgtaccacgcacacctggacattgaagccttcacaatggatcgggaagtgcgcaaaataaaacagggcctggggctaaaattcgctgagctggtgtataccggattttggcatagccccgagtgtgaatttgtcagacactgcatcgcaaaatcacaggagagggttgagggcaaggtccaagtgtccgtgctgaagggacaagtctacattctgggaagagaatctcccttgtcattgtacaacgaggagcttgtctcgatgaatgtgcagggtgattatgaaccgactgatgctactgggtttatcaatatcaacagtcttaggctcaaagaataccatcgcttgcaatcaaaagtgactgcaaagtag

SEQ ID NO: 4217 - DNA, 1239 bp, Artificial Sequence
  Description of Artificial Sequence: Synthetic coding sequence
atgtctagcaaggggtcagtggtcttggcctattccgggggattggatacaagttgcattctcgtgtggctgaaagaacagggatacgacgtgatcgcatacctggctaacatcggccagaaggaggattttgaagaggcacgtaagaaggccctgaaacttggcgcaaaaaaggtttttatcgaagacgtttctcgtgagttcgtggaagaatttatctggccagccattcagtcctctgcactgtatgaggacaggtatttactgggcacctctctggcacgcccatgtatcgccaggaagcaggtcgagattgcccagagagagggcgctaaatatgtcagccatggtgcgaccggtaaaggaaacgatcaggtgcgcttcgagctgagctgctactccctagcaccacagatcaaggtcattgccccttggcgaatgcccgagttttataacaggtttaagggcagaaacgatttgatggagtatgcgaaacaacatggtatccctatcccggttacaccaaagaacccttggagcatggacgaaaacctgatgcatattagctatgaggccggaattcttgaaaaccccaaaaatcaagcccctcccggactttatacaaagacacaggacccagctaaagccccaaacaccccagacattctcgagatcgaattcaagaaaggggtgcccgtgaaagtgacaaatgtgaaggacggcacaactcaccagacatcgctcgagttattcatgtatctaaacgaggtggctggcaaacatggggtgggtcgaatcgatatcgtggagaaccgatttattggcatgaagtcccgcggaatctatgagacaccagcagggacaatcctctaccatgcacatcttgatatagaggcttttactatggatcgcgaggtgcgtaagataaagcaaggcctaggcttgaaatttgcggagctggtttacactgggttctggcactctccagagtgtgaattcgtgaggcattgcatagccaagagtcaggagcgggtggaaggaaaagtgcaagtgagtgtcttaaaggggcaagtatatattttaggcagggaaagtccgctgtctctatacaatgaggaactggtgtctatgaacgtgcaaggggattatgagccaactgacgcaaccggcttcatcaacattaatagcctgcggctgaaggaataccatcgtctccagagcaaagtcactgcaaagtag

SEQ ID NO: 4218 - DNA, 1239 bp, Artificial Sequence
  Description of Artificial Sequence: Synthetic coding sequence
atgagcagcaagggaagcgtggttttagcgtattctggagggctggacacttcctgcatattggtctggctgaaagagcagggatatgacgtgatcgcctacttagccaacattggccagaaggaggattttgaggaggccagaaagaaggctcttaagctgggagccaaaaaggtcttcatagaggatgtatcccgtgagtttgtcgaggaattcatttggccagctatccagtcgtctgccctctacgaagacagatacctcctgggcacaagcctggccagaccctgcatagcaagaaaacaggttgaaatcgcccagcgggagggcgcaaaatatgtctcccacggtgctacgggcaagggtaatgatcaggttcgtttcgaactgagctgttattctctggcccctcagataaaggtaatcgccccatggcggatgcctgagttctacaaccggttcaagggccgaaacgacctgatggagtatgccaagcagcacggaatcccaatcccagtgacgcccaagaatccatggtcaatggatgaaaacctaatgcacatcagttacgaggcagggatcttggaaaacccaaaaaaccaggccccaccaggtttgtacactaagacacaggacccagcaaaagctcctaacaccccagacatcctagagattgaattcaagaaaggagttccagtcaaggtgaccaacgtgaaggatgggacaactcaccagaccagtctggagctgtttatgtatttgaacgaagtcgcaggcaaacacggggtgggcagaatcgacattgttgagaatcggtttataggcatgaaaagcaggggcatctacgagactcctgcgggaactatcttataccatgcccacctggacatcgaagcattcacgatggatcgagaggtccgcaagatcaagcagggacttggacttaagttcgcagagctggtgtataccggcttttggcacagtccggagtgtgaattcgtccgtcactgcatagccaagtcccaagaacgcgtggaagggaaagtccaggtgagtgtactgaagggacaagtctacattctgggtcgcgaatcaccactgtctctgtacaatgaggagttggtctcgatgaacgtgcaaggcgactatgagcccaccgacgccacaggatttatcaatatcaactctctgaggctcaaggagtatcatcgcctgcagagcaaagtcaccgcgaaatag

SEQ ID NO: 4219 - DNA, 597 bp, Artificial Sequence
  Description of Artificial Sequence: Synthetic coding sequence
atgagcagtaaagggtctgtggtgctggcatactccggtggactcgacacctcatgcatcctcgtctggttaaaggaacaaggatatgacgtgatcgcctacttggctaacataggccagaaagaagactttgaggaggccagaaagaaagccttaaagcttggggcaaagaaggttttcatcgaggacgtgtcaagagaattcgtcgaggagtttatttggcccgcaattcaatccagcgctctgtacgaggacaggtacctcttgggcaccagcctcgccaggccatgtatcgcaaggaagcaagtcgagatcgcccagagggagggtgccaagtatgtgtctcacggggctaccggtaagggcaatgaccaagtccggtttgaactttcttgctacagcctggcccctcagataaaagttatcgccccttggaggatgcccgaattctacaaccgcttcaaggggagaaacgacttaatggagtatgcaaaacagcatgggattcccatacctgtgactccaaaaaacccgtggagcatggacgagaatcttatgcatatcagctacgaggctggcatcctagaaaacccttag

SEQ ID NO: 4220 - DNA, 540 bp, Artificial Sequence
  Description of Artificial Sequence: Synthetic coding sequence
atgagcagcaagggatccgtggtgctggcttactccgggggacttgacacatcatgcattctcgtgtggttgaaagagcaggggtatgacgtaatagcatatctcgctaacattggccagaaggaggatttcgaagaggctcgcaaaaaagccctgaagttaggggctaagaaggtcttcatagaggatgtgtcgcgggagttcgtggaagagtttatctggcctgccatccaaagttccgcactgtacgaggatcggtacttactcggcacaagcttggctcgaccttgcattgcgaggaagcaagtggagatcgcccagagggagggggctaaatatgtgtcacacggcgcaaccggcaaggtaattgcgccatggcgcatgcctgagttctataacaggtttaagggtaggaatgatctaatggagtatgccaagcagcatggcatcccaatccccgtcactcccaagaacccctggtccatggacgagaacctgatgcacatcagctacgaggctgggattcttgaaaacccgtag

SEQ ID NO: 4221 - DNA, 663 bp, Artificial Sequence
  Description of Artificial Sequence: Synthetic coding sequence
atggagctggggctgggtggcctctctaccttgtcccactgtccatggccacgccagcagcccgcactctggcccaccctggctgcgctggcactcttgagttcggtggccgaagcctcccttggctcagccccacggtcccctgctcctagggaaggaccgccaccggtgctggctagtcctgccggacacttgcccggtggacggacagcgaggtggtgctctggaagagccagaaggccaccaccgcaacctagccgtccagcaccccctccgccagccccaccgagcgcgctccccagggggggaagggctgcgagagctgggggtcccggaagtcgcgcaagggccgcaggagctagaggttgtagactacgctctcaattggttcctgttagagctctgggtttaggacataggtcagatgaattggtcagattcagattttgttccgggtcgtgccgcagagccagatctcctcacgacctgtcactggcctcactgcttggagccggagctctgaggcccccacccggttccagacctgtttcccagccgtgttgccgaccaacccgctacgaggcagtgagtttcatggacgttaatagcacctggcggactgtggatcgattgtctgccaccgcttgcggatgcctcggttag

SEQ ID NO: 4222 - DNA, 663 bp, Artificial Sequence
  Description of Artificial Sequence: Synthetic coding sequence
atggagctgggcctcggcggattgagtactctttctcactgtccctggcctcgacaacagcctgctctgtggccgaccctggctgctctggcacttctctcaagcgttgccgaagcttctctgggttctgctccccgatctcctgcccctagggagggccctcccccagttcttgcgagccccgcaggacaccttccaggagggaggacagctcggtggtgcagtggcagagccaggcgccctccccctcaaccaagtagaccagcaccacccccacctgccccaccgagtgcacttccacggggaggcagagccgctagggctgggggtcccggatcccgagcccgagccgctggggcaaggggctgccgccttaggagtcaattggtccccgtaagagccctaggactgggccatagaagcgatgagctggttcgcttcaggttttgtagcggctcgtgcagacgtgccaggtcacctcacgacttgtcgctggctagcctgctcggagccggagcacttaggcccccacctgggagcagaccggtgtcacaaccatgttgccggcctacacggtacgaggctgtgtcattcatggacgtgaactcaacgtggagaactgtcgacaggctcagtgcaaccgcttgcggctgcctagggtag

SEQ ID NO: 4223 - DNA, 687 bp, Artificial Sequence
  Description of Artificial Sequence: Synthetic coding sequence
atggaactgggcctcgggggattatctactctttcacactgcccttggcctaggcagcaggccccactgggattaagcgctcagcccgcactttggcctacactggcagctctggctctcctgagttccgtagcagaggcttcccttgggtccgcccctagatcgccagccccacgcgaaggacctccacccgtgctcgcatcaccggcaggccacctccctggaggcagaactgcccgttggtgctccggtagagccagaaggccccctcctcagcccagtagaccagccccaccccctccagcccctcctagcgcgcttcccaggggagggagagcagcacgcgctggtggccctgggagcagagcaagagcggcaggcgctcgcggttgtcgactacgctctcagctggtcccagtcagagccttggggctgggacatcgctccgatgagcttgtgaggttccgcttctgtagcgggtcttgtcgcagagccaggtctccgcatgatcttagcctggcaagtcttctcggcgcaggagcactgaggcctcccccaggctcccgccctgtctcacagccgtgctgcagacctactcgctatgaagctgtgtctttcatggacgtgaactcaacgtggagaacagtggaccgattgtccgcaacggcatgcgggtgtctcggttag

SEQ ID NO: 4224 - DNA, 201 bp, Artificial Sequence
  Description of Artificial Sequence: Synthetic coding sequence
atggaactgggcctgggtggtctgtcaactctatcccactgcccttggccaaggcagcagccggctctgtggcctacattggctgccctggcgctgttaagcagtgtggctgaggccagtctcggaagcgcgccacggagtccagcccctcgggagggcccacctcccgtcttagcctcacctgcaggccacctgccttag

SEQ ID NO: 4225 - DNA, 270 bp, Artificial Sequence
  Description of Artificial Sequence: Synthetic coding sequence
atggaactcggtttgggcggtctgtccaccctgtcgcactgtccatggccaaggcagcaggccccactcggcctctctgcccaaccagctctttggccaactcttgctgccctggcgcttttgagcagcgtggctgaggctagcctgggctcagctccacggagccctgccccaagagaaggccctcctccagttttggccagtcctgccggacacttaccgggaggacgaacagcccgttggtgcagtggaagagcacgcagaccttag

SEQ ID NO: 4226 - DNA, 201 bp, Artificial Sequence
  Description of Artificial Sequence: Synthetic coding sequence
atggaattgggtctgggcggactgtccaccctgtctcactgcccatggcctagacagcagccagccctctggcctaccttggccgctctggccctgctgagtagcgtcgccgaagctagcctcggctctgctcctaggtcacccgcaccaagagaaggcccacctcccgtgctggcctcccccgcagggcatcttccctag

SEQ ID NO: 4227 - DNA, 270 bp, Artificial Sequence
  Description of Artificial Sequence: Synthetic coding sequence
atggagctgggtctgggcggactctctacactttctcattgcccttggccaagacagcaagctcccctaggactgtcagctcagcccgcattatggcccactctagctgctcttgccctgctaagcagcgtcgcggaagcctctttgggcagcgccccaagatcccctgccccacgggagggccctcccccagtactggcctctcctgccggacacctacctggtgggaggacagcgaggtggtgctcaggaagagccagacgaccttag

SEQ ID NO: 4228 - DNA, 687 bp, Artificial Sequence
  Description of Artificial Sequence: Synthetic coding sequence
atggagctgggcttaggaggcttgtctacgctatcccattgcccctggcctcggcagcaggctccactgggcctgtccgcccaaccagccctttggcccacactagcggcattggcccttctaagcagcgtcgcagaggcttcgcttggatccgccccacgttccccggctcccagagaggggccacctccagttctcgccagtcctgctggccacctgccaggcggacgcaccgccaggtggtgcagcggcagagccaggcgacccccaccgcaaccaagtagaccggcaccccctccacccgctcctcccagcgcgctgccacgtggagggagggccgctagggctggaggcccaggcagcagggcgcgagcagcaggggctagaggatgtagactgcgttcccaactggtcccagttcgcgctctgggacttggacaccgtagcgatgagctcgtcagattcagattctgcagtggctcctgccgtcgggctcggagcccccacgacctctccctggcatctcttctgggtgccggtgccttgcggccaccaccagggagtagacctgtttcccaaccatgctgtcgcccaacacgttatgaggcagtgagctttatggacgtcaacagcacctggaggactgtcgatagattgtccgcgactgcctgtggctgcctgggttag

SEQ ID NO: 4229 - DNA, 1602 bp, Artificial Sequence
  Description of Artificial Sequence: Synthetic coding sequence
atggggcctagaggcgctgcttcactgcctaggggcccagggcctcggcgactgctgctgccagttgtacttcccctgctgttactgttgttactggcaccgccaggctccggggctggggcatctcggccaccccaccttgtcttcctcctagccgatgatttgggatggaatgacgtgggctttcatggatcgcgcattcggacacctcatttggatgccctggccgctggcggagtactgctagataattattacacacagccgctctgcactccctcgcggtcacagctactgaccggaagataccagatccggaccggcttgcagcaccagatcatctggccatgccagcccagctgcgtgcctctggacgaaaagcttttgccacagctcctgaaagaagcagggtacactacacatatggtcggcaaatggcatctgggcatgtacaggaaggagtgtctgcccaccagaaggggctttgacacgtatttcgggtacctccttggaagcgaggattattacagccacgagagatgcacattgatcgacgccctgaacgtcacgcgctgtgctctagatttccgcgacggggaagaggtcgccacaggctacaaaaacatgtactccactaacatttttaccaagagggctattgccttaattactaaccatccccctgaaaaaccattattcctgtatttagccctgcagagcgtgcatgagccactccaggtcccagaggagtacctgaagccctatgattttattcaggacaagaatagacatcattacgcgggaatggtgtctctcatggacgaggctgttgggaatgtgacagcagcgctgaagagctcaggtctgtggaacaacactgtgttcattttttcaaccgacaatgggggacagacattggcgggaggcaacaactggcctctcaggggcagaaaatggtctctctgggagggtggggtgagaggagtggggttcgtcgccagtcccctgctgaagcagaaaggtgtcaagaatcgagagctgatccacatctccgattggctcccaactctagtcaaactggcacgaggtcacacaaatggcacaaagcctctggacggctttgacgtatggaaaaccatctccgaaggatccccaagccctcgaattgagttattgcataacatcgatccaaatttcgtggattcctctccttgtcctagaaatagcatggcaccggctaaagatgacagttcgctgcccgagtactccgctttcaacactagcgtacacgcagccatacgccacggaaattggaagctgctgacagggtaccctgggtgtgggtactggtttccaccgccatctcagtacaatgtcagtgagatcccctcttctgatcctcctacaaagacgttgtggctgttcgacattgacagggaccccgaggagcggcatgatctttctagagagtaccctcacattgtgacgaagcttctcagcaggctgcagttttaccataagcattccgtcccggtttatttcccagcccaggatcctaggtgcgatccgaaggctactggagtgtggggtccatggatgtag

SEQ ID NO: 4230 - DNA, 1602 bp, Artificial Sequence
  Description of Artificial Sequence: Synthetic coding sequence
atggggccacgcggagctgcttcgctgccccgtgggcctgggccaaggcggctgttactgccagtggttttacctcttcttctcctgctgctgctcgcccctcccggatctggagctggcgctagcaggccaccacacctggtcttcttactagcagatgacctgggctggaatgatgtgggctttcatggaagtcgtattcgaacccctcatctcgacgccctggccgcaggcggagttctgctggacaactactacacacagcccctttgtaccccctccaggtcacagttactgaccggaaggtaccagatcagaacaggtcttcagcatcagattatatggccatgtcagccatcatgtgttcctctggacgaaaagctgttgccgcaactcctaaaagaggcaggatacaccacccacatggtcggtaaatggcatctgggcatgtaccgaaaggagtgcctgccaactaggaggggcttcgacacttatttcgggtaccttctcggtagcgaagactattactcgcatgaacgctgtacattgattgatgccctaaatgtaactcggtgtgctttggattttagggacggcgaggaagtggcaactggctacaaaaatatgtatagcacaaatatcttcaccaagagggccattgccctgatcaccaaccaccctcccgagaaaccactgttcctttacctggccctgcagagtgtgcacgaacccctgcaggtccctgaggaatatctgaagccttatgacttcattcaagacaagaatagacatcactatgccggaatggtctctttgatggacgaagccgtcgggaacgtcactgctgctttgaagagcagcggtctgtggaacaacacagttttcatttttagtaccgacaatggcggacagaccttggctgggggaaacaattggcctctcagagggcgaaaatggtctctgtgggagggcggtgtgaggggcgtggggtttgtggcatcccccctcctgaaacagaagggagttaaaaatcgagagttaattcacatatcagactggctgcctacgctcgtgaaactggctcgtggtcacacaaacggaacaaagcctctggatggttttgacgtgtggaagacaatatcagaggggtccccaagtccaaggatagagctgctgcataacatcgaccctaattttgtcgacagttccccgtgccctagaaactctatggctcccgcaaaggacgacagctctctgccagagtacagtgcattcaacacatccgtgcacgctgctattcgccacgggaattggaaactcctaactggctacccaggctgtgggtattggtttccaccccctagtcaatataacgtgagtgaaatccctagcagtgatcccccaacgaagacattgtggctgttcgatatcgaccgcgatcccgaagaaagacacgacctctcccgggagtacccccatattgtcactaaactcttaagcaggctgcagttctaccacaagcactctgtgcccgtgtactttcccgcacaagatccgaggtgcgatcctaaggccacaggagtgtggggcccatggatgtag

SEQ ID NO: 4231 - DNA, 1242 bp, Artificial Sequence
  Description of Artificial Sequence: Synthetic coding sequence
atgggacctaggggggctgcctccctgccgcgaggcccaggccctcggagactattacttcccgtggtgctccccttactgcttctgctgctgcttgcacctccgggaagtggagctggcgcatcccggccaccccacctcgtttttttgttagccgatgatctaggttggaacgatgtgggtttccacgggtcgcgtattaggaccccccacctcgacgccttagccgctggtggtgtgctgctggataattactatacccagcctctgtgcacaccaagccgcagccagctgttaaccggtagatatcaaattcgtaccgggcttcagcaccagataatctggccatgccagccctcttgtgtaccgctggacgaaaagctcctgccacaactgctcaaagaggccggatatactactcacatggttggcaaatggcatctcggcatgtaccggaaggagtgcctgccaacccgcagagggtttgacacttactttggctacctgctgggctccgaagattactacagtcacgaaaggtgcactctcatcgacgccttaaacgtaactcgctgcgccctcgacttcagagacggagaggaagtggcgacaggatataagaacatgtactctactaatatttttacgaagcgagccatcgcactaatcactaaccaccctcctgagaaacctctcttcttatacctcgcgcttcagtccgtgcatgaaccactacaagttcccgaagaatacctgaagccatacgacttcatccaggataaaaacagacaccattatgccggaatggttagtctaatggacgaagccgtaggcaacgttacagcagcattgaaatcgagcggcctttggaataacacagtgttcatcttttccaccgacaacggtggacagacgctggcgggaggaaataattggcctctgcggggacgaaaatggagcctgtgggaaggcggtgttcggggagtcggattcgtagcgtctcctctgctcaagcaaaaaggggtgaagaatcgcgagctgatccatatttcagattggctgccaaccctggtgaaactggctcgcggacacaccaacggcacaaaacctctggacggtttcgatgtgtggaagaccatttcagaggggtccccatctccgagaatcgaactgctgcacaatatcgatccaaattttgtagatagcagcccctactggccagagtgctcactgttgctctag

SEQ ID NO: 4232 - DNA, 138 bp, Artificial Sequence
  Description of Artificial Sequence: Synthetic coding sequence
atgggtccgagaggtgcggcttcactccccaggggacccggtcctaggaggttattgttaccggtggtcctcccacttcttctgttgctcctgctagcaccacctggcagtggcgctggggcttcccgcccaccatag

SEQ ID NO: 4233 - DNA, 1788 bp, Artificial Sequence
  Description of Artificial Sequence: Synthetic coding sequence
atggccggacccagcccgcctctccgcgcaggggtgggaaggcgcctgctgggcgtcgcccaccctgatttgaggccctgcctgtgcggggagttacaggttgagggaggacctggcccagtgcctggaatgctgcggacatgttatgtgaggagcccctggcgaagggggccttcctccgcccgaggcgagcagtcaggctcgggacacttagagcaagaagaagtgcaaagtgggagcctgttgttcaggttgctcttattcctgagtaggagccctgcttccaggaatcaaagaatcctctacacagttctcgagtgccagccacttttcgattcctcagatatgacaatcgccgaatgggtgtgtctggctcagaccataaaacgccattacgagcaataccatggctttgttgtgattcatgggaccgacactatggcctttgcagcatctatgctgtctttcatgctggaaaatctgcagaaaactgttatcctgacgggagcccaggtccccatccatgctctgtggtccgacggacgggaaaatttgctgggcgctctccttatggcaggccagtacgtgattccagaagtgtgtctgttcttccagaatcagctgttccgaggaaatcgtgccaccaaagtggacgcccgacgatttgcagcattctgtagccccaacctcctcccccttgcgacggtcggggcagatattacaataaaccgagagctcgtccgcaaagtcgacggcaaagctggcctggtggtgcattccagcatggagcaggatgtgggacttctccgactgtaccccggtatccccgctgctctggtccgcgcattcctccaaccaccactcaagggcgtggtgatggagaccttcggctcagggaatggaccgacaaagcctgacctgctgcaggagctgcgcgtggctactgaacgtggcctagtgatagtgaactgcacccattgccttcagggagcagtgactaccgactacgcagccggaatggcgatggcaggggcaggtgtcattagtgggttcgatatgacttccgaagccgcactggcaaaattatcctatgtcctgggccagcccggacttagtctggatgtgaggaaggaactcctgacgaaggatctcagaggcgaaatgacccctcccagcgttgaggaaaggaggccttctctgcagggcaacaccctgggaggcggagtttcctggttgctctcacttagcggcagccaggaggccgatgcgttgcgcaatgctctggtgcccagcttggcctgcgcagccgctcacgccggtgacgtggaagccctgcaagcgctcgtggaactgggttccgacctcgggctggttgacttcaacggtcagacccctctccacgctgcggctcgtgggggacacaccgaagccgtaactatgctgctgcaacgtggggtggatgtcaacacaagagataccgacggcttctccccacttttgctggccgtcagaggcagacatcccggagttattgggctgttacgggaagccggtgcatcattgtccactcaggagcttgaggaggccggaacggagctttgtagactggcatacagggccgacctggagggtctgcaggtatggtggcaggcaggagcggacctcggccagcccggatacgacggtcacagtgctctgcacgtcgctgaggccgcaggtaatttggccgtcgtcgccttcttgcagagtctcgagggagccgtgggcgcacaggccccatgcccttag

SEQ ID NO: 4234 - DNA, 1740 bp, Artificial Sequence
  Description of Artificial Sequence: Synthetic coding sequence
atggcacgggcagttggtcccgagcgcagactgctggcagtgtacaccggcggtaccataggcatgcgtagcgagttgggcgtcttagttccgggaaccggccttgccgcaatactccgaactttgccgatgtttcatgatgaggaacacgccagggcaagaggcttaagtgaagatactttagtcctgccacctgccagtcgaaaccagcgcatcctgtataccgtgctggaatgtcagcctctgtttgactcatccgatatgaccatcgccgagtgggtctgcctagcccagaccataaagcggcattacgaacagtaccacggcttcgttgtgattcacggaacagatactatggcatttgcggcatccatgctgagttttatgttagaaaacctccagaaaacagtgatcctgaccggtgcccaagtgccgatacacgcactgtggagcgacgggagagaaaatctgctgggcgctctcctgatggcaggtcaatatgtgatccctgaagtatgcctttttttccagaatcagttattccggggaaacagggcaaccaaggttgatgcacgcaggtttgctgccttctgttcaccgaaccttcttcctctggcaacggtgggagccgatatcaccatcaaccgcgagctggtgcggaaagtggatggcaaagctggcctggtggttcattcatccatggagcaggacgtggggctgctgcgattgtacccagggatacccgcagcgcttgttagagcatttctgcaacccccacttaagggcgttgtgatggagacctttggcagcgggaacgggccaaccaaacctgacctgctccaggagctgagagtagccactgaaagagggctggtaatcgtgaactgcacacattgccttcaaggcgctgtcaccactgactatgcagccggaatggctatggcaggcgctggggtcatcagcggatttgatatgacttccgaagccgctcttgccaaactgagctacgtgctgggccagcctggcctaagtttggacgtcagaaaggaactgctgacgaaagatcttcgcggtgagatgacaccaccctctgtcgaggagagaaggccgagtctccaaggcaacacactaggagggggtgtgtcctggctacttagcctgtctggctcacaagaggcggatgccctaaggaatgccctggtgccttcactcgcctgcgccgctgctcacgcaggcgatgtcgaggcactacaggccctcgtggagttaggaagtgatcttgggctcgtggacttcaatgggcagacacccctgcatgctgcggcaaggggcggacatactgaggcggtgacaatgctgttgcagcggggagtggatgtcaacacgcgagatactgatggattttcgccccttctgctggccgtgcgcggacggcacccaggtgtgatcggtcttttgcgagaagccggagcttctctgtcaacgcaagagcttgaggaggctggaacagaattatgcagactggcctaccgggctgacctggaaggcttacaagtgtggtggcaagccggagcagacctgggtcagcctgggtatgacggccattccgcgcttcacgtggccgaggctgctggcaatttggctgtggtcgcgttcctccagtccttggaaggcgctgtaggcgctcaggccccttgcccagagccaagctgtttccaggaagtgttacctggcgtttag

SEQ ID NO: 4235 - DNA, 423 bp, Artificial Sequence
  Description of Artificial Sequence: Synthetic coding sequence
gctgcggctcgcggtggacacacagaagccgtgacaatgctcctgcagcggggtgtggacgtaaatacccgggacaccgatggcttctcaccactgctcctggccgttagagggcgacacccaggtgtcattggactgctgagagaagcgggagccagtctgtccactcaggagctggaggaagcaggcactgagttgtgtaggctggcatatcgcgcagatctggaagggttgcaggtgtggtggcaagccggtgccgatttggggcaacctggctacgatggccacagtgcactccatgtggctgaggccgctggaaacctggcagtcgtcgccttccttcaatctctggaaggagctgtgggcgctcaagccccatgcccagagccatcctgtttccaagaggtgctgcccggagtgtag

SEQ ID NO: 4236 - DNA, 1722 bp, Artificial Sequence
  Description of Artificial Sequence: Synthetic coding sequence
atggctcgagcagtgggtcctgaacgcagactgctggctgtttataccggcggaaccatcggcatgcgctcggagctgggcgtccttgtgcccggaacaggattggcagccatcctgaggaccctgccgatgttccacgacgaggagcacgctcgggcacggggtctgtccgaggacacattggtgctgccccctgcttctagaaaccagcggattctctataccgtgctggaatgccaacccttatttgactcttcggatatgacaattgccgagtgggtgtgcctggcgcaaaccataaagcgtcattacgagcaataccatggattcgttgttatccacggcaccgacactatggcgtttgccgcttccatgttatcattcatgctcgagaacctgcagaaaactgtgatcctaactggtgcacaggtccctatccacgccctttggtccgacggacgggaaaacctccttggtgctcttttgatggccggacagtacgtgatcccggaggtgtgtttatttttccagaatcaactgtttcggggaaatcgtgcaaccaaagttgacgcaaggcggttcgcagccttttgcagccccaatctgctccctctcgcaaccgtaggagccgatattacgattaacagggagctagtgcggaaagtggacggtaaggccggtttggtggtacactcaagtatggagcaggatgttggattactgaggctgtatcctggtatcccagctgccctggttagggccttcctgcagccaccactcaagggggtggtcatggagacttttggtagcggcaatggccctaccaagccggatcttttgcaggaactgcgtgtggccacagaacgcggactggtgatcgtcaactgcacccactgtcttcagggcgctgtgacgacagattatgcggcagggatggctatggctggcgcaggcgtgatttctggtttcgatatgacatcagaggccgctctcgccaagctgtcttacgtactgggacaacctggcctgagccttgacgtgcggaaagaacttctgactaaagatctccgtggtgaaatgaccccgccttccgtggaagagcgtaggccttctctccagggcaatacgctgggaggcggtgtcagctggctgctctccttgagtggctcacaggaagcagacgccctgcgcaacgctttggtgccatccctagcatgcgcagccgcacatgctggggacgtggaggccctgcaggcccttgtagaactgggctcggacctaggtttggtggactttaatggtcagacacccctgcatgcagcagcacgtggcggacacacagaggccgtaaccatgctcctccagcgcggagtcgacgtgaacacaagagacacggacggtttttcaccgctactgctcgctgtgagaggccgtcacccgggtgtcatcggactgctgagggaggctggtgcctctctgagcacacaggagcttgaggaggctgggaccgaactgtgtcgcctcgcttacagagccgacctggaaggactccaagtttggtggcaggctggggcagacttgggacaaccgggatatgatggtcatagtgctctgcacgttgctgaggccgcaggtaacctcgccgtcgtagcttttctccagtccctggaaggggctgtcggggcacaggccccttgtcctgaggtactcccaggcgtgtag

SEQ ID NO: 4237 - DNA, 942 bp, Artificial Sequence
  Description of Artificial Sequence: Synthetic coding sequence
atgacgtcctgccacatagctgaggagcacatccagaaggtggcaatctttggcggtacacacggcaatgagctgacaggggtgttcctagtgaagcactggctcgaaaacggggcagaaatccagcggactggacttgaagtgaagcctttcatcactaaccccagggccgttaaaaaatgtacgcggtatatcgactgtgacctgaaccgcatttttgaccttgaaaacctcggaaaaaagatgagcgaggacctcccctacgaggtgcgcagagcccaggagatcaatcacctgtttgggccaaaggattcggaggattcatatgatatcatttttgacctccacaacaccacctctaatatgggatgcacacttatcctggaggactcccgcaataattttttgattcagatgtttcattacatcaagacctctctggcacccttaccttgctatgtgtacctcattgagcacccttcccttaaatacgcaacaactaggtcaatagcaaagtaccctgtgggcatcgaggtcggtcctcagccacaaggcgtcctgcgcgctgacatacttgatcagatgagaaaaatgataaagcacgcattggatttcatccatcacttcaatgaaggaaaagaattcccgccatgtgctattgaggtgtataagatcattgagaaagtggactaccctagagacgagaacggtgagatcgcagccataatccacccaaatctccaagaccaggattggaaaccactgcaccctggggaccctatgttcctgacgctggacgggaaaacaattccccttggcggagattgcaccgtgtatccagtattcgttaatgaagccgcttactacgagaagaaggaggcgttcgccaagacaactaagctcacactgaatgctaaaagtatccgttgctgcttgcactag

SEQ ID NO: 4238 - DNA, 942 bp, Artificial Sequence
  Description of Artificial Sequence: Synthetic coding sequence
atgacaagttgccatatcgccgaggagcacattcagaaggtggcaatttttggtggaacacatgggaacgagctgaccggcgtgttcctagtgaaacattggctggagaacggcgctgagatccagcggaccggcctggaggtgaagccttttatcactaatcctagagccgtgaagaagtgcacccggtatatcgattgcgatctgaacaggatcttcgaccttgagaacttagggaaaaagatgtcagaggatctgccttacgaggtgagacgtgcccaggagatcaatcacctgttcgggccaaaagactctgaggactcatacgatataattttcgatctgcataacactacgagcaatatgggttgtaccttaattctggaggacagccggaacaatttcctcattcagatgttccattatatcaaaaccagcctagcccctttaccgtgttacgtctacttaatagagcacccgtccctgaagtatgccaccactagatccatagccaaataccccgtgggaattgaagtgggccctcagccgcagggggtattgcgcgcagacattctggaccaaatgcggaagatgattaaacatgctcttgacttcatccaccactttaatgaggggaaggagtttcccccttgtgccatcgaggtatataaaatcatagagaaggtcgattacccgcgtgatgagaatggtgaaattgctgccatcatccacccaaaccttcaggaccaagattggaaaccgttgcatccgggtgaccctatgttcctcactctagatggtaaaacaattccactcggaggggattgcaccgtgtacccagtgtttgtgaatgaggccgcttattatgagaagaaggaggcttttgccaaaacgactaagctcacactgaacgctaaaagcattcgctgttgcctgcattag

SEQ ID NO: 4239 - DNA, 3756 bp, Artificial Sequence
  Description of Artificial Sequence: Synthetic coding sequence
atgtccactgaaagggactcggagaccacctttgacgaagattcacagccgaatgacgaagtggttccttacagcgatgacgagactgaggatgagctcgacgaccaaggttctgccgtggagccggaacaaaacagggtcaacagagaggctgaagaaaaccgggagccgtttcgaaaggaatgtacgtggcaggtgaaggctaacgacagaaagtaccacgagcagccacactttatgaacactaaattcttatgcattaaggaatccaagtacgcaaacaacgccatcaagacatataagtacaacgcgtttacctttattccgatgaaccttttcgagcagttcaaacgcgctgccaacctgtacttcctcgctcttctgattcttcaagctgttccacagatatccactttggcttggtatactactctggtgcccctactggtggttcttggcgtaactgccattaaggatctggtggatgatgtagcacgacacaagatggacaaggagatcaacaaccggacttgtgaagtaatcaaggatggcaggtttaaagtagcgaagtggaaagagatacaagtgggtgacgtcatcagactgaaaaaaaacgacttcgtgccagctgatatactgctgctctctagtagcgaacccaatagtctgtgttatgtggagacagcagagttggatggcgaaactaatcttaagttcaaaatgagtctcgaaattacagaccagtatttacagcgggaggatacactggctacattcgacggttttatagaatgcgaggaaccaaataacaggctagacaagttcacaggaaccttattctggaggaatacatcattcccactggacgctgataagattctgctgagaggatgtgtgatcaggaatactgacttttgccacggtctggtgatcttcgccggagcagatacaaaaattatgaagaacagcggtaaaacaagatttaagcgcactaaaattgattacctgatgaattacatggtgtacactatttttgtcgtcctgattctgctttcagcgggacttgctattgggcatgcttattgggaggcacaagtgggaaactcaagttggtacctatatgacggcgaagatgatacacccagttatagaggctttctgatcttctgggggtacatcatcgtcttaaataccatggtccccatcagcctgtacgtgagcgtcgaggtgatccgtttgggccagtcccacttcattaactgggacttgcagatgtactacgcagagaaggatacacctgccaaagcgaggacgacaacgctcaatgaacagttaggccaaatccactatatctttagcgataagacaggaacacttacacagaatattatgacctttaagaagtgttgcataaacgggcaaatttacggagatcaccgggacgctagtcagcataaccacaacaaaattgaacaggtggacttttcatggaatacatacgctgacgggaagctcgctttttacgatcactatttgatcgaacagatacagtcaggtaaggagcctgaggtgaggcaattttttttcctgctggcagtatgtcataccgtgatggtcgatcgaactgacgggcagctcaactaccaggcagcttcccccgatgagggagctctcgtgaatgctgcacgcaacttcggcttcgcattcctcgctaggactcaaaatacaatcacaatcagcgagttaggcacggagcggacttacaacgtcctggcaatcctggactttaactccgacagaaagcggatgtccattatcgttaggacccccgagggcaacatcaagctgtattgtaagggcgcagacaccgttatctatgaaaggcttcatcgcatgaatcccacaaagcaggagacccaggatgcactggacatcttcgctaacgagacactaagaacactgtgtttatgctataaggaaatcgaagagaaagagtttacagaatggaataagaaatttatggctgcctctgtcgctagtactaatcgcgacgaggccctggacaaggtttatgaagagatcgagaaagatttgatcttattaggggcaactgcgatcgaggataaactgcaagatggggtacccgaaacaatcagcaagctggccaaagcagatattaagatttgggtactgacaggagataaaaaggaaactgccgagaatattggatttgcctgcgagctacttactgaagacactacgatttgctacggcgaggacataaactctttgctgcacgcacggatggagaaccagaggaatagaggaggcgtgtatgctaagttcgcgccacctgtgcaggaaagtttcttcccacccggaggcaatcgtgctttgatcatcacgggcagttggcttaacgagatcttacttgaaaagaaaacaaaacggaacaaaattctgaagctcaagttccctaggaccgaagaagaacgcaggatgagaacgcagtcgaaacgaagacttgaagccaagaaagagcagcggcagaaaaattttgtagacctcgcctgcgagtgctctgccgtgatttgttgcagggtaacacctaagcagaaagccatggtagtggatctcgtcaaacggtacaagaaagctatcaccttggcaattggtgacggtgcaaatgatgtgaatatgattaaaactgctcatattggcgtggggatttccggccaggaagggatgcaggctgtaatgagttcggactactccttcgcacagtttaggtaccttcagaggttgctgctggtccatggcagatggtcctacatccggatgtgcaaatttctgcgttacttcttttacaaaaactttgcattcactctggttcatttttggtactcattcttcaatggttattctgcacaaaccgcttacgaagactggtttattaccctgtataacgtgttgtacacgagtctgcccgtgctgttgatggggttgcttgatcaagacgtcagcgacaagctgtcgctgcggttcccagggctatacatagtgggccaacgcgatctgctgtttaattacaagcgttttttcgtatctctgctgcatggagtccttaccagtatgatcctcttcttcatccctttgggtgcatacctgcagaccgtgggccaggatggggaagcaccatctgattaccagtcttttgctgttacaattgcttcggccctggttataacagtgaactttcagattgggctggatacctcctactggacttttgtcaacgctttttctatctttggctcaattgccctgtattttgggatcatgttcgacttccattctgccggaattcatgttcttttccccagcgctttccagtttaccggcaccgcatcaaacgccctgaggcagccgtacatctggctgaccattattctcgctgtggccgtttgtctgttacctgtcgtcgcgatccgtttcctgagtatgactatttggccaagtgagagtgacaagatccaaaaacaccgaaagagactgaaggccgaggagcaatggcagaggcggcagcaggtatttcgccgaggggtcagtacacggcgttccgcttacgccttttctcaccagagagggtacgcggacctcatcagttctggaaggagtatccgtaagaagcgcagtcctcttgatgccatcgtggccgacggtacagctgagtacaggagaactggagatagctag

SEQ ID NO: 4240 - DNA, 3756 bp, Artificial Sequence
  Description of Artificial Sequence: Synthetic coding sequence
atgagtaccgagcgcgattcagaaaccacttttgatgaagacagccagcctaatgacgaagtcgtcccgtactccgatgatgagacggaagatgagctggatgaccagggcagtgctgtggagccggaacaaaacagagtaaatcgcgaagccgaggagaatcgcgagccttttcggaaagagtgcacgtggcaggtaaaggccaatgaccgcaagtaccatgaacagcctcactttatgaacactaaattcctgtgtatcaaggagagcaagtacgccaataatgcgataaaaacttataaatacaacgcattcacttttatccctatgaatctttttgagcagttcaaacgcgcagccaatctctattttctggccctgttaattctacaggccgtgcctcagatatctactcttgcctggtatacgacattggtccccctgctggttgtgctaggtgtgaccgccattaaggatcttgtagatgacgtggcgcgacacaaaatggacaaagagattaacaaccgtacctgcgaagtcatcaaggatggcaggtttaaggtggctaaatggaaagaaatacaagttggtgatgtgatcagactcaagaagaacgactttgtaccggcagatattttactgctgagttcatctgagcccaatagcttgtgttatgtggagacagctgagctggacggggagacaaatcttaaatttaagatgagcctcgaaattacggatcagtatctgcagcgcgaagacacccttgctacatttgacggcttcatcgagtgcgaggaacctaataaccggctcgacaagtttacaggcaccctcttttggcggaataccagttttcctcttgacgctgacaaaattctgctgcgtggctgtgtcatccggaacaccgacttttgccacggtttggtgatattcgcaggcgctgatacaaagattatgaagaatagcgggaagacaaggtttaagagaacaaagatcgattacctgatgaactatatggtctacactatctttgtcgtgctgatcctgctgagtgccggactcgccataggtcatgcctactgggaggctcaggtgggtaattctagctggtatttgtacgacggggaggacgatacaccctcctatcgtggttttctcattttctggggatatataatcgtgctcaacacaatggttccaattagcctctacgtctccgtcgaagtcatcagactggggcagtcacatttcatcaattgggatttgcaaatgtattacgccgaaaaggatacccctgccaaagcccgaactacgactttgaacgagcagctcggccagattcattatatcttttccgacaagaccggaactttgactcagaacatcatgacgtttaaaaaatgttgtattaatggccaaatttatggcgaccaccgggatgcatcacagcataatcataataagatagagcaggttgacttctcatggaatacttacgccgacggaaagctggccttctatgatcactacctgatcgagcagattcagtctggaaaggaacctgaggttcggcagttcttctttctgcttgccgtgtgccataccgtcatggtggataggacagacgggcagttgaactaccaagctgcttcccccgacgagggagcccttgtgaacgctgcaagaaactttggcttcgccttcctcgcaaggactcagaacacaatcacaattagcgaactggggactgagaggacatacaatgtgcttgcaatcttagactttaattcagaccggaagcgaatgagcataattgttagaactcctgagggcaatatcaaattatactgtaaaggggcagatactgtgatttatgaaagactccacaggatgaaccctacaaagcaagagacgcaggacgccctcgatatctttgctaacgagacccttcggacactctgcttatgctacaaggagattgaagaaaaggagtttacggaatggaacaagaagttcatggccgctagcgtggcctccactaatcgcgacgaggctctagataaggtctacgaggagattgagaaagacctgattctcctcggcgctaccgccattgaggacaaactccaggacggcgtgccagagacgatctccaagctggctaaggcagacataaagatatgggtcctcaccggcgacaaaaaggagacagctgaaaacattggcttcgcttgtgaactgctcacggaagacactactatctgctacggggaggacattaattccctactgcatgccagaatggagaaccaacggaaccgcggaggcgtctatgcaaaatttgccccaccagtgcaagagtccttctttcctcctggcggaaacagggcgcttatcatcacaggaagttggctgaacgagattctcctagagaagaagaccaagaggaacaaaattctgaaacttaagtttccacgtaccgaagaagagaggcgcatgcgcacccagtctaagaggcgactggaagcgaagaaagaacagagacaaaaaaatttcgtggatctcgcctgtgagtgttctgcagttatttgttgccgcgtgacccccaaacagaaagctatggtggtggacctcgttaagaggtataaaaaggcgattacattggcaattggagacggggcaaatgacgtgaatatgattaagactgctcacattggggtgggcatatctggacaggagggtatgcaggctgtgatgagctcggactacagcttcgctcagtttagatatctgcaacgcctattgctggttcacggccgatggagttacataagaatgtgtaaatttctgcgatattttttctacaagaacttcgcatttaccttggtccatttttggtattccttcttcaatggctattctgcccaaaccgcatatgaggattggttcatcaccctgtacaacgtgttgtatacttcattaccagttctcttaatgggactcttagaccaggacgtgagcgacaaactctcattgaggtttcctggcctgtatattgtcgggcagcgcgatctgctgtttaattacaagagattctttgtctctctgctgcacggggttttgaccagcatgattctgttcttcatcccccttggcgcttacctccaaacagtcgggcaagacggagaagccccttctgattaccaaagcttcgccgttactatcgcttccgctctggtgatcactgttaatttccaaataggactggacactagctactggacttttgtgaatgcctttagtatttttggctctatcgccttatatttcgggattatgtttgactttcacagcgccggtattcatgtgctctttccctcagcctttcagttcactggaaccgctagcaacgcattgaggcaaccttatatttggctcacaatcatcctcgcggtggctgtttgcctcttacccgtcgtggccatccggttcctgtccatgacaatatggccatctgagtccgacaagattcagaagcacagaaagaggctcaaggcagaggaacaatggcagagacgacagcaagtgttcagaagaggagtgagcaccagaagatcagcatacgctttttcacatcagcggggatatgcagacctgatctcttcagggcgatccattagaaagaaacggtccccgctggatgctatagtggctgatgggacagctgaataccggaggaccggtgattcatag

SEQ ID NO: 4241 - DNA, 4398 bp, Artificial Sequence
  Description of Artificial Sequence: Synthetic coding sequence
atgcccgaacaggagcgacagatcaccgcgcgagaaggggcatcacggaagattctctctaagctgagcctgcctacaagggcctgggaacctgctatgaagaaaagcttcgccttcgataatgttggatatgagggcggactcgatggcttggggccatcaagtcaggttgccactagcacggttaggatattaggaatgacttgccagtcttgtgttaaaagtattgaggaccggattagcaacttgaaaggaatcatctcaatgaaggtgtctctggaacagggttctgctaccgtaaagtatgtgccatcagtcgtctgtctacaacaggtctgccaccagattggggacatgggattcgaagcatctatagcagagggaaaagccgcatcctggcctagtagatcattgccagcccaggaggccgttgttaagttgagggtcgagggcatgacctgccagagctgtgtgtcctccatcgaaggcaaagtgcgcaagctccaaggagtggtaagagtcaaggtgtcactgtccaatcaggaggccgtgataacctaccagccctacctgatccagccagaagatctgcgagaccacgttaatgacatgggcttcgaggccgcaattaaaagtaaggtcgcccctttgtcgcttggtcctatcgacatagaaagactgcagtccacaaacccaaagcggcctctgtccagcgccaatcaaaacttcaacaacagtgaaactttgggccatcaggggtcacatgtggtaaccctgcagctgcgtattgatggaatgcattgcaagtcttgtgtgcttaacatagaggagaatatcgggcaactcctcggggtgcaaagcatccaggtcagtcttgagaataaaacggcacaagttaagtacgatccatcctgtacctctcccgtggccctccagagggctatagaagcattgccacccggaaactttaaggtgagtctgcctgacggcgcagagggtagcgggacagaccaccgtagctcatcgtcacactctccgggtagcccaccccgtaaccaggttcaggggacttgttcaacaaccctgattgccatcgcagggatgacctgcgctagctgtgtgcatagtatagaggggatgatttcacagttagagggggttcagcagatctccgtctcactggccgagggcacagcaaccgtgttatacaatccatccgtgattagtcccgaggagctccgggcagccatagaggacatgggatttgaggcgtccgtggtgtcagaatcatgtagcaccaatcccctgggaaaccacagcgccggtaatagtatggtccagacgaccgacggcacccccactagcgtgcaggaagtggcaccccacactggccgattgccagccaatcacgccccagacatattggctaagagcccccagtcgacaagagccgtggcgccacagaaatgcttcctgcaaatcaagggaatgacatgtgcatcctgcgtgtcaaacatcgagcggaacctccagaaggaggctggtgtcttgtcggtactggtggccttaatggcaggcaaagctgagatcaaatacgaccccgaggtcattcagcctttagagatagcccagttcatccaggacctgggattcgaagctgcggtgatggaagattacgccggtagtgatgggaacattgagttgactatcacaggaatgacctgtgcatcgtgcgtgcacaatatcgaaagcaagctgacccgaactaacgggataacttacgcaagtgttgctttagccacatcaaaggcactggtcaagttcgatcccgaaattattggcccacgtgatataattaagatcatcgaagaaatcggctttcatgccagcctggctcagcgcaaccctaatgcccatcacctggaccataaaatggaaattaagcagtggaaaaaatccttcctgtgtagtctcgtgttcgggatccccgtcatggccctgatgatctacatgttaatcccttccaacgaacctcaccaaagcatggtgctggaccacaatatcatccccggtctctcaatcttaaatctcatcttcttcatcctatgtactttcgtgcaactgttagggggatggtatttttatgtgcaggcatacaagtcgctaaggcatcgttcagcaaatatggatgtcctcattgttctagctacaagtattgcctatgtttacagcttggtgattctggtagtagctgttgcagagaaggcggagaggtcacctgtcacgttttttgatactcccccaatgctgtttgtgttcatcgctctcggacgctggctggagcacttggccaaatccaagaccagcgaagcccttgccaagctaatgagcctgcaggccacggaggccacagtggtcaccttgggagaggacaatctgatcatccgtgaggagcaggtgcctatggaactggtgcagaggggcgacatagtgaaggtggtcccgggaggcaaatttccagttgatggcaaggtcctggaaggtaacaccatggctgacgagagtctgatcacaggcgaagctatgcctgtgacaaaaaaaccagggagtaccgttatcgctggctccattaatgcccatgggtccgtgttgataaaagccacacatgtggggaatgacactacactggcccagattgtgaaacttgttgaagaggcacaaatgtcaaaggcacctatccagcaactcgccgaccgcttttctggatactttgtgcccttcattatcataatgtcgacgttaacgctcgtcgtgtggattgttataggtttcatcgactttggggtcgttcaaagatactttcccaaccccaacaagcacattagccagaccgaggttatcatcagatttgccttccagacaagcattacggtgctatgcatcgcctgtccttgctctctggggttagcaacccccaccgccgtcatggtgggaacaggagtcgccgcacagaatggcatactgattaagggtggaaagcctttagaaatggcccacaaaatcaaaacggtcatgtttgataaaaccggcactatcactcatggcgtgccgagggtgatgcgcgtgttgctgttgggagacgtggctactcttcctttacggaaagtcctcgcggtcgttggtactgccgaagcctcctcagagcacccactgggcgtggcggtgactaagtattgcaaggaagaactagggacggagaccctcgggtactgcacagattttcaggccgtgcccggatgtggaatcggatgtaaggtctcaaacgtggagggaatattggcccacagcgagcgaccactctcagcccctgccagccatctgaacgaagccggatccctgcctgccgaaaaagacgctgtgccccagacgttctccgtgctgattggaaaccgtgaatggctcagaaggaacggactcacaatcagttctgacgtctctgatgccatgaccgaccacgagatgaaggggcaaacagctatcttagtggctatcgatggcgttttatgtggcatgatcgcaatagcagacgccgtcaagcaagaggccgctctggccgtacacacacttcagtcaatgggcgtagacgttgtgctgatcaccggcgacaatcgcaaaacagcacgagctatagccacccaagttggaattaataaggtgttcgccgaggtactgccctctcacaaggttgcgaaagttcaggaactgcagaataagggcaagaaagtggcaatggtcggggacggggttaatgactcgccagcactcgcacaggccgatatgggggtagcaatcggtacaggaaccgacgtggcaatagaggctgctgatgtagtgttaattaggaacgacttgttagacgtggtggctagcattcatctgtctaaacgcacagtgagaaggatcaggatcaatctggtcctcgcactgatatacaatttagtgggcatccccatcgcagccggtgtattcatgccaataggaatcgttctccagccctggatgggcagtgccgcaatggcagcttctagtgtcagcgtggtgcttagtagcctgcaactgaagtgttataagaaacctgatctggagcgttacgaagcccaagcccacgggcacatgaaacctctgactgctagccaagtgagtgttcatattgggatggacgaccggtggagggattctcctcgcgcaacaccttgggatcaggtctcgtacgttagtcaagtgagcttgagttcactgacctcagataagccctctcggcattcagctgccgcagatgacgacggcgataagtggtccttactcttgaatgggagggatgaggagcagtacatctag

SEQ ID NO: 4242 - DNA, 3777 bp, Artificial Sequence
  Description of Artificial Sequence: Synthetic coding sequence
atgccagaacaggaacgacagataacagctagggaaggggcttcccgaaagattttgtcgaaattaagtttacctacacgagcctgggaacccgctatgaaaaagagcttcgcctttgacaacgttggatatgaaggcggactggacggactgggccctagctctcaggtcgctacctcgaccgtgagaatccttgggatgacatgccagtcatgtgtaaaaagtatcgaggatcgcatctcaaacctaaagggcataatttcaatgaaggtctcccttgagcaggggagcgcaactgttaaatatgtgcccagcgtagtttgcttgcagcaggtgtgccaccagataggcgatatgggctttgaggcatctatagctgagggcaaagcggcttcatggccgtcacgttcacttcccgcacaagaggccgtggtgaaactccgcgtggagggaatgacatgccagagctgtgtgtccagcattgaggggaaggtacgaaagttacagggggtggtgagggtgaaggtatccttatccaaccaagaggccgtcatcacctaccagccctacctgattcagcctgaggacttgagagatcacgtcaacgacatgggcttcgaagccgctattaaatctaaggtggctccactgtccctcggacccatcgacattgaacgacttcagtcaactaaccctaagcgcccattaagttctgccaatcagaactttaacaattccgaaaccctgggacaccaggggtcccacgtcgtaacactgcagctgcgcatcgatggaatgcactgtaagagctgcgttctgaatattgaggagaacattggccagttgctgggcgtgcagagcatccaagtctctctggagaacaagaccgcccaggtaaaatatgaccccagctgcacctcgcctgtggcgttgcagagagcaattgaggctctcccccctggcaatttcaaagtttcattgccagatggggctgaggggtccggcactgatcatcgctctagcagctctcactcacccggatcccctcccaggaaccaagttcagggaacatgttctacaacactgattgcaatcgccggaatgacatgtgcatcctgcgtgcactctattgaaggtatgatctcacagctggagggcgtgcagcagatctcagtgtcactagccgaaggaaccgcaaccgtactgtacaatccctccgtcattagcccagaagaactccgggcagccatcgaagatatgggattcgaggcatctgtggtcagcgagagctgttctaccaaccctctgggaaaccattctgccggtaatagcatggtgcagacaaccgatggtacgcccacttccgttcaggaagtagcaccccataccggtcgacttcctgctaatcacgcaccagatatactggctaaatcaccacagtctacccgagctgtagccccacagaaatgtttccttcaaattaagggaatgacatgtgctagttgcgtatcaaatatcgagagaaatctacagaaagaggccggtgttctctcagtgttggttgcactgatggctggtaaagcagagattaagtatgaccccgaggtgattcagcccctggagatagctcaatttatccaggacttggggtttgaggccgcagtgatggaggattacgctggttctgatgggaacatcgagcttactataaccggaatgacttgtgcctcttgcgtccataatattgagagcaagttgacacggactaatggtattacatacgcatcagtggccctggccacctccaaggccctggtcaagtttgacccagagattatcgggccacgtgatatcattaagatcatcgagagtaaaacatcagaagctttagcaaaacttatgtccctgcaggccactgaagccacagtggttacactgggggaagacaacttgattatccgagaggagcaggtgccaatggaactggttcagcgcggagacatcgttaaagtggtgccgggtgggaaattcccagttgatggtaaagtcctcgaaggcaatacaatggctgatgagagcctgattaccggagaagcaatgccggttaccaagaaacctggctccactgtgatcgctggttctattaacgcacacggatctgtcctgatcaaagccacgcatgtcgggaacgataccacattggcgcagattgtgaagctagtcgaagaagcacagatgtcaaagaatccgaacaagcatatttcacagactgaggtaatcatccgcttcgccttccaaacatccataaccgtcttgtgcatcgcatgtccctgtagcctgggcctggccacacccacagctgtgatggtcgggacaggagtggcagcgcagaatggcatcctgatcaagggcggaaagcctctggagatggctcataagatcaaaacagtgatgttcgataaaactggaactatcactcatggagtccccagagtgatgcgggtgctgttgctcggagacgttgccaccctccccctgcgtaaagtgttggccgtcgtgggcactgccgaagctagctctgagcatcccctcggggtggcagttacaaaatactgtaaagaagaactgggtacagaaaccttaggatactgtaccgatttccaggctgttccaggatgtggcatcggatgcaaagtgtcaaacgtggaaggaatccttgcgcactcggaacggcctctcagtgcccctgcctctcacctgaatgaagcaggaagcctgcctgccgaaaaggatgctgtgccccagacattttcagtgctcatcggaaatagggagtggctgaggcgcaatggcctgactattagctctgatgtcagcgatgctatgactgaccatgagatgaaaggccagaccgccatattagtggccattgatggcgtgctttgtggcatgatcgcaatagccgatgcagtgaaacaggaggccgcacttgccgttcacacgctgcagagcatgggtgtcgacgtggtcttaataaccggcgataacaggaagactgccagagctatcgccacccaagttggtataaataaagtgttcgccgaagtgctgccgtctcacaaggtcgccaaggtacaggaactccagaataaaggcaagaaagtcgctatggtgggagatggcgtcaacgattcacctgcacttgcccaagccgacatgggggtcgccattgggactggaactgatgtggcaattgaagcagccgatgtggtccttattaggaacgaccttctggatgtcgtcgctagcatccacctgagcaaaagaacggtgagacggattagaatcaatctggttctcgcattaatttacaatctggtgggtatccccatcgccgctggggttttcatgcccatagggatcgtccttcaaccctggatgggcagtgccgctatggccgctagcagtgtgagcgtggtgctgtcctcactgcagcttaaatgctacaagaaaccggacttagagaggtacgaggcccaagcgcacgggcatatgaagccactgacagcatcccaggtgtctgtgcacatagggatggacgatcggtggcgcgacagtccgagagccacgccctgggatcaggtgagctacgtctcacaggtcagccttagttcactaacaagcgacaaaccttcaaggcacagtgcagccgctgatgacgatggtgacaagtggagcttacttctgaacggaagagacgaagaacaatacatttag

SEQ ID NO: 4243 - DNA, 4065 bp, Artificial Sequence
  Description of Artificial Sequence: Synthetic coding sequence
atgccggagcaagaacgtcaaattacggcacgagaaggagcctcgagaaaaatcttgagcaaactctcccttccaactagggcatgggagccagccatgaagaagagtttcgcctttgataacgtgggttacgaaggcggtcttgatggtctgggaccttcaagccaggtggcaacctctacagttcgcattcttggcatgacctgtcagagctgcgttaagagcatcgaggacaggatctcaaacttaaaaggaattatttcaatgaaagttagcctcgagcagggaagtgctaccgtcaagtatgttccatctgtggtgtgtcttcagcaggtctgtcatcagattggagacatgggcttcgaggctagcatagcagaagggaaggcggctagctggccaagccgcagtttacccgctcaggaggcagtggtgaaactcagggtcgagggaatgacttgtcagagctgcgtgtcttccatcgaagggaaggtgagaaaactgcagggtgtcgtgcgagttaaagtgagcctctccaaccaagaggccgttattacctatcagccttacctgatacagccagaagacctgcgggaccacgtgaacgacatgggtttcgaggctgctatcaaaagcaaggtggccccactgtctctgggaccaattgacatcgagaggctgcagagtactaacccaaaaaggcccctgtcaagtgcaaaccagaactttaacaactcggagaccctcggccatcaggggtcccatgttgttacactgcaactgagaattgacggcatgcactgcatgatatcccagctggaaggagtgcaacaaatcagcgtctcactcgcagagggaacagctaccgttctgtataatccgagcgtgatcagtcctgaagaattgagagctgctatcgaagacatgggctttgaagcttccgtggtgagcgagtcatgttcaaccaatccgctcggcaaccacagcgcaggcaactcgatggtccagaccacagacggaacacccacaagtgtgcaggaggtggccccacataccgggagactgcccgctaatcatgctcccgatatcttggccaagtcacctcagagcactagggccgtggctccccagaagtgttttttacagattaaagggatgacttgcgcatcctgtgtctccaatatagagaggaacttgcagaaggaggctggagtcctgagcgtgctggttgccctgatggcgggaaaggccgagatcaaatatgacccagaagtcatccaacccttagagatcgcccagttcatccaagacttaggctttgaggccgctgtaatggaggactatgcgggttccgatggcaacattgagctgaccataacaggcatgacctgcgcgtcttgcgtgcacaacattgagagcaagctgacgagaactaatggaataacatacgctagcgtcgcgctggccacctctaaagctctggtgaaatttgatcccgaaatcattggccctcgagatatcattaagattatcgaggagattggctttcacgctagtctcgcccagagaaaccctaatgcacaccacctcgaccacaaaatggagatcaaacagtggaagaagtcattcctttgcagtttggtgtttggcatccctgtcatggcacttatgatctacatgctgatacccagcaacgagcctcaccaatccatggtgctggatcataacatcataccaggcctttctattctgaacctgattttttttatattatgcacgtttgtccaattgctcggtggctggtacttctacgtccaggcttataaaagcctgcgccacaggtccgcgaatatggacgtgcttatagttctggccacttcgatcgcttacgtatactctctggtgattctggtagttgctgtggcagagaaggcagagcgatcccctgtgaccttctttgatacgcctcccatgctgtttgtgttcattgcgctgggacgatggctggaacatctggccaagtcgaaaaccagcgaggcactggctaagctgatgtcactgcaggccactgaagccaccgtggtgactctgggtgaggataatctcattatacgtgaagagcaagtcccgatggagcttgtgcagcgaggcgacatcgtcaaagtagtccccggagggaaatttccagttgacggaaaggtgctggagggaaacactatggcggatgaaagcctcattaccggagaggcaatgccggtgacaaagaaacctggttctacagtgatcgccggaagcattaatgcacacggctcagttctgattaaggccacacatgtggggaatgacaccacactggcgcagatcgtgaagctagtggaggaggcacagatgagcaaagctccaatccagcagttagcggatcgcttcagtggttatttcgtaccttttattattattatgtccaccttgacattggtggtgtggattgtaatcggctttatagactttggagtagtacagaggtattttccaaaccccaacaagcacatcagccaaaccgaggtaattatccgtttcgcttttcaaacctcaatcactgtgctttgtatcgcttgtccatgctccctgggactagctactcctacagcagtcatggtcggtaccggagtagcagcgcaaaacggcatactgatcaaaggcggaaagccgctggagatggctcacaaaattaaaacagtaatgttcgataaaactgggaccataactcatggggtgccacgcgtgatgagggttctgttactgggagacgtggcaactctgccgctgagaaaggttctcgcagtggtgggcactgcagaagcatcttccgaacatccactgggtgtggcagtcacgaagtactgtaaagaagagcttggcacagagaccttgggctactgtacggatttccaggccgttccgggttgcggaatcggatgcaaggtgtccaatgttgaaggaatcttggcacactccgaacgcccactgtcagcaccagcctcacatctaaacgaggccggatctttacctgctgagaaggacgccgtgcctcaaacattctctgtgttgatcggcaacagggagtggctgcgacgcaacgggctcacgatatccagcgatgttagcgatgccatgaccgaccacgaaatgaaaggccaaaccgctatcctggtcgctattgatggagttctgtgtggaatgatcgccatcgccgatgccgtgaagcaagaggccgctctagccgtccacaccttgcagagcatgggagtggacgtggtcctgatcacgggcgataataggaaaactgcacgcgctatcgctacacaggtgggtattaataaggttttcgcagaggtcctcccatctcataaggtagctaaagtgcaggaactccaaaacaagggaaagaaagttgccatggttggagatggagtcaatgactcgcctgccctggctcaagctgatatgggggtcgccatcggtactggaacggatgtggcaattgaggcagccgacgtggtgcttatcagaaacgacctgttggacgtggtggcctcaatccatctgtctaaacgcactgtgcgtcgaatcaggatcaatctagtgctggctctgatttataatcttgtcgggatcccaatcgccgctggagtatttatgccaatcggcatcgttttacagccctggatggggtccgctgccatggctgcatcctccgtttctgttgtgctatccagcctgcagctgaagtgctacaaaaagcctgatcttgagcgatacgaagctcaggcacatggccatatgaaacccctcactgcttctcaagtgtctgtgcacatcggcatggacgacagatggcgtgattcaccccgtgcaaccccatgggaccaagtgagctatgttagtcaggtctccctatcgtccttaaccagtgacaaacccagcagacactccgcagccgctgacgatgacggagataagtggtctttactgttaaacggaagggacgaagagcagtatatttag

SEQ ID NO: 4244 - DNA, 3108 bp, Artificial Sequence
  Description of Artificial Sequence: Synthetic coding sequence
atgcctgagcaggagcgacagatcaccgcacgcgaaggtgcgagtaggaaaattctgtcaaaattgagcctgcccacccgggcttgggagcccgcaatgaagaagtccttcgcctttgataatgtgggttacgaagggggtctggacggccttggcccatcatcccaggtggctacaagcaccgttaggattctgggaatgacctgtcagagctgtgtcaagtccatcgaggatcgaattagtaatctgaagggcattatctccatgaaagtctctctggaacaggggagtgccactgtcaagtacgtaccctctgttgtgtgtctccagcaagtgtgccatcagattggagacatgggatttgaggcgagcattgctgagggaaaggcagccagctggccatcccgatcactccctgctcaggaggcagtagttaaactgcgagtagaggggatgacttgccagtcctgcgtgtcctcaatcgagggaaaagtgcgaaaattgcagggagtggtcagagttaaggtgagcctttcgaaccaggaggctgttatcacctaccagccatacctcatccagccggaagacctgcgtgaccatgtgaacgatatgggcttcgaagctgctattaaaagtaaggtggcccctctgagtctcgggccaatcgacattgaacgtctgcaatccacaaaccctaagagacctctgtctagtgcaaaccagaattttaataactcagagactttggggcaccagggtagccatgtggtgacactccagctacgaatcgacggcatgcactgcaagtcctgcgtcctcaacattgaagaaaacattggccagctccttggcgtgcagagcatccaggtctctctggagaataaaacagcacaagttaagtatgacccctcttgcactagcccagttgctctgcaaagagccattgaagcactacctcctggtaacttcaaggtgagtcttcccgacggagcggaagggtccgggaccgatcacaggtctagtagctctcactctcctggatctcccccacggaaccaggttcagggtacctgctctacaaccttgatcgccattgcaggcatgacttgcgcctcctgcgtgcacagtatcgaggggatgatcagccaacttgaaggcgtacagcagatcagtgtgtcattggccgagggaactgctacagtactgtacaatcctagtgtgatatcccccgaggagctgcgcgcagctatcgaagacatgggctttgaagcctcagtggtgtctggtgaggccatgccagtcactaagaagccaggatctaccgtcattgcaggatctatcaatgcccacggaagtgtgctcatcaaggcaacacacgtgggtaatgacacaaccttggcccaaattgtcaagctggtggaagaggctcagatgtccaaggccccaatccagcagctggctgatcggtttagtgggtacttcgtgccttttatcatcattatgtctacccttacacttgttgtttggattgtcatcggctttatagatttcggcgtggtacagaggtattttccaaaccccaacaaacatattagccagactgaggtgatcatcagattcgccttccagaccagtatcaccgtattgtgcatagcctgcccatgcagtttgggacttgctacaccaactgctgtaatggtaggtacaggtgtggccgcacagaatggaatactcattaaaggagggaaacccctggaaatggctcacaagattaagaccgttatgttcgataagaccggtaccattacccacggcgtcccaagggtaatgagagtgttgctcttaggagatgtggctactctccccttgagaaaggtcctggccgtggtgggaaccgcagaagcttcttctgagcaccccctaggcgtggctgtgactaagtactgtaaggaggaactgggaactgagaccctagggtattgcaccgacttccaggcagtgcctggatgcgggatcggctgtaaagtgtcgaatgtggaggggatcctagcacattccgagcgccctctgagcgctccagccagtcacttgaatgaggccggtagcctgccagccgaaaaagacgctgttccacagacattttctgtgttaatcggcaacagagaatggctccgcagaaacggactaacaatttcttccgatgtgagtgacgcaatgactgatcatgaaatgaaggggcaaacggccatcctcgttgcgatagacggcgttctgtgcggcatgattgctatcgcggatgccgtcaaacaagaagctgccctggccgtccacacactgcagagtatgggcgtcgatgtggtacttattacgggtgataaccggaaaacagcgagggccatagccacacaggtgggaatcaataaggtgtttgcggaggtgttgccttctcacaaagtggccaaggtgcaggaactacagaataaaggtaaaaaagtcgctatggtaggcgatggtgtaaatgattccccagccctggcccaggcagatatgggcgtggctatcggaactgggaccgacgtggccatagaagctgccgatgtagttctgattcggaatgacctgctggatgtggtggcatccatccacctgtctaagagaactgttagacggatccgaatcaatttggttttggctctgatctataacctagtcggcatcccaatcgctgctggtgtcttcatgcctattggcattgttctccagccatggatgggaagcgcagccatggccgcttcttccgtaagtgtggtcctgtcaagcctgcagctgaagtgttataaaaagcccgacctggagcggtacgaagcccaggctcacggtcatatgaaaccgctgacagcgtcccaggtgtcagtccacatcggaatggacgatcggtggcgggactcaccacgagcgacaccttgggaccaggtttcctatgtgagtcaggtatctctctcctccctcactagcgacaagccttcccgtcacagtgctgcagctgacgatgacggggataaatggtcattgctgctcaatgggagggatgaggagcagtacatttag

SEQ ID NO: 4245 - DNA, 2031 bp, Artificial Sequence
  Description of Artificial Sequence: Synthetic coding sequence
atggatgtactgattgtcttggcgacgtcgatcgcatatgtgtatagcctagtgatcctcgtcgtggcggtggccgagaaggctgagcgtagcccggtgacgttcttcgacacgccacctatgttgttcgtctttatcgccttaggtaggtggcttgagcatcttgctaagtccaagacttctgaggccctagcaaagctgatgagcctgcaggcgactgaggccacagtcgtgaccctgggtgaagataatctaatcatccgcgaggagcaggtgccaatggaactggtacaacggggagacatcgtcaaagtcgtgcccggaggcaaattcccggtggatgggaaggtcctggagggtaataccatggccgacgaaagcctgatcacaggggaagccatgccggtcacaaaaaaaccaggaagtacagtgattgctgggtcaattaacgctcacggatctgttctcatcaaggctacacacgttggtaatgacactaccttagcacagattgtcaaactcgtcgaagaagcgcagatgtccaaggctcccattcagcaactcgcggacagattcagtggatacttcgtgccattcattataatcatgtcaactttgacccttgtagtgtggatcgtgatcgggttcattgatttcggagtcgtccaaagatactttccaaaccctaacaagcacatatcccagacagaagtcataatccgcttcgcatttcagacgtctataactgttctctgtattgcatgtccctgttcccttgggcttgctactcccaccgccgttatggttggtaccggggtggccgcacagaatggcatacttatcaaagggggaaagccactggaaatggcacacaaggagttaggtaccgagactctgggatactgcacagatttccaagccgtgccgggatgcggcattgggtgcaaggtaagcaacgtggagggtatcctagcccacagtgagcggccattgagcgctcctgccagccatctcaatgaagccggatctcttcccgcagagaaagatgcagtgccccagacattctctgtactcattggtaaccgtgaatggttgaggcgtaacgggctcaccatcagctcagacgtttcagacgcaatgacggaccacgagatgaaaggccaaaccgcgattctggtggccattgacggtgttctttgtgggatgatcgccattgccgatgctgtgaagcaggaggccgcacttgccgtgcacactctgcaaagtatgggcgtcgacgtcgtcctcatcacgggggacaatcgcaaaaccgccagagcgattgccacacaggtcggcataaacaaggtcttcgctgaagtgttgccttcgcataaggtcgccaaagtgcaggaactccagaacaaaggcaaaaaagtagcaatggtcggagacggtgtgaatgattctccagccctggctcaggctgatatgggagtcgccattggcacaggcacggacgtggcaatagaggcggctgacgttgtactgataagaaatgacctgctggatgttgtggcaagcatccatttgtctaagagaacggtgaggcgcattcggattaatctggtgctggccctgatttataacctagtggggatcccaattgccgcaggagtgttcatgccaatcggaattgttctgcagccatggatgggaagtgccgcaatggctgctagttcagtgagtgttgtgcttagcagtctccagctaaagtgctataagaaacctgatctcgaaagatacgaggcccaggcccacgggcacatgaagcctctaaccgcttcccaggtgagcgttcatatcggcatggacgatcgctggagggattctccccgagctacaccatgggaccaggtttcttacgtgtctcaggtgagtctctcctccctgacatcagacaagccttcacgacattccgctgctgctgatgacgatggcgataaatggtctctattgttgaatgggagggacgaggagcagtacatttag

SEQ ID NO: 4246 - DNA, 4203 bp, Artificial Sequence
  Description of Artificial Sequence: Synthetic coding sequence
atgcctgagcaggagaggcagatcactgcacgcgaaggagcctccaggaaaattctgtccaagctgagtctccctactcgtgcctgggagcctgctatgaagaaatcctttgcctttgacaacgtggggtacgaaggtgggcttgatggcttgggacctagctctcaggtcgcaaccagtaccgtacggatcctcggtatgacatgccaatcctgcgttaagtccatcgaggacagaatctctaatctgaaaggcatcatctccatgaaagtttccctagaacaggggagcgcaactgtgaagtatgtaccatctgtcgtctgcctgcagcaggtttgccaccagataggcgatatggggttcgaggcaagcattgccgaggggaaagctgcgagctggccatcacgatccctacctgctcaggaagctgttgtgaaactgcgggtcgaagggatgacctgccagtcgtgtgtctccagtatcgagggtaaggtgaggaaactgcagggagtggtccgggtgaaggtttccctgtctaaccaggaggccgttatcacctaccagccctacctcatccagcccgaggatctgagagatcatgttaacgatatggggtttgaggccgctattaaatccaaagtcgccccactgagtctcgggccaattgatattgagaggctacagtctaccaaccccaaacggccactgagctctgccaaccaaaactttaataattcggagacattaggccaccaggggtctcacgtagtgactcttcagttacgaattgacggaatgcactgtaagtcatgtgtccttaacatcgaggagaatatcggtcaactgctaggcgtccagagtattcaagtttccttggagaacaagactgcccaagtgaagtatgatccatcctgtacaagtcctgtggcactgcaaagggcaatagaggcactgccacccggaaattttaaggtcagcttgcccgacggcgctgaaggcagcggcaccgatcatagaagttctagttctcactcccccggaagtcccccaaggaaccaagtacaggggacctgctccacaacactaatcgctattgccggaatgacttgcgcctcttgtgtgcatagtatcgagggaatgatctcacagctggaaggggtccagcaaatatcagtcagcttggcggagggcacagctacggttctgtacaatccttcagttatcagtcccgaagaactgcgggcagcaatcgaggacatgggcttcgaagctagcgtagtatctgagtcctgctcaacaaatcccctgggtaatcattcggccggtaacagtatggtacaaaccacagatggtacccccacatcggtacaggaggtcgccccacatacggggagactgccggctaatcatgcaccagatatactggctaaaagcccacagtcgacgcgggctgtcgcaccgcaaaagtgtttcctacagatcaaaggtatgacctgcgcatcctgcgtttcgaacatcgagcggaacctccagaaggaagcaggcgtgttatctgtgctcgtggcactgatggcgggtaaggccgagataaagtatgaccccgaagtgatccagcccctggaaattgcccagttcattcaggatcttggattcgaggccgctgtgatggaggactatgcgggtagtgatggcaacattgaactgacaattaccggcatgacctgtgcatcatgtgttcataatattgagagcaagctcacccgtacgaatgggatcacatatgccagcgtggccttggccacttccaaggccctggttaagtttgatcctgaaatcattgggcctagagatatcatcaaaatcatcgaagagatcggttttcacgcctcactggctcagaggaatccaaacgcacatcacctggaccacaagatggaaatcaaacagtggaagaaatcctttctgtgttctttagtcttcggtatacctgttatggcattgatgatctatatgctgatcccgtctaatgaaccccaccaaagcatggtgctggatcacaatattattccgggattatccatactcaacctcattttttttattttatgcacgttcgtgcaactcctggggggatggtatttctacgtccaagcctacaagagtttaaggcatcggagtgctaatatggacgtcttgatcgtccttgccacgtctatagcctatgtctatagtctggtcattctggttgttgctgttgccgagaaagcagaaagaagtcctgtaacattctttgatacccccccaatgctgtttgtgttcatagccttgggccgatggctagaacacctggcaaagtccaagactagcgaggccttggcgaaattaatgtctttacaggctaccgaagccactgtcgtgactctcggagaagataacctcataatccgggaagagcaggtaccaatggagctggtgcagcggggagatatagttaaggtggtgcccggaggcaaattcccagtagacggaaaagttttagaaggaaacacgatggccgacgaaagcctcataaccggagaagcaatgccagtgaccaagaagccagggtccacagtcatcgccggaagtatcaatgctcacgggtcagtcctgatcaaagcgacccatgtagggaacgacacaaccctggcccagatcgtaaaattagtcgaggaagcacagatgagcaaagctcccattcagcagctggccgacagattctcagggtactttgtgcctttcattattatcatgagcaccctgaccctggtggtctggatcgtcattgggtttattgacttcggggtagtgcaacgctatttccccattaaaacagtaatgtttgacaaaaccggcaccatcactcatggcgtgccaagagtcatgcgggtcctcctcctgggtgacgtggctactctgcccctgagaaaggtgttagccgtggtgggaaccgccgaagcaagcagcgaacacccactgggggtggccgtcactaagtactgtaaagaagaattgggcaccgagaccctgggctactgtactgactttcaggcagtgccagggtgcggtattgggtgtaaagtgtcgaatgtcgagggtatactggcacattctgagcgccctcttagcgccccagcgtcccatctaaatgaggcgggatctttacccgctgaaaaagacgcagtgccccagaccttctctgtgctcatagggaatagagaatggctgagaagaaatggtctgacaattagctccgatgtgtcagacgcaatgacagaccacgaaatgaagggacagacagccatcctagttgccatcgacggagtgctgtgtgggatgatagctatcgctgacgccgtgaagcaggaggctgccctcgcagttcacaccctacagtctatgggcgtggacgtggtgctgattactggcgacaatcgcaagactgcccgagccattgcgacccaggtcggaattaacaaggtgttcgcagaggttctgcctagtcacaaagtggcgaaggtacaagaattgcaaaacaaaggaaagaaggtagcaatggtcggggacggagtgaatgattccccagctctggcccaggcagacatgggagtagccatcggaacgggtaccgacgtagctattgaggccgctgacgtggtgctgataaggaacgatctcctcgatgtggtggcatctattcacctgtctaaacggacagtccgcagaattaggatcaatctcgtactggctctcatatacaatttggtgggaattcccatcgcagcaggagtgttcatgccaataggcattgtcctacagccctggatgggatccgctgccatggctgcttcatctgtgagcgtggtgctttccagcctgcagctgaagtgctataagaagcccgacctcgaaaggtacgaagcccaggcgcatgggcatatgaagcccttgactgcatcccaagtgagcgtgcatattggtatggacgatcgctggcgggatagtcccagggccactccatgggaccaagtgtcttacgtgagccaggtttcattgtcttctttaacctccgataagccttctcgccacagcgccgctgccgacgatgatggtgataagtggtctttgttgctgaacggcagagacgaggagcagtatatctag

SEQ ID NO: 4247 - DNA, 4164 bp, Artificial Sequence
  Description of Artificial Sequence: Synthetic coding sequence
atgcccgaacaagagagacagataacagcaagggaaggcgcatccagaaagatcctgtcaaaactgagcttgcccactcgcgcatgggaaccggcaatgaaaaaatcttttgcattcgataatgttggctatgagggtggactcgacgggctcggaccaagctcacaagtcgctaccagtacagtgcggatcctgggcatgacttgtcagtcctgtgtcaaaagcatagaggaccgcatcagcaacctgaaaggaatcatttccatgaaagtgtcacttgagcaggggtcagctacggtgaaatacgttccctctgtggtctgtcttcagcaagtctgccatcagatcggtgacatgggctttgaggcaagcatcgcggagggcaaagctgcctcttggcccagtcgctcactccccgcacaggaagccgtggtgaagttgagggtagagggcatgacctgccaaagctgtgtgtcttccatcgagggcaaagttcgcaaactgcagggggtggtaagagttaaagttagtctttccaaccaagaggctgtgattacttatcagccctacctgattcaaccggaggatttacgggaccatgttaatgacatgggctttgaggcagcaattaagtccaaggtagcaccactgagtcttggcccaatcgatattgagagactgcagagcacaaatcccaagcgacccctgagctctgccaatcaaaattttaataactctgaaacccttgggcatcaagggagtcatgtagttacattacaactgagaattgatggaatgcactgcaaatcctgtgtactcaatatcgaggaaaacattgggcagctactaggcgtgcagagcatccaggtcagtctggaaaacaagacggcccaggtaaagtacgatcccagttgtacgtccccagtcgccctccaaagagctattgaagccctgccacctggcaactttaaggtgtccttgccagacggggcagagggcagcgggacggaccataggtcctcatcaagtcactcccccggatcgccccctaggaatcaagtgcaggggacctgtagcacgacattaatcgcgatcgctgggatgacatgtgcttcatgtgtgcattcaatagaaggcatgatctctcaactcgagggcgtccaacagatcagtgtgagtcttgccgagggcacagccacagtcctctacaatccttccgtgatttcacctgaggaacttcgggcagctattgaggacatggggttcgaggctagcgtggtcagcgaaagctgttcgactaacccactggggaatcatagcgcagggaactctatggtccagaccacggacggtactcctacatcagtgcaagaagtggctccccatacagggagactgcctgctaaccacgctccagacatcctggccaaaagtcctcagtcaacccgggcagttgcccctcagaaatgctttctgcagatcaaggggatgacctgcgcgtcctgcgtgtctaacatcgagagaaatctgcagaaagaggcaggcgtcttatcggtcctcgtggccctcatggccggaaaggccgaaataaaatacgatcccgaggtgatacagcccttagagattgctcagtttatacaggacctgggattcgaagctgcggttatggaggattatgccggaagcgatgggaacattgagttaacgatcactggcatgacatgcgcctcgtgcgttcataacatagaatctaaattgacccgcactaatggcatcacgtacgcatccgtcgcgcttgctacatcaaaggcactggtaaagtttgaccctgaaatcatcggacctcgggacattatcaagattatcgaagagataggctttcatgcctcattggcccagcgtaaccccaacgcccatcacctggaccacaaaatggaaatcaaacaatggaaaaagtcattcctctgctcactagtcttcggtattcctgtgatggcgttaatgatttatatgctcatcccgtcaaacgagccgcaccagtcaatggtgttggatcataacatcatcccaggtctttctatccttaatcttatttttttcattctctgtaccttcgtacagagtaaaacttccgaggccctggctaagctcatgagcctccaggcaacagaggccacggtcgtgactttgggggaggacaatttaattatcagggaggagcaggtacccatggagctggtgcagcggggagacattgttaaagttgtgcctggtggcaagttccccgtcgatgggaaggtcctggagggcaacaccatggctgatgaatctctcatcacaggggaagccatgcctgtgactaagaagccgggatccaccgtgatcgctgggtctataaacgctcatggctcagtcctgatcaaagctacacatgtcggcaacgacaccacgcttgcccaaatcgtcaagctggtggaggaagcacagatgtctaaggcccctattcagcagctcgctgacaggttctcgggatactttgttccattcattatcatcatgtccacgctcacactggtggtatggatcgttataggctttatagactttggtgttgtccaacgctacttccctaaccccaacaaacatatttcacagacagaggtgatcatcaggttcgccttccaaacttctattacggtgctgtgtatcgcctgcccttgttcgctgggactggcgacacccaccgccgttatggttgggacaggtgtggccgcacaaaacggcatccttatcaagggtgggaaacctcttgagatggcccacaagataaagacggtgatgttcgataagactgggactattacccacggggtgccccgtgtgatgcgagtcctgctgctcggggatgtcgctacactgcctcttcgaaaggtcttggctgttgttgggactgccgaagcatctagcgaacacccactcggagtggcagttacgaagtactgtaaggaggagctggggactgaaactctgggatactgcaccgactttcaagctgtgcccggttgcggcatcggatgcaaggtctctaatgtggaaggcatcctggcccatagcgagcgtcccttgtccgctcctgccagtcacttgaacgaggccggatccctgccagcggaaaaggacgccgtgcctcaaacattcagtgttcttatcggtaatcgcgagtggctgcgcaggaacggccttactattagcagcgatgtttcagatgccatgactgatcatgagatgaagggccagacagccatcctcgtggccatcgacggtgtgctttgtggcatgattgcgattgccgacgctgtcaaacaggaggctgctttagctgtgcataccctgcagtcaatgggtgtggatgtggtcctgataactggggataatagaaaaacggccagggccatcgccacccaggtgggcattaataaggtcttcgcagaggttttgccaagccacaaggtggcgaaagtgcaggaactccaaaataagggtaaaaaggtggcgatggtcggcgacggagtaaacgactctccagcgctcgcgcaggccgacatgggagtcgccatcggtaccggtacagacgtcgccattgaggcagccgacgtggtgttgattagaaacgacctgctggatgtggtggcttccattcacctgagcaaacgaactgtcagaagaatccgcattaatcttgtgctagcattaatctacaatctggtcggcatcccgatagctgcaggcgtgttcatgccaatagggatcgtacttcagccttggatgggatctgcagcaatggcagcatcttctgtctccgtggtgctgtcttccttgcagctgaagtgttataagaaaccggacctggaacgctatgaggcacaggcacacgggcacatgaaaccacttaccgcgtctcaagtatccgtacatatcggcatggacgataggtggagagactcacctcgcgcaactccttgggatcaagtgtcgtacgttagtcaggtttctctgagtagcttaacaagcgacaagccgagccgccattctgctgctgcagatgatgatggagacaaatggtctctgctcctgaacggaagggatgaggagcagtatatttag

SEQ ID NO: 4248 - DNA, 1587 bp, Artificial Sequence
  Description of Artificial Sequence: Synthetic coding sequence
atgaagaagtctttcgcatttgataatgtcggatacgagggagggcttgacggcttagggccttcgagtcaagtcgcaacttccaccgtgcgcatcctcggcatgacctgccagagttgtgttaaaagtattgaagatcggattagtaatctgaaaggcatcattagcatgaaggtgagtttagagcaaggctctgccacggtgaagtatgtgccctcagtggtgtgtttacagcaggtgtgccaccagataggcgatatgggtttcgaagcctccatcgcggagggtaaggccgcaagttggccatccagatccctcccagcacaggaggccgtggtcaaactgcgggtggaaggtatgacatgtcagagttgtgtctccagtatcgagggtaaggtgagaaaactgcagggcgtcgtgagggtcaaggtgagtttgagcaatcaggaggctgtgatcacttaccaaccttacctgatccagcccgaagacctcagggaccatgtcaatgacatgggctttgaagccgcaatcaaatctaaggtggctccccttagcctcggacccattgatatcgagcggctccagagtaccaaccctaagagacccctgtcatcagctaatcagaacttcaacaactctgaaaccttgggccaccagggatcacacgtagtcactcttcagctgcgcattgacggcatgcattgcaagtcttgcgtgctgaacattgaggagaacatcggacaattgcttggagtacagtcaattcaggtgtccctggaaaacaaaaccgcccaggtgaaatatgaccctagctgcacctcaccagtcgccctccaaagggctatcgaggcattgcccccaggcaattttaaggtgtctcttcccgatggcgcagaggggtctggaacagaccatagatccagctcttcgcacagtcctgggagcccgccacggaatcaggtgcaaggcacctgttcaaccaccttgatagcaatcgccggtatgacctgcgcaagctgcgtgcattctatagagggaatgatatcacaactggagggcgtacaacagatcagcgtcagcctggcagagggaactgccacagttctatataacccatccgtgatctcccccgaggaactgcgggcagctattgaagacatgggctttgaagcttctgtagtgtctgagtcttgcagtacgaaccccctggggaaccacagcgcaggtaattccatggttcagacaactgatggaaccccaactagcgtacaagaggtagcaccacatacagggaggctgcccgcaaaccacgctcccgatatacttgctaagagcccacagtcaacccgcgcagtggccccacaaaagtgctttctgcagataaaggggatgacctgtgcttcctgtgtgtccaacattgagcgtaacctacagaaagaagccgctcctcgatgggtggtcctgttaagatccggcctgcaaattagtgagacgcaggtgagccagcacggacgggctcaccggcctggacacaagcattgtctctgcctgtttagtggacaccccggaggctgttgtggatag

SEQ ID NO: 4249 - DNA, 3966 bp, Artificial Sequence
  Description of Artificial Sequence: Synthetic coding sequence
atgtctgacagcgtgatcctgcggagcatcaaaaagtttggcgaggagaatgacgggtttgagtcagataaaagctataacaatgataaaaagagtcgattgcaggatgagaagaagggggacggagtccgtgtgggcttcttccaattgttccgtttttcaagttctacagacatttggctcatgtttgtgggctctctgtgtgccttcttgcacggcatcgcacaaccgggagtcctcctcatcttcggaaccatgacagacgtttttatagattatgatgtggagctccaggagttgcagattccgggaaaagcgtgcgtcaacaacacaatagtttggactaattccagtttaaaccagaatatgactaacggaactcgatgcggtctcctgaatattgagagcgagatgattaagttcgccagttattatgctggtattgcagttgccgttctcatcactggctatattcagatctgcttttgggttatcgccgctgccaggcaaatccagaaaatgaggaaattttatttcagacggatcatgagaatggaaatcggctggtttgattgcaactccgtgggtgagttgaatacacgattctccgacgatataaacaaaataaacgatgccatcgctgaccagatggccttattcattcaacgaatgacaagcaccatctgcggatttctgcttgggttttttcgtggatggaaactcactctcgttatcatttcagttagtccactgatcggtataggcgcagctacaatcgggctctccgtcagcaagttcacagattacgagcttaaagcctacgctaaagcgggagtggttgcggacgaggtgatcagtagtatgagaactgttgccgcatttggtggcgaaaagcgcgaggtggagagatacgagaaaaatctcgtgtttgctcaacggtgggggatccggaagggaatagttatgggcttctttaccgggtttgtttggtgcctgatctttctgtgctacgctctcgctttctggtatgggtctactctggtgctggacgagggcgaatatacccccggaaccctggtacaaatctttcttagtgtaattgttggtgccctgaacctcggtaacgcctctccttgtctggaggccttcgctaccggaagagcagccgctacgtctatctttgaaaccatagacagaaagcccatcatagattgcatgagcgaggacgggtacaagctggataggattaaaggtgagattgaattccataacgtaactttccactaccctagcaggccagaggtgaagatcttaaatgacctgaacatggtgatcaagcccggagagatgacagccctagttggtcctagcggcgcaggcaagagtacagccctgcaattgatccaacggttttacgatccctgtgagggtatggtgaccgtggacggtcacgacattcggtcactcaacatccagtggcttcgcgatcaaattgggatcgtggaacaggagcccgtgctgttcagcacaacgatcgctgaaaatatccgatacggcagagaggatgccaccatggaagatatcgtgcaggccgcaaaggaggccaacgcttataacttcatcatggatctgcctcaacagtttgacacgttagtcggtgagggcggaggccaaatgtctggaggccaaaaacagcgtgtggccattgccagggccctcattagaaatccaaaaatcttactactcgacatggctacatctgccctcgacaatgagtcagaggcaatggtgcaagaagtgttgtctaaaattcagcatggccataccattatttcagtagctcacagattgtccacagtgcgtgcagcggatactataattggcttcgagcatgggactgccgtggagcgcggaacccacgaggagctgctggagcgaaaaggagtttactttacactggtgactctgcaaagtcagggaaaccaagccctgaatgaggaagacatcaaagacgcaactgaggacgatatgctggccagaacattttcgaggggttcttaccaagactctctgcgggctagtataagacagagatcaaaaagccagttgtcctatttagtgcacgaaccgccactcgccgtcgtggaccacaagtctacttatgaagaggataggaaggataaggatattcctgtgcaggaagaggttgaacctgcgcctgtaagacgaattctgaaattcagcgccccagaatggccatacatgcttgtggggtccgtaggcgcagctgtgaacggcactgtcacacctctgtacgcatttttgtttagtcagatcctcggaaccttttcaatcccagacaaggaggagcagaggtcccagattaatggcgtgtgcttgcttttcgtcgccatgggctgtgtcagcctttttacgcagttcttacaaggatacgcgttcgccaaatccggcgaactgctgaccaagcgattgcgtaagttcggttttagggcaatgttgggccaggacatcgcttggtttgatgacctgcggaattctcctggagcacttaccactcggttggcaaccgatgcctcccaggtgcaaggcgctgccggtagtcagatcggcatgatcgtcaacagcttcacaaatgtcaccgttgcaatgattattgcctttagcttttcctggaaattgagtctcgtaatcctgtgtttttttccttttctggccctctcaggcgcaacccaaacccggatgttaacaggatttgctagcagagacaaacaggcactcgagatggtggggcagataacgaacgaagcgttatcaaatatccggaccgtcgccggtatcggcaaagagcggcgattcatagaagcacttgaaaccgaattggaaaaaccttttaagacagctattcaaaaagctaatatttacgggttctgctttgccttcgcccagtgcataatgttcatcgccaacagcgctagttaccgctacggaggctacttgatcagcaatgaaggtcttcacttctcatacgtgtttagagtcatctccgccgttgtgctatccgcaacggcgctgggacgcgctttcagctacaccccatcgtatgctaaggctaaaatctctgctgcacggttttttcagctgctcgacagacagcccccaatttccgtgtacaataccgcaggagagaaatgggacaacttccagggtaagatcgattttgtggactgtaagtttacgtacccttcccgacctgacagtcaggtacttaacggtctgtcagtgagtatttcacccggacagacattagcctttgtgggtagctccggatgcgggaagtccacatccatccaactccttgagcggttttacgatccggaccagggaaaggtgatgatcgatgggcacgacagcaaaaaggtgaatgtgcagtttctgcgaagcaacatcggcatcgtgtcgcaggaacctgtgcttttcgcgtgcagcatcatggacaacataaaatacggagataatacaaaggagatccccatggagagagttatagccgctgctaagcaggctcagttgcacgacttcgtgatgtcactgcccgagaagtacgagaccaacgtcgggtctcaagggagccagctttcccgtggtgagaagcagagaatcgcaatcgccagggccatcgttagagatcccaagatattgcttctcgatgaagccacttctgccctcgataccgaatcggagaagacagtgcaggtagcattggataaggccagagaagggcgtacgtgtatcgtcatcgcccacaggctctcaacaatccagaatgctgatattatagctgttatggcacagggagtcgtgatagaaaaggggactcacgaagagctcatggctcaaaagggtgcctactataagctggtgacaactggctcaccaatctcttag

SEQ ID NO: 4250 - DNA, 3861 bp, Artificial Sequence
  Description of Artificial Sequence: Synthetic coding sequence
atggaccttgaggccgcaaaaaatggaactgcatggcgcccaaccagtgctgagggagactttgagcttgggatcagctctaaacagaagcgtaaaaaaaccaaaaccgtgaagatgatcggggtgctgacactcttccggtattctgactggcaagacaaactttttatgtccctgggcaccataatggcaatcgcacacgggtccgggctgcctttgatgatgattgtgttcggagaaatgacggacaaattcgtcgacactgccggaaacttctcattcccggttaacttctccctgtctttgttaaacccaggtaagatacttgaagaagagatgacaaggtacgcttattactactcaggtctcggtgctggcgtgctggtcgcggcttatatccaagtgtcattttggaccttggcggcagggaggcaaatcagaaagattcgtcagaaattcttccacgccatcctgcggcaagagataggatggtttgatataaacgacaccactgaacttaatactcgactgacagatgacatctcaaaaatatccgagggcattggtgataaagtcggcatgttcttccaagctgtcgcgacattttttgctggttttatcgttggctttataagggggtggaaactaactctcgttatcatggcaatatctcctattctcggcctgagcgctgctgtgtgggcaaaaattttatctgcatttagcgataaagaacttgcagcgtacgccaaagccggtgcagtcgctgaggaagctctcggggcaattcggacagtgattgcatttgggggacagaataaggaactggagcgatatcagaaacatctggagaacgccaaagaaatcggaatcaagaaagcaataagcgccaacatcagcatgggtatcgcgtttctcttgatttacgccagttatgccctggccttttggtacggctctactctggtaatttcaaaggaatatacgatagggaacgccatgacggtttttttttccatcctgattggtgccttttctgtggggcaggcggctccatgtatcgacgcctttgctaatgctaggggagccgcatatgtgattttcgacatcatcgacaataacccaaaaattgactccttctcggagagaggtcataagccagacagcattaaggggaacttagagttcaacgatgtccacttctcataccctagcagagccaacgtcaaaatcttgaaaggcttgaacctgaaggtgcagagcgggcagaccgtggcactcgtgggctcatcagggtgcggcaaaagtacaacagtgcaattaatccagagactgtatgatcccgatgaaggaacaataaatatagatgggcaagacattcgtaatttcaacgtcaattatttgcgggagatcatcggcgttgtgtcccaagaaccggtgcttttcagcactaccattgcggagaatatttgttatggacgagggaacgtgaccatggacgagatcaagaaagccgtcaaggaggcaaacgcatacgagttcatcatgaagctaccccagaagttcgataccctggtgggagagcggggagcccagcttagcggagggcagaaacagaggattgcaatcgccagagcactcgtaaggaatcctaagatcctcctgttagatgaggccaccagcgctttggacactgaatccgaagctgaggtgcaggccgcattggataaggccagggaagggcgtacaacgatagtgattgcacaccgcctgtctaccgtccgcaatgccgatgtgatagccggattcgaggacggcgtgatcgtggaacaggggtcccacagtgagctgatgaaaaaggagggagtttattttaagctagtaaatatgcaaacgagtggctcccagattcagagcgaagagttcgaactgaacgacgagaaagccgcaaccagaatggctcccaacggctggaagtcccgtctattcaggcatagtacacaaaagaatctcaaaaacagccaaatgtgtcagaaatcccttgacgtggaaaccgatggcttagaggccaatgtcccccctgtctcatttttgaaggtgctgaagttaaataagactgagtggccctacttcgtggtcggcactgtgtgtgccattgcgaacgggggtcttcagcccgcatttagcgtgatcttttctgaaattatcgccatcttcggcccaggcgacgacgctgtgaagcagcagaagtgcaatatcttcagcttaattttcttgtttctaggcatcattagtttctttaccttcttcctgcagggcttcacctttgggaaagcgggagaaatcctcacccgcagactgaggagtatggccttcaaagcaatgcttaggcaggacatgtcttggtttgacgatcataaaaatagcacaggtgcgttgtctactcgcctcgcaacggatgccgctcaggtgcaaggggcaactggaactaggctggctttaatcgctcagaatattgctaacctggggacaggcattatcattagctttatctatggctggcagctgactctgttactcttggcggtggtgcccattattgccgtgagcgggatcgttgaaatgaagttgctcgctggcaatgccaagcgggacaagaaggaactcgaagccgcagggaagattgccacggaagcaattgaaaatatccgaacggttgtcagtttaactcaggagagaaagtttgaatctatgtacgtggagaagctctacggcccttataggaattccgttcagaaggcccacatttatggcatcacttttagtataagtcaagcctttatgtatttcagctacgctggatgttttcgctttggggcttacctaatcgtgaatggccatatgcgttttagggacgtcatcctagtgttcagcgctattgtgtttggcgcagttgcccttggacatgctagttcctttgctcccgactatgccaaggcaaagctatcggccgcacacctgttcatgctgttcgaacgccaacctcttattgatagctactcagaggagggactaaaaccagataagtttgaggggaacattacttttaacgaggttgtgtttaactatcctaccagggccaatgtgccggtactgcaaggcctcagcctcgaagtgaagaagggccaaacgctcgccttggtgggctcatcggggtgcgggaaatctaccgtggtgcaactcctcgagcggttttacgatcccttggcgggaacagtctttgtggacttcgggttccagctcctcgacggccaggaagcaaaaaaactgaatgtccagtggcttcgggctcagctcggtatagtgtcccaggaaccgatcttatttgattgtagtatcgccgagaatatcgcttatggcgataattccagagtggtgtctcaggatgaaatcgtctctgccgctaaagctgccaatatacaccctttcattgaaacactcccccataagtacgagactcgcgttggcgataagggcacacaactgtctgggggacagaagcaacgcatcgccattgcaagagcactgattcgccagcctcagatcctcctcttagacgaggctacgagcgccctagataccgagagtgaaaaagttgtccaggaggcacttgataaagccagagagggccgaacatgtatcgtcattgcccacaggctttcaacgatacagaatgctgatcttattgtggtgtttcagaatggaagggtgaaggagcacggtacccaccaacagctgctagcccagaaaggtatctatttctctatggtatccgtgcaggcagggacccagaacctctag

SEQ ID NO: 4251 - DNA, 3699 bp, Artificial Sequence
  Description of Artificial Sequence: Synthetic coding sequence
atggacctagaggctgcgaagaatggcactgcttggcgccctacatctgcggaaggggattttgaactcggcataagctcaaagcagaagcggaagaaaaccaaaacagtaaaaatgatcggagttctgacactctttagatacagcgattggcaggataaattattcatgtctttaggtacaattatggcgatagcacatgggtccggcctgccacttatgatgattgtgttcggtgagatgaccgacaaatttgtggacactgccggtaacttcagcttcccggtgaacttttcactttccctgctgaatcccggaaaaatcttggaggaagagatgacacggtacgcctattactactcggggctgggggcaggagtgcttgtagcagcctacatccaggtgtccttttggacactggctgccggtaggcagatccgaaagattcgccaaaagttcttccatgccatattgagacaagaaattggctggttcgacataaacgatactactgagttgaacacacggcttactgacgatatctccaagatctcagaagggattggcgataaagtgggaatgttcttccaggccgtcgcgacattcttcgcagggttcatagtgggattcatcagggggtggaagctgaccctggtgataatggcgatttcccctatcttaggtctatctgctgccgtttgggctaagattctgtcagcctttagtgataaagagttggccgcatatgccaaagccggagctgtggcagaagaggctcttggtgccatcagaaccgtaatagctttcggcggacagaacaaggagctggaacgctatcagaaacatcttgaaaacgccaaggagatcgggatcaaaaaggctatttccgctaatatctccatgggaattgcctttctgctgatctatgcctcctacgctctcgcattctggtatggaagtactctggtcatcagtaaggagtacacaatcggaaatgccatgacggtgttctttagtatcctgatcggagccttttccgtgggacaagctgcaccatgcattgatgctttcgccaacgctaggggcgcagcttacgtgattttcgacattatagacaataatccaaagatcgattcattttccgagagagggcacaagcccgattcgattaagggaaacctggagttcaacgatgtccacttttcgtacccaagcagagcaaatgtgaaaattctgaaaggattaaatcttaaagtgcagagtggccagactgtggcccttgtgggttcttctggatgcgggaaatctacaaccgtgcagctaattcaacgcctgtacgaccccgacgaggggactatcaatatcgatggccaggatattcgtaactttaacgtcaactacctgagagagatcatcggcgttgtgagtcaagagcctgtactcttctccaccactatcgcagaaaatatctgttatggacggggtaacgtgactatggatgaaatcaagaaggctgtcaaggaagccaatgcatacgaattcattatgaaactgcctcaaaagtttgatacactggtgggggaacggggagctcagttgtccgggggacagaaacagcgaatcgcgattgcacgggctttagttcggaaccccaagattttgcttctggatgaggcaacatccgctctcgatactgagtcggaggcagaggtgcaggccgcacttgataaagcgagggaaggccgtaccaccatcgtgatcgcccatagactctcaacggtgcgcaacgcagatgttattgccggttttgaagacggggtgattgtggagcaggggtcacacagcgagctcatgaaaaaggagggagtatactttaagcttgtgaacatgcagaccagcggatcccagatacagtccgaggaatttgaacttaatgacgagaaagccgctactaggatggctccaaacgggtggaaatctcgactttttcggcacagtacccaaaagaacctcaaaaattcacagatgtgtcagaagtcccttgatgttgagacagatgggctggaagccaacgtccccccagtttcatttctgaaggtgttgaagctcaacaaaactgagtggccttatttcgtcgtagggacagtttgcgccatcgcaaacgggggattgcaaccagcattttccgtgatcttttctgaaatcatcgcaatctttgggcctggtgatgacgctgtgaaacaacaaaagtgcaacattttttcactgatctttctattcttgggcatcatttccttttttacttttttcctgcagggcttcacgttcgggaaagccggagagatcctgaccaggcggttgaggtccatggcattcaaggctatgcttagacaagatatgtcctggttcgatgaccataaaaacagcaccggcgctttaagcacccgactcgccacagatgctgcacaggttcagggagcaactgggactcggctcgccttaattgctcaaaacatcgccaatctagggaccggcataatcatctctttcatctacggctggcaacttacgttgctgttgttagccgtagtacccataatagctgtctctggtattgtggagatgaagctgctggcgggaaacgcgaagcgagacaagaaggagcttgaagccgctggaaagatcgccactgaagcaatcgaaaacatccgtaccgtggtgtccttaacacaggaacgcaaattcgaaagcatgtacgttgaaaagctgtatgggccttacagggtgtttagcgctatagtattcggcgctgttgcacttggccacgcctcaagctttgcgcctgactacgctaaggccaaactgtcagccgcacatctttttatgttattcgaacggcagccactaattgatagctactctgaggagggactaaagcccgacaaatttgagggtaatataaccttcaacgaggtcgtgttcaactaccctacccgtgctaatgtacctgtgctgcaaggattgagcttggaagttaagaaaggacagactctggcccttgtaggttcgagcggttgcggcaagtccacagttgtgcagttactagaaaggttttatgatcccctggctggtactgtccttcttgatggacaggaagccaaaaagcttaatgtccagtggctcagggctcagcttgggatcgtgagccaggagcccattctctttgactgcagcattgccgaaaatatcgcatacggcgataactcccgggtcgtgagccaggacgagatcgtaagcgccgcaaaagctgcaaacattcaccccttcattgaaacacttccccacaagtacgagactagggtgggtgacaagggtacccaactgagtggtgggcagaaacaacgcatcgctatcgccagggctctgattcgccagcctcagatcctgctgctagacgaggccacctccgccctggacaccgagtccgaaaaggttgtgcaggaggctttggacaaggccagagaaggaaggacgtgcattgtcatcgcacatcgattatcaaccattcaaaatgccgatctgattgtcgtttttcagaatggcagagtaaaggaacacggtactcaccagcagctgctagctcaaaagggaatatacttctcaatggtaagtgtccaggccggaacgcagaatctctag

SEQ ID NO: 4252 - DNA, 3840 bp, Artificial Sequence
  Description of Artificial Sequence: Synthetic coding sequence
atggacttggaggcagcgaagaatggaaccgcgtggagacctacttcagctgaaggggatttcgagctgggcatctcttcaaagcagaagagaaagaagactaaaacagtgaaaatgataggcgttttaacccttttccgttattcagactggcaggataaactcttcatgtccctgggtaccatcatggccattgcacatgggtcaggcctcccattgatgatgatcgtatttggagaaatgaccgacaagtttgttgatacagcaggcaacttttctttccctgttaacttcagcctcagtctgttgaacccagggaaaatccttgaggaggaaatgactagatatgcctattactactcagggttgggagctggggtgttggttgccgcatatatccaggtgagcttttggactttagccgctggaagacagatccggaagattcgccagaaattcttccacgccattctgcgacaagaaattggctggtttgatatcaatgatactaccgaacttaacacccgtttaaccgacgacatctctaaaataagtgaggggattggagataaggtgggcatgttttttcaagcggtcgccactttcttcgctgggtttatcgtgggcttcattcgcggttggaaactgacccttgtgattatggccatttcgccaattttggggctttctgcggcagtttgggctaaaatcctttcagccttcagcgataaggaactggcggcttatgcaaaggcaggagccgtcgcagaggaggccctaggggctatcagaacagtgatagcctttggaggccaaaacaaggagttagaaaggtaccagaagcacttggaaaacgctaaggagatagggatcaaaaaggctattagtgccaatatttcaatgggcattgctttcctcctcatctacgcctcctacgctctggccttctggtatggttccacccttgtgatttccaaagaatacactataggtaacgccatgacagtgttctttagtatcctgatcggggcattttccgtgggccaggcagccccttgtattgatgcattcgccaatgcacgtggagctgcctacgtcatttttgatatcattgataacaaccccaaaatcgattcttttagcgaacggggacataaacctgatagcattaaaggcaaccttgaatttaacgacgtccatttttcctatccatcacgagctaatgttaaaatcctgaaggggcttaacctgaaagttcagagcggtcagaccgtggcgctagttgggagcagcgggtgtggaaagagtactaccgtgcagctgatacagagactttatgaccccgacgaaggcaccattaacattgacggccaggacatccggaattttaacgtcaattacttgcgagaaattatcggggtggtcagccaggaacctgttcttttttcgacaactatcgccgaaaatatttgctatggacggggtaacgtgactatggacgagatcaagaaggctgtcaaggaagccaatgcatacgagtttatcatgaagcttcctcagaagtttgacactctggtgggagagcggggagcccagctcagtggagggcagaagcagcggattgctatcgccagagcactggtgcgtaatccaaagatattactcctggatgaggccacctccgctctggatacagaatctgaagcggaagtccaggcggcattagacaaagctagagagggaagaactaccatcgttatagctcaccggctcagcacggtgcgtaatgctgacgtgatagctggcttcgaggacggcgtgatagttgagcagggtagccattctgaactaatgaagaaggagggagtctatttcaaacttgttaatatgcaaacttccggctcgcaaattcaatcagaggagttcgagctgaatgacgagaaggccgctactcgcatggcgcctaacgggtggaaatcacgcttgtttaggcactccacacagaaaaatctgaagaactcgcaaatgtgtcagaagtctctggatgttgagactgacggtctggaggccaatgtgcccccagtgtcttttctgaaagtgctcaagcttaacaaaactgagtggccctatttcgtcgtgggtacggtgtgtgcaattgccaatgggggactgcagcccgctttcagtgtcattttctcagaaataattgccatcttcggccctggcgatgatgccgtgaagcagcagaaatgcaatatattctcactcatcttcctgtttctcggcataatcagcttctttacattcttcctgcagggctttacttttggaaaggcaggagaaattctgacgcggcgtctgcggtccatggcatttaaggcgatgttgaggcaggatatgtcctggtttgatgaccataagaactcaactggcgcattgtcgactagattggccaccgatgccgcacaggtgcagggggctaccggtactcggctggcccttatcgcacaaaatattgcaaatttgggaaccggaattatcatatcctttatttatggctggcagttaacactgctgctacttgctgttgtccccatcatcgctgtctcaggcattgtagaaatgaagctgctggccggtaatgccaagcgggacaaaaaggagttggaggccgcaggcaagatcgcgactgaggcaatcgaaaacattcggactgtagtctcccttacacaagagcgcaaatttgagtctatgtacgttgaaaaactgtatggaccttaccgtaattctgtgcagaaggctcacatatatggtattaccttctccattagccaggcattcatgtatttcagttacgctgggtgcttccgctttggcgcatacttaatcgtgaatggacacatgcgattccgcgatgttatcttagtgttctcagcaattgtgttcggtgcagttgctttgggtcatgcttcaagctttgccccagactatgctaaggctaaactttccgccgcacacctctttatgctcttcgaacgacaaccactaatcgactcttattccgaggaggggctgaagcctgataagtttgaaggcaatataacgtttaacgaagtcgtgtttaattaccctactcgggctaacgttcctgtcctgcaaggactctctctggaggtcaaaaagggccaaactctcgccctcgtaggttcttcaggatgtggaaagagcactgttgtgcagcttctggagcgattctatgacccgttggcgggtacagtgctcctggatggacaggaggctaagaagcttaacgtgcagtggctccgagctcaactgggcatcgtgagccaggagcccatcctcttcgactgctccatcgcggagaacatcgcttacggcgacaactcgcgggtggtcagccaggatgaaatcgtgtcagcagccaaagcagccaatatccacccgttcattgaaactctgccacataagtacgagacccgcgtgggagacaaggggacccaactctccggaggtcagaaacagcgaatagcaattgcacgtgcactgatcaggcagccgcaaatcttactgctggacgaggccacttccgccctggacaccgagtccgaaaaagttgtgcaggaagcgctggacaaggccagagagggcagaacgtgtattgtgatcgcccacagactaagcacaatccaaaacgccgatttaatcgttgtcttccagaacgggcgagtcaaggaacacgggactcatcagcagctcctggctcagaaaggcatttattttagcatggtgtccgtgcaggctggtacacaaaatctatag

SEQ ID NO: 4253 - DNA, 186 bp, Artificial Sequence
  Description of Artificial Sequence: Synthetic coding sequence
atggatctggaagctgccaagaatggcaccgcttggcgtccaacttccgcagaaggagattttgagttaggaattagctccaagcagaagaggaaaaaaacaaagacagtgaagatgatcggcgtactgaccctgtttcgatattccgactggcaagacaagctctttatgagtcttgggacatag

SEQ ID NO: 4254 - DNA, 3699 bp, Artificial Sequence
  Description of Artificial Sequence: Synthetic coding sequence
atggacttggaagccgcaaaaaatggtaccgcgtggagacccacatcggctgagggcgattttgagttaggaattagctcaaaacagaagaggaagaaaacaaagaccgtaaaaatgattggggtcttgacgctgtttcgctactccgattggcaagacaaacttttcatgtccctgggaacaataatggccattgcacacggttccgggctgccgctcatgatgattgtatttggagaaatgacggacaaatttgtggacaccgcagggaacttttcctttccagtcaatttctcactctccctgctcaatccaggcaaaattttggaagaagagatgacacgatacgcctattattactccgggctgggggctggagtcctagtggctgcatatatccaggtctcattctggaccctggccgctggtcggcagatccgcaagatcagacaaaagttcttccatgcaatattaagacaagagatcggttggtttgatattaatgataccaccgagctgaatactcggctgacggatgacatttccaagatatcagagggcatcggggataaggttggaatgtttttccaggccgtagcaacatttttcgccggtttcatagttggtttcatccgcggttggaagcttacgctagtgataatggccatctcaccaatattaggattaagtgcagcagtctgggccaagatcttgtccgcattctccgataaggaactggctgcctatgcaaaagcaggtgcagtggccgaggaggccttaggtgcaattagaactgtcattgctttcggaggacagaataaggaactggagcgatatcagaagcacctagaaaacgcaaaagagatagggattaaaaaagccatttccgctaacattagcatgggaatcgcgttcctgctgatttacgcaagctacgctctggcattctggtatggcagcacgttagttatttctaaggaatatacaattggaaacgccatgacagtgtttttttccatcctgatcggggcattctctgtcggtcaggctgccccttgcatcgatgccttcgcaaatgctcgtggggctgcttacgtgatcttcgatattattgacaacaaccctaagatcgattctttcagcgagcgcggacacaagcctgattctataaagggcaatttggagttcaatgatgtgcatttctcctacccttctcgcgctaacgtgaaaatactgaaggggctgaacttgaaggtgcagagcgggcaaacagttgccctggtggggagcagtggctgcgggaaaagcactaccgttcagctgatccaacgcttatacgaccccgacgagggcaccatcaatatcgacggacaagatattcgaaacttcaacgtgaattatctgcgggagatcattggagtggtatctcaggaaccggtgcttttctcaactaccattgccgaaaacatctgctacggcagagggaacgtgacaatggatgagatcaagaaagcagtgaaagaggcaaacgcgtatgagtttattatgaagttgcctcaaaaattcgacaccctagtgggtgagagaggggctcaactgtcagggggacagaaacagagaatcgcgatcgcacgcgcactcgtacggaatcccaaaatactcctgctggacgaggctacgtccgccctcgatacagaaagcgaagccgaggtgcaggcagccctggacaaggcgcgtgagggcaggactacaatcgttattgctcatcgactgtccaccgtacgaaacgccgatgtaatcgctgggttcgaagatggggttattgttgagcagggctcacactccgaacttatgaagaaggaaggcgtgtacttcaaactagttaatatgcaaacaagtggatcacagatccagagcgaggagtttgagttgaatgacgaaaaggctgcaaccaggatggctcctaatggatggaaatcacgacttttcaggcactctacccaaaagaatctcaagaattcccagatgtgtcagaaaagcctggatgtggaaacggacggactagaggcgaatgtgccacctgtgtcttttctcaaggtccttaagctgaataaaacagaatggccctactttgtggtgggcactgtgtgcgccattgccaacggtggccttcagccagcgttctccgtgatcttctctgaaatcattgcaatttttggcccaggcgacgacgccgtgaaacaacagaaatgcaatatatttagtctgatcttcctattcctgggcattatctcattttttacattctttctgcagggatttactttcggcaaagccggtgaaattctgacaaggaggctgaggagtatggctttcaaggcgatgcttcgtcaggacatgtcctggttcgacgaccacaaaaatagcaccggcgcattgagcacccgccttgcaacagacgcagctcaagtgcagggagctacaggcactcggctggcattaatcgctcagaatatcgccaatctgggcactggcattataatttcattcatctacggttggcaactcaccctcctgctcttggcagtggttcccattatcgccgtatctggcatagtggagatgaagctcctagcaggaaacgccaagagggacaagaaagaactcgaggccgcaggcaaaattgccacggaagccattgagaacatcaggacggtcgtcagcttgactcaagagaggaagttcgaaagcatgtatgtagaaaagctgtatggcccatacagggtgttctctgccattgtgttcggagctgtggcccttggacatgcctcttcttttgcacctgactacgctaaagcaaagctaagtgccgctcatttgttcatgctgtttgagcggcaaccccttatcgatagctactcagaggaagggttgaagccagataaattcgagggcaatatcaccttcaacgaggtcgtgttcaactatccgacgagagctaatgtgcctgtcttgcaggggctgagcctggaggtaaagaagggtcagactctggcacttgttggatccagtggctgtgggaaatcaacagttgtgcagcttctcgagcggttttacgatcccctggctgggaccgtgctgctggatggacaggaagcaaaaaagcttaatgttcagtggctcagagcccagttgggaattgtgtcccaggagcctatcctgttcgattgcagcatcgctgagaatattgcctacggagacaatagcagggtcgtgtcccaggacgagatcgttagtgctgccaaagcggcaaatatccacccattcatcgaaaccttgccccacaagtatgagaccagagtcggggataaaggcacacagttatcaggaggacagaagcagcgcattgctatagcgagagcgctcattaggcagccccaaatactgctcttagacgaggccacttcagctctggacacagaatcagagaaggtggtgcaggaggcactggacaaagctcgagaaggtaggacatgcatcgttatcgcccataggttaagtactatacagaatgcagatctgatcgttgtctttcaaaatggaagggtgaaggagcacggtacacaccagcagcttctggctcagaaagggatatacttcagcatggtgtctgtccaagccggaacccagaacctgtag

SEQ ID NO: 4255 - DNA, 3840 bp, Artificial Sequence
  Description of Artificial Sequence: Synthetic coding sequence
atggatcttgaggccgcaaaaaatggaactgcttggcgtccgactagtgcagaaggcgacttcgaactcggaattagctccaaacagaagaggaaaaagacaaagaccgtaaaaatgatcggagtactcaccctgttcaggtactcagattggcaggacaagctgttcatgagcctcgggacaataatggccatagcacatgggtcaggcctccccctcatgatgatagtgttcggggagatgaccgataagtttgttgacaccgccggaaattttagctttccggtcaacttctctctgtccctcttaaatcccggtaagatcctggaagaagaaatgactaggtacgcttactattacagtggccttggagcaggagtgctcgttgctgcatatatacaggtcagcttctggacactcgcagcaggaagacaaatcagaaaaattagacagaagttcttccacgccattttacgacaagagatcggatggttcgacatcaatgacaccactgagcttaacacgcggttgactgacgacattagcaaaatctccgaaggcataggagacaaggtgggcatgtttttccaagccgtggccaccttctttgctgggttcatcgtgggttttatccggggttggaaactgacgctcgttattatggccatcagccccatcctgggtctgtccgccgcagtatgggcaaaaatcttgagcgcgttctctgacaaagaattagctgcatatgccaaggcaggcgctgtcgctgaagaggcactgggagctatcagaacggtgattgcgttcgggggacagaataaggaactggaacggtaccagaaacacctggagaatgctaaagagatcggcatcaagaaagccatctctgcaaacatatccatggggatcgctttcctcctgatctacgcaagctatgcactggctttttggtatggcagcaccttggtcatttccaaagagtacaccattggaaacgccatgaccgtttttttcagcatcctgatcggagccttttccgttgggcaggcggctccctgcattgatgcctttgccaatgcaagaggggctgcatacgtgatcttcgatatcatcgataacaaccctaagatagactcatttagcgaaaggggccataaaccagactccattaagggaaatctggagttcaacgatgtgcacttcagctatccttcgcgcgctaatgtaaaaatcctgaaaggtctcaacctgaaggtccagtccggccagaccgtggccctcgtgggaagcagcggctgtggcaaaagcaccactgtacagctgattcagagattgtacgaccccgacgagggcaccatcaatatagatggccaggacatcagaaatttcaatgtgaactaccttagagagatcataggtgtggtctctcaggaaccagtcctcttcagcacaactatcgccgaaaacatttgctacggacggggaaatgtcactatggatgagattaagaaggcagtgaaggaagcgaatgcttacgagttcatcatgaaactgccgcaaaaatttgatacacttgttggagaacggggagcacagctttcggggggacaaaaacagcgtattgcaattgccagggctctagttcggaacccaaagatccttctgctggacgaggccactagtgctctggatacagaatcggaggccgaggtgcaggccgctctggataaggcgagggagggcagaacaactatcgtgatagctcaccggctctccactgtccgaaatgccgacgtgattgcgggtttcgaggacggcgttattgttgaacagggcagccacagcgaactgatgaagaaggagggagtttacttcaagttggtcaacatgcagactagcggttcccaaatccagagcgaggagttcgaattgaacgacgagaaggcagcaacacggatggccccaaatggatggaaatctcgcctgttcaggcactccactcagaaaaatctgaagaatagccaaatgtgtcagaaaagcttggacgttgaaactgacggcctcgaagctaacgtccccccagtgtctttcttaaaagttctcaagttgaacaagacggagtggccatattttgtggtggggactgtttgtgccatagcaaacgggggattacagccggctttttccgttatcttctcagaaataatcgccatcttcggccctggcgacgatgccgtgaagcagcaaaaatgtaacatcttttccttgatattcctgttcctaggcattatatctttcttcacgttcttcctgcaagggttcactttcggcaaggccggtgaaattttgaccagaaggctgcgatctatggcgttcaaagccatgcttaggcaagatatgtcatggtttgatgatcacaagaacagtaccggagccctgtcaactagactggcaactgacgccgctcaggttcagggggcaactggtactagactcgctctcattgcccagaatatagcaaatctgggcactggtattattatctccttcatctatgggtggcagctaacccttctgctgctggcagttgtgcccatcatcgcagtatcgggcatcgttgaaatgaagctgctcgctgggaacgccaagcgtgataagaaggagttagaagctgctggcaagatcgccactgaagcaatcgagaacatccgaactgtcgtatcactgacacaggagaggaaattcgaaagtatgtatgtggagaagctgtatggcccatacaggaactctgtacaaaaagctcatatttatgggattacgttttcgatttctcaggccttcatgtattttagttatgcaggctgtttccgtttcggagcttacctaatcgtgaatggacatatgcggttcagggacgtcattctcgttttctcagcgatcgtgtttggagcagtggctcttggacacgctagttcctttgctcctgactatgctaaggctaagctgtccgcagcccacctgtttatgttgtttgagaggcagccactcattgactcatattcagaagaaggcctgaagcctgacaagtttgagggcaacatcacattcaacgaagtagtgttcaattatccgactagagctaatgtgcctgtgctgcagggcctatccctggaggttaaaaaggggcagactctggctctcgtaggctcctctgggtgtggaaagagtactgtggtgcagttgctcgagagattctacgatccactggcaggcacggtactgttggatgggcaggaggccaaaaaattaaatgtgcagtggctcagggcccagctgggcatagtaagtcaggaacccatcctctttgactgtagtatagcggaaaacattgcatacggggataattccagagtggtgagccaggacgagatcgtgtcagctgccaaggctgccaacattcacccctttattgagaccctgccacacaagtatgagacaagggtcggtgacaagggaacacagctctctggcggacagaaacagaggatagccattgccagagccctgattagacagccccagattctactgttggacgaggccaccagcgccctcgacacggagtccgagaaggttgtgcaagaagccttagataaggctcgggaaggcaggacctgtattgtcattgctcatcggctgagcacaatccagaacgctgatctgatcgtggtgtttcagaatggcagagtgaaagagcatggcacccaccaacaactcttggcacagaagggcatatactttagcatggtgagtgtgcaggccggaacccaaaacctgtag

SEQ ID NO: 4256 - DNA, 1464 bp, Artificial Sequence
  Description of Artificial Sequence: Synthetic coding sequence
atgcgcgagaatatggccagggggccatgtaatgctcctaggtgggcctcactcatggtcctcgtggctattggcaccgcggttacggcggctgtgaaccctggtgttgtggtacgcatttcacagaaaggtctggattatgcctcccagcaggggactgctgccctccaaaaagaattaaaaagaatcaagataccggattactcagatagttttaagatcaaacacctcggcaaaggccactacagcttttactccatggatattagggaatttcagctgccctcaagccagatatcaatggtacctaatgttggactgaagtttagtatttctaacgccaacattaagatttcgggcaagtggaaagcccaaaagcggttccttaaaatgtccggaaatttcgacttatcaatcgagggcatgagtatcagcgctgaccttaaattaggctcgaatccaacctcagggaagcccaccattacctgcagcagttgttcatctcatattaattctgtccacgtgcatatctcaaaatctaaggtcggctggctcattcaactgtttcataagaagatcgaatctgccttgcgtaacaaaatgaattcacaggtgtgtgaaaaggtcacaaactccgtctcaagcgaactgcaaccttacttccagacgctgcccgtcatgaccaaaattgactccgtggccggtatcaactacggcctggtggcccctcccgcaacaaccgctgaaactctagatgtccagatgaaaggagaattctactctgaaaatcaccataatccccctcctttcgctccaccagttatggagttcccagccgctcatgatcgcatggtgtacctaggcctcagtgattatttttttaacaccgctgggctcgtgtatcaggaggcaggcgtgttaaaaatgacccttagagatgacatgatcccaaaagagtctaaatttagactcacaactaagttttttggaacattcttacctgaagtggctaaaaagttcccaaatatgaagatccagatccatgtgagcgcgtccacaccaccccacctgtccgtgcagcccacaggactgacattttacccagctgtcgacgtgcaagcattcgccgttctccctaactcaagcctggcttcactgttcctaatcggaatgcacacgacagggtccatggaagtgtcagccgagtcaaatcgactggtcggtgagttaaaattggacagactgctgttggagctcaagcactctaacatcggccctttcccggtggagctcctgcaggacatcatgaactacattgtccccatccttgtgctgcctcgggtcaatgagaaactccagaaaggattcccgctaccgactccggctagagttcaactctacaacgtcgtcctccaaccccaccagaacttcctcctctttggcgctgacgtcgtgtacaaatag

SEQ ID NO: 4257 - DNA, 1449 bp, Artificial Sequence
  Description of Artificial Sequence: Synthetic coding sequence
atggacgagggaatcccacacctgcaagagcggcagcttttggaacaccgagactttatcggattggattattcaagcttgtatatgtgcaagcctaaacgaagtatgaagcgtgacgatacaaaggatacatacaagcttccacacagattgatcgagaagaagcgtcgagaccgtataaacgagtgtattgcccagctgaaggacctactgccagaacacctgaagctcacaactcttggccatttagaaaaggctgtcgttctggagttgacattaaagcacctgaaggccctgaccgctttgactgagcaacagcatcagaagattatcgcactgcagaacggggagcgttccctgaaaagccccatacagtctgatctggacgcatttcattctgggtttcagacttgtgccaaggaggttctgcagtaccttagccgcttcgagagttggacaccgagggagcctcgctgtgtacagcttatcaatcacctccacgccgtcgctacccagttcttacccacgcctcaactacttacacagcaagtgcctctctctaagggtacgggcgctccttccgcagcgggtagcgctgccgctccttgtcttgagcgggcagggcagaagctggaaccgctggcatactgcgtccccgtaatccagcggacccagccctccgctgaactcgcagcagaaaacgatacggatacggactccggctacggaggggaggcagaagccagacctgaccgcgagaaaggtaaaggcgctggagcaagtagagtgacaatcaagcaggaacctcccggagaagatagtccggcaccaaaacgcatgaaattggacagcaggggtggtgggtcaggaggcggtccaggcggtggcgcagcagctgccgctgcggcactactcggccctgatccagccgcagcagctgctctgcttagaccagatgccgctctgttatcctcacttgtggctttcggaggcggtggtggagccccttttccccagccggctgcagccgctgcaccattctgcctcccattttgctttttaagccccagtgccgctgcagcatacgtgcaaccattcctggacaagtcaggcctcgaaaaatatctctacccagccgctgcagccgctccattccccctgctgtatcccggaatcccagcccctgccgctgccgcagctgccgctgcagcggctgctgccgcagcggcagcttttccttgcctgagctctgtactgtcaccacccccagaaaaggcgggagccgcagccgctacactcctacctcacgaggtggcgccactgggcgctcctcatcctcagcatccccacggtagaacacatttgcccttcgctggccctagagaaccaggaaaccctgagtcatccgcacaggaggaccccagccagccaggaaaggaagcaccatag

SEQ ID NO: 4258 - DNA, 1113 bp, Artificial Sequence
  Description of Artificial Sequence: Synthetic coding sequence
atggatgaggggatacctcacctacaagaaaggcaactgctcgaacatcgcgacttcatcggccttgattattcttccctttacatgtgcaaaccaaaacggagcatgaaaagagatgacacaaaggacacttacaaactgccccacaggctcatcgagaagaagagaagagatagaatcaacgagtgcattgctcaactgaaggatctcctgcctgaacacctgaaactaacaaccttggggcacctggagaaagctgtggtgcttgagctgaccctaaaacacctgaaagccttgaccgcactgaccgaacaacaacaccaaaaaatcattgcgcttcagaacggagagcgctcccttaaaagtcctattcaatcagacctggacgcattccactccggttttcaaacttgtgctaaggaggtgctacaatatctatctaggtttgaaagctggacccctcgcgaaccaagatgtgtccagctgattaaccatcttcacgctgtcgctacacagttcctcccaacaccccagctcctaactcagcaggtgcccctgtccaagggtacgggagccccttcagccgcagggtccgctgctgctccttgtctggagcgcgctggacagaaactggaaccattggcttattgcgttcccgtgattcagaggacccaacccagtgccgaactggcggctgaaaatgataccgacaccgactccggctatgggggagaggcagaggcccgtccggatcgggagaaggggaagggcgcaggggcaagccgagtcacgattaaacaagagccacctggcgaagacagtccaccacctccacctcgtagcccggcatgccccagatgttgcagaccattacccagaagacgggcaccccctcctcgacctagttgccgaactcgttggcggccattgggacgccgaacccccagcactcggacggcggcaccaacatgcccctccccgggacccgcttcaagaggtacaagaagggctctgttacggaagattcccagaagccaggaaagaaaactgcctgaaagcctgcgccctgagggtcgacgattcaaacagagtgagaagctgaaatatccttag

SEQ ID NO: 4259 - DNA, 1191 bp, Artificial Sequence
  Description of Artificial Sequence: Synthetic coding sequence
atggtggccggtactcgctgcctgctggctctactactgcctcaagtacttctcggtggagcggcaggtctggtgcctgaattaggacgcagaaagttcgctgccgctagcagcgggaggccctcctctcagccgtccgacgaggtcctgagcgagttcgagctaaggcttctctcaatgtttgggttaaaacagcgccctacaccgtctcgggacgctgtggtgcccccatacatgctggatctgtatcgacgccactccggtcagcccggatccccagcacctgatcaccgactcgagcgagcggcttcgcgtgctaacaccgtcaggagtttccaccacgaggaatccttggaggaacttcccgagactagcgggaaaacaacacgtcgtttcttctttaacctgtcatcaattccaacagaagaattcattacctcagcagaattacaggtgttccgggaacaaatgcaggatgccctgggcaacaatagttcattccaccatcggatcaacatatacgaaattatcaagcccgctaccgctaactcaaaatttcctgttacgcggctcctggatacacgcctcgttaatcagaatgcttcgcggtgggagtcctttgacgtgaccccagccgtgatgagatggactgctcaaggtcacgctaaccacggtttcgtggttgaagttgcccaccttgaggaaaaacagggggtttcaaagcggcacgtgagaatcagccgctctctccaccaggacgagcacagctggagtcagattaggccactgctagtaactttcgggcatgatggtaaaggccatcccctgcacaagcgggagaagcgacaggcgaaacacaagcaacgcaagcgacttaagagttcctgtaaacggcacccactgtatgtggatttctccgacgtcggctggaacgattggattgtggccccacccggataccacgcattctattgccatggcgagtgtcctttccccctcgccgatcacttgaattctaccaaccacgccattgtgcagacactggtgaactccgtcaattctaaaatccctaaagcttgttgtgtgcccacggagctttcagctattagcatgctctacctggatgagaacgagaaagtggtccttaagaattaccaggatatggtggtggaaggttgtggctgtcggtag

SEQ ID NO: 4260 - DNA, 1296 bp, Artificial Sequence
  Description of Artificial Sequence: Synthetic coding sequence
atgcatgttcgtagcctgagagccgcagcaccccactcctttgtggcactatgggcgcctctgtttctgctcaggagcgcactggccgacttctccctcgataatgaggtgcactcatccttcattcaccgccgactccggagccaagaacgccgtgagatgcagagagaaatcctgtccatcctcgggctgccacaccgacctaggccgcatctacagggaaaacacaacagcgccccaatgtttatgctggacctatataatgctatggctgtggaggagggcggaggtcccggaggccaggggttctcatacccatataaagctgtgttctccacacaagggccaccattagcttccttgcaagattcacacttccttactgatgctgacatggttatgtcatttgtcaatttggtggaacacgataaggagtttttccatccacggtatcatcatagagagttccggttcgacctgagcaagattccagagggagaagctgtcactgccgcagagttcagaatttataaagactatatcagagaacgcttcgacaatgaaacatttcgtatcagtgtctaccaggtgttacaggagcatctgggaagggagtccgacctgttcctactcgacagtagaacactctgggccagcgaagaaggttggctcgttttcgacatcaccgcaacttccaatcactgggtggtgaacccaagacacaatctaggtttacaactgagcgtggagacactggacggtcagagcatcaatcccaaattggccggactgattggacgacatggacctcagaataaacagccatttatggtcgccttttttaaggcaactgaggtccactttaggtccattcggtccaccggctctaaacagagatcgcaaaaccgcagcaaaacgcctaagaatcaggaggctcttcgtatggctaatgtggccgaaaattcatcttctgatcaacgtcaagcttgcaagaaacatgaactctatgtgtcttttagggacttgggttggcaggattggatcatagctcccgaaggatacgctgcctattactgcgagggcgaatgcgcttttccgctgaatagttacatgaacgctaccaaccatgctattgtacagaccttagtgcatttcatcaatccagaaacggtcccaaagccatgctgtgcgccaacccagctgaacgccatctccgtgctgtactttgacgacagcagtaacgttattcttaagaaataccgcaacatggttgtgcgagcatgtggctgccattag

SEQ ID NO: 4261 - DNA, 1098 bp, Artificial Sequence
  Description of Artificial Sequence: Synthetic coding sequence
atgcacgtgaggagccttagggcggctgcgcctcacagtttcgtagctttatgggctcctctgttcctgctgcgatcagcactcgccgacttctctttagataacgaagtgcactcttcctttattcacaggaggctccgctcccaagagcgtagagaaatgcagagagaaatactgtcgatcttgggacttcctcaccggcctcggccacacttgcaggggaagcacaattcagcaccaatgttcatgttagacctctacaacgcaatggcggtggaagagggaggcggtcctggagggcagggcttcagctatccctataaggccgttttttcaactcagggcccaccactggcatcacttcaggactctcacttcctcacggatgccgacatggtgatgagcttcgttaacctcgttgagcacgacaaggaattcttccatcctcgttaccaccatcgagaatttcggtttgacctgtcaaaaatccccgagggagaagccgttacggccgcagagtttagaatctataaggattacatcagagaaaggttcgataatgaaacattccggataagcgtttaccaagtgctccaggagcacctcggtagagaaagtgacttgtttcttttggattctcgcactctgtgggcgagcgaggagggatggttggtgttcgacattaccgccacaagcaatcactgggtagtcaaccctaggcacaacttagggcttcagctcagcgttgagaccttagatgagaatagcagttccgaccagcgacaggcctgtaagaagcacgaactttatgtaagctttagagatctcgggtggcaagattggattatcgccccagaagggtatgcggcttactactgcgagggagaatgcgcatttccattgaactcttacatgaatgctactaatcatgccattgtgcaaaccctggtgcacttcattaacccggagacggttcccaagccatgctgcgccccaactcagctcaatgccatttcagttctttacttcgacgacagcagtaatgtgatcctgaagaaatacagaaatatggttgtgagggcatgtggctgtcactag

SEQ ID NO: 4262 - DNA, 1656 bp, Artificial Sequence
  Description of Artificial Sequence: Synthetic coding sequence
atggcaggcgacctgagtgccggttttttcatggaagagctgaatacataccgacagaagcagggagttgtgcttaaataccaggaactcccaaattccgggccaccccacgataggaggttcacattccaagtaatcattgacggccgagaattccctgaaggggaggggagatctaagaaagaggctaagaacgccgcagccaagctggctgtggagatcttgaataaggagaaaaaagctgtgtctcccctgctcctgactacaactaattcatcagagggcctcagtatgggtaactacatcggactcataaatcgcattgcacaaaaaaagcgcttgacggtgaattatgaacagtgtgcctctggcgttcacggacccgaggggttccactataagtgtaagatgggtcagaaagagtatagcatcggaaccggaagcacaaagcaggaggccaaacaactggcagctaagcttgcttatctgcagattctatctgaggagacctccgtcaaatctgactacctgtcatccggatcctttgccaccacctgtgagtctcagagcaactccttagtgacgagcacattagcaagcgagtcgagttctgagggggacttttctgccgatacatccgaaataaactcgaattcagacagcctcaatagttcttccctcctgatgaatgggctaaggaacaaccaacggaaggcaaagaggtccctggctcctagatttgacctgcctgacatgaaagagactaagtacaccgtggataagcgctttggcatggacttcaaagagattgagctgatcggctctggtggcttcggtcaggtgttcaaagccaagcaccggatcgacggtaaaacctacgttatcaaaagagttaaatataacaacgagaaggcggaacgcgaggtaaaagccctcgccaaactggaccacgtgaacatcgttcactacaacggctgttgggatggatttgactacgatcccgagactagcgacgactccctagaaagttccgactatgacccagagaattccaaaaattctagcagatccaaaactaaatgtctattcatccagatggaattttgtgataagggtaccctagagcagtggatcgagaaaagaagaggagaaaagctcgacaaagttctggctcttgaattgtttgaacagattacaaagggagttgactacatccacagcaaaaagttgatccatcgggatctaaaacccagcaacattttcctagtggatacaaagcaggtaaaaattggcgatttcggcctggtgactagcctgaagaatgatggaaagagaactagaagtaagggcaccctgcgttacatgtcaccggagcaaatttcttcccaggactacggaaaggaggtggacttgtacgcattgggacttattctggcagagctacttcacgtgtgtgacactgcttttgagacaagcaaattcttcaccgacttacgggatggaataattagtgatatattcgataaaaaagagaagacgctgttgcagaagctccttagcaagaagcctgaggataggcctaacacttctgaaatactgagaacactgaccgtgtggaagaagagcccagaaaagaacgaaagacatacttgctag

SEQ ID NO: 4263 - DNA, 366 bp, Artificial Sequence
  Description of Artificial Sequence: Synthetic coding sequence
atgacacggatcctcactgcctttaaggtcgtgcgcacactgaaaacggggttcggctttaccaatgttacagcccatcaaaagtggaagttcagccgccctggcataaggctgctgtccgtgaaagcgcaaaccgcacacattgtgctggaggatggaactaagatgaaaggttattcgttcggacatcctagttctgtagcaggcgaggtcgtgttcaatacgggtctgggtgggtatcccgaggccataaccgatccagcttacaaaggtcagatcctgaccatggccaatccaatcattggcaatggaggagcgccagatactaccgccctcgatgaacttgggctgtccaaatacttgtag

SEQ ID NO: 4264 - DNA, 4521 bp, Artificial Sequence
  Description of Artificial Sequence: Synthetic coding sequence
atgccacagatcattaaaatgactagaattctgactgccttcaaagtagtccggacccttaagaccgggtttggtttcactaatgtaacagcacatcaaaaatggaaattttctcgacccggaatccggctgctctctgttaaggcccagacagcccacattgtgttggaagacggaaccaagatgaaaggatactctttcgggcacccatcaagtgttgccggagaggtcgtattcaatacaggactgggagggtaccccgaagccattactgatcccgcatataaaggccagattctgaccatggcaaatccaatcataggaaatggcggagctccagatactacggcactagatgaattgggacttagtaagtaccttgagtcaaacggtattaaggtgtcaggattactggtcctcgattattcaaaagattataatcactggctcgcgaccaagagtcttgggcagtggctgcaggaagaaaaagtgcctgccatttacggagtggacactagaatgctgacaaaaataattagagacaaaggcaccatgcttggtaagattgaatttgagggacagcccgtcgatttcgtcgatcccaacaaacagaatctcatcgctgaggtcagcaccaaggacgtaaaggtgtacgggaaaggaaaccctacaaaggtggtcgctgtggactgcggaattaaaaacaatgtcattcgcctactggtgaaaagaggcgctgaggtccatttggtaccatggaaccatgacttcactaaaatggagtacgatggcatcttaattgccggaggtcctggtaaccccgctttagccgagcctctgatccaaaacgtgaggaagatcctagaatccgatcgaaaagaacccctctttggcatctctacaggcaacttgataactgggttggcagcgggagctaagacctacaagatgagcatggctaaccgtgggcaaaatcaacccgtgctgaacataaccaataaacaggccttcataaccgcacagaaccacggctacgcattggacaacaccttaccggctggatggaaacctctgttcgtgaatgtgaacgatcagaccaatgaaggaatcatgcacgagagtaaaccctttttcgctgttcagttccatcctgaagtcacccctggcccaattgatacagagtacttgtttgacagcttcttttccctaatcaaaaagggtaaggcaaccactataacctcagttctccccaagccggcattggtggcatcccgcgtagaagtttcgaaagtgctgattcttggcagcggaggcctgtctatcggccaggcgggtgagtttgattactccggatcacaggccgtgaaggctatgaaggaggaaaacgtcaagacagtcctgatgaatccaaacatcgcgtccgtgcagaccaatgaggtcggactgaagcaagccgatacagtatacttccttcccatcaccccacagtttgtcactgaagtgattaaggccgagcagcccgatggcttgatattaggaatgggcggacagaccgcacttaattgcggggtcgagctgttcaagaggggtgtcttgaaagagtatggagtcaaagtcctaggaacgtccgtggaatccatcatggcaacagaggatcgacagttgtttagcgacaaactcaacgaaatcaacgaaaagattgcaccatcattcgctgtggagagcatcgaggatgcccttaaagcagccgacacgatcggctatcctgtgatgatcagaagcgcttacgccctgggcggtctgggctctgggatttgtcccaaccgggaaacattgatggacctcagcacaaaagcctttgccatgaccaatcaaattcttgtcgaaaaatccgtcactggttggaaggaaatcgaatacgaagtcgtgagggacgccgacgacaactgcgtcacagtctgcaatatggaaaacgtggacgcaatgggggttcataccggggactctgtggtagtggcccctgcccagacactttcaaacgctgagtttcagatgctccggagaacttcaatcaatgtcgtcagacatctggggatcgtgggcgaatgtaacatacagttcgccttgcacccaacctctatggagtactgtattattgaagtgaatgccagactgtcccgatctagcgcccttgcttcaaaagcaacagggtatcccttggccttcatcgctgcaaagatcgccctgggtattcctctgcctgagatcaagaatgtggtgtccggaaagacatcggcgtgtttcgagccatcactggattacatggtgactaagatcccacgctgggacctggatcgctttcacgggactagctcacggatcggtagcagcatgaagtctgtcggcgaagttatggctatcggacgcacattcgaggaatcctttcagaaagcgctgaggatgtgtcatcccagcattgaggggttcacaccacgactgcccatgaataaggagtggccaagtaatttggacctgagaaaggaactgagcgagcctagctctaccagaatctacgctatcgcaaaggccatagacgataacatgtctctggatgagattgagaagctaacttatatagataagtggtttctgtataagatgagagatatcctgaatatggaaaaaactctcaaggggctcaacagcgagtccatgacagaggagacattaaaacgcgctaaggagatcggattctcagacaaacaaatctccaagtgtttgggcctcacagaggctcaaacgcgggagctgcgcctgaagaagaacatccacccatgggtgaaacaaatagacacactggctgccgagtacccttcggtgactaactatctttacgtgacctacaacggccaggagcatgatgtcaactttgatgaccacggtatgatggtactcggttgcggaccatatcacattggatcaagtgtagaatttgattggtgtgctgtgagctctatcaggactcttcgccaactcggaaagaagacagtggtggtcaattgtaatcctgaaacagtgagtacggacttcgacgaatgtgacaaattgtattttgaggaactgagcctggaacggattctggacatttatcaccaggaagcttgcggtgggtgtatcatatctgtgggaggccagatccctaacaacctcgccgtgcctctctacaagaacggtgtaaagattatgggtacctcaccgctccagatcgatcgtgccgaagaccggtctatcttctccgccgtgctcgacgaactaaaagtggcccaggctccctggaaagcagttaatactctcaatgaagcgctggaattcgccaagtctgtggactatccttgcctgctgaggcccagctacgtcttaagcggttcagctatgaatgttgtgttctcagaggacgaaatgaaaaagttcttggaggaggcgaccagggtttcacaggagcaccccgttgtgttgacaaagttcgttgagggtgccagagaagtcgaaatggacgcagtgggtaaggatggacgggtcatatcacacgccatcagcgaacatgtagaggacgcaggagtgcacagtggggatgctacactgatgctgccaacacagaccatctctcaaggagccattgaaaaggtgaaggacgccactcgcaaaattgctaaagccttcgccatttcaggcccatttaatgtccagtttctagtgaagggaaacgacgttttggtaatcgagtgcaatttacgagcctcccggtccttccccttcgtaagcaaaaccctcggtgtcgacttcatagacgttgccacaaaagtaatgattggtgaaaacgtcgacgaaaagcatctcccgaccctggaccatccaattatacctgccgattacgtagcaatcaaggcgccaatgttctcctggcccagattaagggatgctgatcctatccttcgatgtgagatggcctctacaggggaagtagcctgctttggcgaagggatccacactgcatttctcaaggccatgcttagcactggatttaaaatcccacagaagggcattctcatcggtattcagcagtcattccgtccgcgattcctcggtgttgctgaacagctgcacaacgagggatttaagctcttcgcaacagaagctacctccgattggctcaacgcaaacaatgtgcctgccactcctgttgcttggccttcccaggaaggacaaaatccatccctgagttccattagaaaactgattcgcgatggctctattgacctggtgattaacctgccaaacaacaatactaagtttgtacatgacaactatgtgatcagacgcacagcagttgactcagggattcccctcctgacaaattttcaggtgaccaagctgttcgctgaggcagtacaaaagtctaggaaagtagattccaaaagcctgttccactatcggcaatatagcgcgggtaaggctgcttag

SEQ ID NO: 4265 - DNA, 3150 bp, Artificial Sequence
  Description of Artificial Sequence: Synthetic coding sequence
atgaaggaggagaatgtaaaaacagtgctgatgaaccccaacatcgcgagcgtccagacaaatgaggtgggattgaaacaggctgacaccgtgtactttctgccgataaccccccagtttgtgacagaggttatcaaggccgagcagcctgacgggctgattctgggtatgggtgggcagacagccttgaattgtggagtcgagctgtttaagcgcggagtcctcaaagagtacggggtgaaagtactaggtacttctgtcgaaagcataatggccacggaagaccggcagctgtttagtgataagctgaacgagatcaacgagaagatcgctcccagtttcgctgtcgagtccattgaggacgcgctaaaagcagcggacactatcggttaccccgtcatgatacgatcagcatatgctttgggcggactcgggtcaggcatttgtcccaatagggagacactcatggacctcagtaccaaggcgttcgctatgaccaatcaaattctggttgaaaagagtgtgacgggatggaaggaaattgaatatgaggtcgtcagggacgccgacgacaactgcgtgaccgtgtgcaatatggaaaacgtggacgctatgggagtacacacaggagactccgtcgtggtagcacctgcccagaccctttcgaatgctgagtttcagatgctgcgtaggactagcatcaatgtggttagacatttaggaatcgtgggagaatgtaatattcagtttgcgctgcacccgacatccatggagtattgtattatcgaggtcaatgcccgtcttagccgcagtagcgctttggcaagcaaagccacaggttacccactcgctttcatagcagccaaaatcgctctgggaatacccctgcctgagattaaaaatgtcgtgagcgggaagacctctgcctgctttgagccctccctggattacatggtcaccaagataccacggtgggatttggacaggttccacggtacttcctctaggattggatccagtatgaaaagtgttggcgaagttatggcaatcgggagaacctttgaagagagctttcagaaagcgttaaggatgtgtcacccaagtatcgagggtttcacccccagacttcccatgaacaaggaatggcccagtaacctggacctaagaaaagaactgagcgagccatcaagcacgcgcatttatgccatagcgaaagccatagacgacaacatgtctttggacgagattgagaaactgacatatattgacaagtggttcctgtacaaaatgcgtgacatattaaacatggagaaaaccttaaaggggcttaactccgaatctatgactgaagaaactttaaaaagggcgaaagaaatcggtttttctgacaagcagatctcgaagtgccttggcctcaccgaggcacaaactcgagaacttcggctgaagaagaatatccatccatgggtcaagcagatcgatacgcttgctgccgaatacccctccgtcacaaactacttgtacgtcacctacaatggccaggagcatgatgtgaatttcgacgaccatggaatgatggttctaggctgtggcccataccacatcggaagcagtgttgagtttgactggtgcgcagtgtcttccatccggacactgagacagctcgggaaaaaaactgtggtggtcaattgcaaccccgaaactgtctccactgattttgacgaatgcgacaagctgtactttgaagaactgagtctggaacggatcctggatatttatcatcaggaagcatgtggagggtgcattatctcagtgggcggacagattcctaacaatttggcagtgccactgtataaaaatggcgtgaagatcatgggtacatcccctctgcaaatcgaccgcgctgaggatagaagtattttttcggcagtcttagacgaattgaaggtggctcaagccccatggaaagctgtgaataccctgaatgaggctctagagtttgctaagagcgtcgattatccatgtctcctgcgaccttcatacgtactgagcggatcagctatgaatgtcgtattcagcgaagatgaaatgaaaaagttcctggaagaggccactcgcgtgtctcaggagcaccctgtcgtgctgacaaagttcgtggagggagccagagaagtggagatggatgcagtcggcaaggatggccgtgtgataagtcacgcgataagtgagcacgtcgaagacgcgggtgttcattctggagacgctacccttatgcttcctacacagaccatatcccagggagcaatagagaaggtcaaagacgccactcgcaaaattgccaaggcctttgcgatctcaggaccgtttaatgtccagtttctcgtcaaggggaatgacgtgttagtgatagagtgcaatctccgagcctcccgatcattcccctttgtctctaagacccttggagtggattttatagacgtggccacaaaggtgatgatcggcgagaacgtggacgaaaaacatctgccaactcttgaccatcccatcattccggctgactacgtggctataaaagctccaatgttctcgtggcctaggctgagggatgccgatccgattctcagatgcgaaatggcatccacaggcgaagtggcctgctttggcgaaggaatacatacggcattcctgaaagcaatgctgagtacaggtttcaaaatccctcagaagggaatcctcataggcatccaacagagtttccgcccaaggttcttgggcgtagcagagcagttacataacgaggggtttaagctctttgctaccgaggctacatccgattggctcaatgctaacaatgtgcctgcgacaccagtggcctggccctcccaagagggccagaacccttccctgagttctatcagaaagcttatcagagacggcagcatagaccttgtcattaacctgcctaataacaatacaaaatttgtgcacgacaattatgtcatccgcagaacagcggtggattctggcatcccattgctcaccaacttccaagtgactaagctttttgcagaagccgtgcagaagtctcgcaaggtggattccaaaagccttttccattaccggcagtactcggccggaaaggcggcttag

SEQ ID NO: 4266 - DNA, 366 bp, Artificial Sequence
  Description of Artificial Sequence: Synthetic coding sequence
atgacacggatcctaacagctttcaaagtcgttcgaactttgaaaacagggttcggtttcacgaacgtcacggcacaccagaaatggaagttctcccgtccagggattcgcctgctgtccgtcaaagcccagaccgcccatatcgtgctggaggatggcactaaaatgaagggctattcctttggacatccttcaagcgtggctggcgaagtggtgttcaataccggattgggaggataccccgaagcaatcacagatccagcctacaagggacaaatactgaccatggccaacccgattatcggtaacggcggagcccctgacacaactgccctagacgaactaggcttgtccaaatacctttag

SEQ ID NO: 4267 - DNA, 1542 bp, Artificial Sequence
  Description of Artificial Sequence: Synthetic coding sequence
atgacaaggattctcacagcctttaaagtcgtccgaaccctcaaaacagggttcggcttcaccaatgtaacagcacaccagaagtggaagttcagtagaccaggaatccgcctcctttccgtgaaagcccaaactgcccatatcgtacttgaagacggcaccaagatgaagggttactcatttgggcatccttcgtccgtcgccggagaggtcgttttcaacacaggtctgggaggatatcctgaagccataacggaccccgcttacaagggccagattcttaccatggcgaatccaattatcggtaacggcggagctcccgatactaccgctttagacgaactgggactgagcaaatatcttgaatcaaacggaatcaaagtcagcggactgttggtgttggattatagcaaggactacaatcactggctagccaccaaaagcctggggcagtggctgcaggaggaaaaggtcccagcaatctatggcgttgacacccgcatgctcactaagatcattcgtgacaaaggcactatgcttgggaaaatagagtttgagggtcagcctgtggatttcgtcgacccaaacaagcagaacctcattgctgaggtgtcaacaaaggatgtaaaagtctatggaaaaggaaatcccacaaaagtggtggcagtggattgtggcatcaagaacaacgtgatccgtctgcttgtcaaacgaggcgcagaggtgcatctggtaccctggaatcacgacttcacaaaaatggaatacgatgggatactgatcgccggtggacctgggaatcccgcactggccgaaccactgatccagaatgtcagaaaaatcctcgagtccgatcgcaaggaaccactgtttggcatttccaccggaaatctgatcaccggcctggctgccggtgcgaagacatacaagatgtctatggcaaaccgcggacagaaccagcctgtcctgaatatcacaaacaagcaggctttcattaccgctcaaaaccacggatacgctctagataacacactgccagcaggctggaaaccactctttgtgaatgtcaacgatcagactaatgagggcattatgcatgagtccaaacctttctttgctgtgcaattccatcctgaggttacccctggaccgatcgacacagagtacctgttcgactccttcttctcactcattaaaaagggcaaggcgaccaccatcacgtctgtgctgccaaagcccgctctggtcgcttcaagggtggaggtctccaaagtactgattttgggcagtggcggtctgagcatcggccaggctggcgagtttgactattcgggctcccaggccgtgaaggcaatgaaggaggagaatgtcaaaacggtgctgatgaacccaaacattgcttctgttcaaacaaacgaggtgggcctcaagcaagctgataccgtgtatttccttcctatcacccctcagtttgtcactgaagtcattaaagcagaacaaccggatggactcatcctaggcatgggcgctaggcaactttag

SEQ ID NO: 4268 - DNA, 4527 bp, Artificial Sequence
  Description of Artificial Sequence: Synthetic coding sequence
cgtcctcggccacagatcatcaagatgactcgcattctgactgcgtttaaagtcgtccggacgctgaaaacgggatttgggttcacaaacgtaactgcgcaccagaaatggaaattttctaggccaggcataaggcttttgtccgtgaaggcgcagaccgcacacatagtgctggaggatggcaccaagatgaagggctactctttcggacatccttcgtccgtcgctggcgaggtggtttttaacactgggctcgggggatatcccgaggccatcactgacccagcatacaagggccagattttaaccatggccaatcccataattggcaacggcggtgctccagacactacagccctggacgagctgggactcagtaaatacctcgaatccaacggtattaaggtgagcggattgctggttttagactactcaaaggattacaatcactggttggcgacaaaaagtttgggacaatggttacaagaggagaaggtccctgctatttatggcgttgacacaagaatgttgactaagattattcgggacaagggcacaatgcttggcaagatagagtttgagggtcagccagttgattttgtggatccgaacaaacagaatcttattgctgaggtcagcactaaggatgtcaaggtctatgggaagggcaaccccacaaaagttgtggccgtggactgtggcatcaagaacaacgtcattagacttctagtgaagcggggagctgaggtccacctagtgccatggaatcacgacttcaccaaaatggagtatgatggaattctcattgccggtggtccgggaaatccagctctggctgagcctctaatccagaacgtcaggaagattctagagagtgatagaaaggaacccctatttggtatcagcaccggaaacctgattacaggcctggccgctggagccaagacttataaaatgtctatggcaaatcgtggacagaatcagcccgtcctgaatattaccaacaagcaggcttttatcacagctcagaatcatggttatgctctggataacaccctccctgctggttggaagcctctgtttgttaatgtgaacgatcaaaccaacgaggggataatgcacgaaagcaagccattttttgccgtacaatttcacccagaagtcacccctgggccaatagacactgaatacctttttgattctttcttcagtctgatcaaaaagggcaaggctaccaccatcacgtcagtcctcccaaaacctgcgttggtcgcctcccgagtggaagtgagcaaggtattaattttgggctcagggggattatcaatcggtcaggcaggcgaattcgactattcaggtagccaggccgtaaaagcaatgaaggaggagaacgtaaaaacagttctgatgaaccctaacattgcatccgtgcagacaaacgaggtggggttgaagcaggcagacaccgtgtacttccttcccatcactcctcagtttgttaccgaagtgatcaaagccgaacagcccgatggtctgatattaggaatggggggtcagactgccctcaattgtggagtagagctctttaagaggggcgtgctcaaagaatacggcgtcaaggtcctggggacttctgtcgagtcaattatggctactgaagatagacagctgttcagcgataagttaaacgagataaacgagaagatcgcacccagctttgccgtggaatcgattgaagatgccctgaaggcggcagacacaatcggttatccagtcatgatccgcagtgcttacgcactcggaggtctgggaagcgggatatgccccaatcgtgaaacacttatggacctgtccactaaggcattcgccatgacgaaccagatcctggtggaaaagtctgttactggctggaaagagatcgagtacgaggtcgttcgggacgcagatgacaactgtgtcacagtgtgtaatatggagaatgtggatgcaatgggcgtccacaccggcgactcggttgtagtggcaccagctcagacactgagtaatgccgaattccagatgttgcggcgtacgagtatcaatgtggtgagacaccttggcatcgtcggtgagtgtaacatccagtttgccctgcatcctactagcatggagtactgcatcatagaggtcaatgcgaggctgtctcggtcatcagccctcgcctccaaagcaactggttacccgctcgcctttattgcggctaaaatagccctggggattccgctgccagagattaagaatgtggtatccgggaagacttccgcttgctttgagccaagtctcgattatatggtcactaagatcccacgctgggacttggatcgatttcacggcacctcatctcgcatcggcagctctatgaaatcggtgggggaggtgatggccattggcagaaccttcgaggaaagtttccagaaagcgcttcggatgtgccatccctctatcgaaggcttcaccccgagactgcccatgaataaggagtggccttctaatctcgatctgcggaaggagctctctgaaccatccagtactcgtatctacgccatcgctaaagccattgatgacaatatgtctctggacgaaatagagaaacttacctacattgacaagtggtttttgtacaagatgagggatatactcaatatggagaagacactgaagggtctgaactccgaatctatgaccgaggaaacactgaaaagagctaaggagattgggttctcagataagcagatcagcaagtgcctcggtttgacggaggcccaaacccgggagctcagattaaagaagaacattcacccatgggttaagcagattgatacgctggccgctgagtatcccagtgtgactaattacctgtatgttacttataacggccaggagcatgacgtgaatttcgatgaccacggcatgatggtgctggggtgtgggccataccatattggttcatctgtagagttcgactggtgcgccgtgtcgagtatacggacacttaggcagctgggcaaaaagaccgtggtcgtcaactgcaaccctgaaaccgtatccacagatttcgatgagtgtgacaagttgtactttgaggaactgtctctggagaggattctggatatctatcatcaagaggcttgcgggggatgcattatatcagtgggaggtcagattcctaacaacctggccgtgccactttataagaatggtgtgaaaatcatggggacttccccgctgcagatcgatcgggcagaagatagatccattttctctgcggtgttggatgagctcaaagtcgcccaggcaccctggaaagctgtgaacactctcaacgaggccctcgagttcgcaaagagcgttgattatccttgcctcctcaggccttcatatgtcctgagcgggagcgcaatgaacgtcgtgttttccgaggatgagatgaagaaattcctggaggaggccacccgcgtgtcccaggaacacccggtcgtgttaactaaattcgtggagggcgcaagggaagtggagatggacgctgtgggaaaggatggtcgcgtcatttcccatgccatttccgaacatgtggaggatgccggtgtgcatagcggtgatgctacactgatgctccccactcagacaattagtcagggcgctatagaaaaagtgaaggatgctactcgtaagattgccaaggccttcgccattagtggccctttcaacgttcagttcctggtgaagggcaatgacgtgctggtaatcgaatgtaacctcagagcatcccggtcctttccattcgtgagcaagacactgggagttgatttcatcgatgttgccactaaagtgatgattggcgaaaacgtcgacgaaaagcatctacccactttggaccatcctataattcctgcagactacgtggccattaaagctcctatgttctcttggccacgattgagggatgccgacccaatcctcaggtgcgagatggcaagcaccggcgaagtcgcctgtttcggtgaaggcattcacacagcattcctgaaagccatgctgtccactggctttaaaataccccaaaagggaattctgatcggcatccaacagtccttcagaccacgatttctgggcgtggctgaacaactgcacaatgaggggttcaagttgttcgcaacagaagccaccagcgactggctgaacgccaataatgtaccagcaaccccagtggcctggccatctcaggaaggtcagaaccccagtctatctagtatccgcaaactgattagggacggtagcatcgatctggtgatcaacctccccaacaacaataccaagtttgtgcatgacaactacgtgatccgccgaaccgcagtggactccggcatcccccttctcaccaatttccaggtgacaaaattattcgccgaagcggttcagaaaagccggaaggtggactctaagtctttgtttcattaccgccagtattccgcaggcaaggctgcttag

SEQ ID NO: 4269 - DNA, 213 bp, Artificial Sequence
  Description of Artificial Sequence: Synthetic coding sequence
atgactcgcatcctaacggcttttaaggtggttcgcacccttaagactgggtttgggttcaccaatgttacagcacaccagaaatggaagtttagtcgtccagggattcgtctgctcagcgtcaaagcacaaaccgcacacatcgtgctcgaagatcgtgacgcagacacacctgcgcctttattgaaccagcccgagcctcatgtgatttag

SEQ ID NO: 4270 - DNA, 606 bp, Artificial Sequence
  Description of Artificial Sequence: Synthetic coding sequence
atgtcgagacgggaaggaagcctggaggatcctcagactgacagctcagtgtctctcctgccacacctcgaagctaaaattcgtcagacccactctctggcccacctcttgacaaaatacgcggagcagctgttacaggaatacgtgcagcttcagggggaccctttcggactgccatctttttcccctcctagactgccagttgccggactgtctgcccctgccccttctcatgcaggtctgccagtgcacgagaggctccggttggatgcagccgcacttgctgccctgccccctctactggacgccgtctgcagaaggcaggccgagctaaaccctagggcacctcgtctacttcggagactggaagacgccgctaggcaggcgagggcgctgggtgccgctgtcgaagcactgctggccgcattgggagctgccaatcgcggaccaagagctgaacccccagctgccaccgccagtgccgcttctgctacgggcgtattcccagccaaagttctggggctgcgtgtctgtgggctgtacagggaatggctgtctcgcactgagggagacttgggccagctgctgcccggagggagcgcatag

SEQ ID NO: 4271 - DNA, 603 bp, Artificial Sequence
  Description of Artificial Sequence: Synthetic coding sequence
atgtcgaggcgggagggctccctggatccccagaccgatagctccgtatctttgctcccccacctggaggccaaaatcaggcagacccacagcctcgcacacctactgacaaagtatgcagagcagcttctccaagaatacgtgcagctgcagggcgatccgtttggcttgccatctttcagccctccacgcctgccggttgctgggcttagcgctcccgctcccagccacgccggtctcccagtgcacgagcgtctgagactcgatgccgctgcgttagccgcactgccgcctttgctcgacgccgtatgtcgaaggcaggcggaacttaatcctagggcacccagattgctcagaaggctggaagatgccgctaggcaggcacgggcactcggcgctgccgtcgaggccctcctcgccgcactgggagctgctaaccgaggccctcgggctgagccccctgccgcaaccgcaagtgcagctagcgcaaccggagttttccctgccaaggtgttaggacttcgtgtgtgtggtttatatagagaatggctctctcgcactgaaggcgacttaggacagctgttaccaggcggatcagcctag

SEQ ID NO: 4272 - DNA, 513 bp, Artificial Sequence
  Description of Artificial Sequence: Synthetic coding sequence
atgaagactcaaagggacggacattccctaggcaggtggtctttggtgctcctgttgctcgggttagtgatgcctctggccatcattgcccaggtgctaagctataaagaagcagttctccgggcaattgacggaatcaaccagcgtagctctgacgctaatctctatagactgctggatctagaccctaggcctactatggatggcgaccctgacacccccaagccagtaagttttaccgtgaaagagacagtgtgccccagaaccacacagcagagccccgaggactgtgattttaagaaggacggtcttgtaaagagatgcatgggcaccgttacgctgaatcaggccaggggctcattcgatataagctgtgacaaggataacaaaaggttcgccctgctgggcgacttttttagaaagtctaaggaaaaaattggcaaagagtttaaacgcattgtccaaagaattaaggactttctaaggaatctggttcccaggaccgagtcctag

SEQ ID NO: 4273 - DNA, 1692 bp, Artificial Sequence
  Description of Artificial Sequence: Synthetic coding sequence
gcatgctgttgtggcggaggatgcacatgctgtggctgcacgtgtacgactggttgctgcactacgtgcacttgttgcgcctgtgcgtgcactacaggaaccacaacgggggcaggagcgtgctgcacaggcggttgcgcagcgggtggcacaggctgcggtggcgcaggctgctgctgcacttgctgcgctggagccgcaggcacgggctgcggcggaacatgcgccgctgggtgcggaggctgcgcgggatgtggcggtgccggtgcttgcggaggctgtggcgcaggctgttgtgcaggaggcgctgcttgctgtacgtgctgctgctgctgctgcgggtgcgggacatgctgctgttgtgcaggctgcacgacttgttgctgtgccggatgcgggaccgggggatgtggcggatgtggaggcgctgcatgttgctgttgctgtggaggcgctggtgccgcagctggagcggctacagctgctgccggtgcttgcacaggtggggcaacggcatgtgctggcggaacatgttgtgccacaacagcctgcggaacatgcgccacaacttgtaccggctgcgcagggggttgttgtgcggcaaccaccaccgcaaccggtgccggaggcgctgctacctgctgcgccgctggcgcaacaggcgcagccaccacaaccggcggagcaggttgtgctggcggtgctggggctggtggatgttgtggcactactacaggaacgtgtacgggttgcgctggcacaggctgttgttgctgtgcagggggttgtacaggatgcacgtgctgctgcgctgggtgcgggtgtactacctgctgctgcgccgcttgcgctggcgctggaggggcttgttgtgcgacatgcaccggcgcaacaggtgctactacgtgtgctacagcagggggttgtgcctgtgccgcagcatgcgccactggcgcagccgctacaggagcttgtactactactggcgctgcagggaccactacctgttgtacaacatgcgcagccaccgccgcagccgcagcctgcgccggtgcttgcgccgctaccgccacaggaactaccgctacctgcgccggtgctacttgtgccgcagcttgtacctgctgcggggcatgctgttgctgcgcagcgtgcggtgcgggagctaccacttgctgcacaggcgcagccggagcggcttgcactggctgtggagccggtggggctgggggaaccggaggaggctgttgtacttgtacaacgtgtgccggatgtggcgctggctgcacgggcggagcatgtaccggatgtacttgttgttgcaccggaggcgcaggctgtgcttgcggcgcaggaacaacatgtgctggaggcgcagccggaggctgcacgtgcgctgggggtgctgcaggggctggtggcgcaggcgctggatgcgccggttgcgccgctggttgtgggggtgctgctactgccacctgcacatgcggagctactggctgtgccactgccgctactgggtgcgccggtactaccggcggtaccggaggagggggatgctgtgccaccggcgcttgcgggggagggggatgctgttgtgggggagccgcttgtacctgcgcgtgctgtgccggttgcactactgcaggttgcgcaggatgcggatgtacatgtggtgggtgtaccgggtag

SEQ ID NO: 4274 - DNA, 555 bp, Artificial Sequence
  Description of Artificial Sequence: Synthetic coding sequence
atggccgatcacctgatgctggcggagggttatcgactcgtccagagaccacctagtgccgcagcagcccacggtccacacgccctccgcacactgccgccatacgccggacctggtcttgacagcggcctgcgacctcgaggtgctccgctgggccctccccctccacgccagccaggcgcactggcctacggggcattcggtcctccctcatcgtttcagccatttccagccgtgcctccacctgctgccggaatcgcccacctgcagccagtggcaactccctacccaggtcgggcagcggctccgccaaatgccccaggcggaccgccaggcccacagcctgccccatctgcggctgctcctcccccacccgctcacgctctcggcggaatggacgccgaacttatagacgaagaagcactcacttctcttgaattggagctcggtctccacagagtccgagaacttcccgaactgttcttgggacaatctgaattcgattgcttttccgacctgggctctgctcccccagcgggatccgtctcctgctag

SEQ ID NO: 4275 - DNA, 3198 bp, Artificial Sequence
  Description of Artificial Sequence: Synthetic coding sequence
atgaaaattctcattctcggcatcttcctttttctgtgtagtactcccgcttgggctaaggaaaagcactactacatagggataatcgaaacaacctgggattacgcttccgaccacggagagaaaaaactgatctctgtggataccgagcattccaacatttatctgcagaatggcccagaccgcattggcaggctgtacaagaaagccctgtacttacaatacactgacgagacgttccgtacaaccatcgagaagccagtgtggctggggtttctggggccaatcatcaaggcagagacaggtgacaaagtgtacgtgcacctgaaaaatctcgcgagtcgcccatacacatttcattcacacggaattacctactacaaggaacacgagggggctatttaccccgacaacaccaccgacttccagagagccgacgacaaagtgtaccctggggagcagtatacctatatgctgctggccaccgaggaacagtctccaggtgaaggggacggcaactgcgtcaccaggatctaccactcccacatcgatgcccctaaagatatagcaagtggcttgattggaccattgatcatctgtaaaaaagattctctcgacaaggagaaggagaagcatattgacagggaattcgtggtgatgttcagcgtcgtcgatgagaacttcagctggtacttagaagataatatcaaaacctattgctccgaaccggagaaggtcgataaggacaatgaggattttcaggagtccaacaggatgtactccgttaacgggtataccttcggcagccttccagggctgagcatgtgcgccgaggatcgggtgaagtggtacctgttcgggatggggaatgaggtagacgttcacgctgccttttttcacgggcaggctctcacaaataagaactataggatcgatacaattaatttgttccctgccacactgtttgacgcctatatggttgcccagaaccctggggaatggatgctttcttgtcagaatctgaaccatctcaaggcaggcctgcaggctttttttcaggttcaagagtgcaacaaaagttcttctaaagacaatatccgtggcaaacatgtgagacattactacattgccgcagaagagattatatggaattacgccccatccgggatcgacattttcactaaggaaaacctgactgcaccagggtccgacagtgctgtgtttttcgaacaagggacaactaggatcggcggttcttacaagaaattggtttatagagagtacacggatgcctcctttaccaatagaaaagaacgtggtccagaggaggagcacctgggaattctgggtcccgtgatctgggcggaagttggcgacacgattagagtcacattccataataagggcgcttaccccctttccatcgaaccaatcggcgtcagattcaacaagaacaatgaaggcacctattatagccccaattataatccacagtccaggtctgttccaccatcagcttcccatgtggccccaaccgaaacgtttacctacgaatggacagtgccaaaagaagtcggtcccaccaacgcggatccagtctgtttggccaagatgtactactcagcagtggagcccactaaagacatctttaccggcctcattggtccaatgaaaatctgtaagaagggcagtctgcatgcaaacggcagacagaaggacgtggataaggagttctatctgtttccaacagtgtttgatgaaaatgagtcactgttgctggaagacaatattcggatgtttacaactgcccctgaccaagtggataaagaggatgaggactttcaggagagcaacaagatgcatagcatgaacggcttcatgtacgggaatcaacctggactcaccatgtgcaagggtgattccgtagtctggtatctgtttagtgcaggcaacgaggccgacgtgcatgggatttacttttcaggcaatacatacctgtggagaggcgaacgcagagacactgcgaatctcttccctcaaaccagcctgacgctccacatgtggcccgacacagaaggcacatttaacgttgaatgtcttacaactgaccattacaccggcggaatgaagcagaagtacactgttaaccagtgcaggcgacaaagtgaagattccaccttctacctgggggaacgtacttattatattgccgcagtggaggttgagtgggattacagtccacagcgcgagtgggagaaagagttgcaccacttacaggaacaaaatgtgagtaatgcattcttggataaaggggagttttacatcggatctaagtacaagaaagtcgtctaccgccagtataccgactctacttttagagtcccagtggaaagaaaagccgaagaggaacacctcggcatcctagggcctcagctgcacgccgatgtgggcgacaaggtgaagattatatttaaaaacatggctactcgcccttattctattcacgcacacggtgtacagacggaatctagcacagtgacaccaactcttccgggagaaaccctgacttacgtctggaagatacccgaacgatcaggggctggcaccgaagacagtgcatgcataccatgggcttactacagtacagtggatcaggtgaaggacctctattcgggcttgatcggccctttgatagtctgtcgcaggccttatctcaaagtattcaacccaagaaggaaactggaatttgctctgttattcctcgtgttcgatgagaatgaatcctggtaccttgacgacaatattaagacatattcagatcatccagaaaaagtcaataaagacgatgaagagttcattgagtctaataaaatgcacgcaattaatggccgaatgttcgggaaccttcaggggctgactatgcacgttggcgatgaggttaattggtacttgatgggtatgggcaatgagatcgacctccatacggttcattttcatggacactccttccagtacaagcaccgcggagtttattcatcagatgtgttcgacatctttccaggcacctaccagaccttggagatgttccccagaacgcctggtatttggctgctgcattgccacgtgactgatcacatccatgccggtatggagaccacatataccgtgctccagaatgaggacaccaagagcggatag

SEQ ID NO: 4276 - DNA, 603 bp, Artificial Sequence
  Description of Artificial Sequence: Synthetic coding sequence
atggctttcactgagcattcaccacttaccccacaccgacgagacctgtgttctagaagtatctggctagcaaggaagataagaagtgatctcacggccctgaccgaatcttacgttaagcatcagggcctgaacaagaatatcaatttggactctgcagacggcatgcctgtggcatctacggaccagtggtcagagctgacagaagccgagcggctccaggaaaacctccaagcgtacagaacgtttcacgttttgctggcacgactgttggaggatcagcaggttcatttcaccccaacagagggagatttccaccaggcaattcatactctcctgctgcaggtggcggcttttgcttaccagattgaggaacttatgatccttctcgaatacaaaatacccaggaacgaagcagatggaatgccgattaatgtaggcgatggaggacttttcgagaagaaactgtgggggctcaaggtgctccaggagctgagccagtggactgtgcgttccatccatgatctgcgtttcatctccagtcaccagaccgggatccccgctcgcggttcacactacattgccaacaacaaaaagatgtag

SEQ ID NO: 4277 - DNA, 1869 bp, Artificial Sequence
  Description of Artificial Sequence: Synthetic coding sequence
atggcccatgtgcggggactgcagttacccggatgcctggccctggcggctttgtgcagcctggttcattcacagcatgtgttcctggctcctcagcaagcaaggtccctcctgcaacgggtccgtcgcgcaaacacctttttggaggaggttcgtaaaggcaatctggagcgcgaatgtgtggaggagacatgctcttacgaggaagcatttgaggccctcgaaagcagcaccgccactgatgtcttttgggccaaatataccgcctgcgagacagcgagaaccccccgagacaagcttgcggcttgtctggaggggaactgtgccgaaggcctgggcacaaattataggggccacgtcaacatcacccgaagtggaatagaatgccagctttggcgcagccgataccctcataaacctgaaatcaattctaccacccacccaggtgctgaccttcaggagaatttctgtcggaatcccgattcgtccaccaccggaccttggtgctatacaacggacccaactgtgcgcaggcaggagtgctcaatacccgtgtgtgggcaggaccaggttaccgtggctatgactcctcgctctgaaggctcttccgtcaatctctcccccccactggagcagtgcgtgccagatcgaggccaacagtaccagggcaggctggccgtaacaacccacggcctgccctgtctggcctgggctagcgcacaggcaaaagccctttcaaaacaccaagattttaattcagcagtccagctggtagaaaatttctgtagaaaccctgacggcgacgaggagggagtctggtgctatgtcgcgggtaagcctggggacttcggttattgcgacttaaactattgcgaagaggctgtggaagaagaaacaggtgatggcctagacgaggacagcgatcgagccattgaggggaggacagcaaccagcgagtaccagaccttcttcaacccccgaaccttcggctcgggagaagcagattgcggcctgaggcccctcttcgagaagaaatcccttgaggataagaccgagcgcgagctgctcgagtcgtatattgatggtagaattgtggaggggagcgatgcagaaatcggcatgtcgccatggcaggtcatgttattcagaaaatcaccacaggagctcctctgtggagcgagcctaatttcagatagatgggtactgacagcggctcactgcttgctttacccaccttgggacaaaaactttacagagaacgaccttctcgtgagaatcggtaagcactcccggacccggtacgagcgaaatatcgagaaaatctctatgctagaaaagatatatattcaccctcggtataactggagggagaacctcgaccgggacatcgcccttatgaagttaaagaagcccgtcgcctttagcgactatatccacccggtgtgtctaccagaccgcgaaaccgccgcttctctattgcaggctgggtacaagggcagggtgacaggctgggggaatcttaaggaaacttggacagccaacgtgggtaaaggtcagccgagtgtgctccaggtagtgaatctgcctatcgtagaacgcccagtgtgcaaggattctacccgaattcggattacagataacatgttctgtgctggctataaacccgacgaaggaaaacgtggtgatgcatgcgagggcgactccgggggacctttcgtgatgaagtcaccttttaacaacaggtggtatcagatgggcatcgtcagctggggagaggggtgcgaccgcgatggcaagtacgggttctacacacatgtattcagactgaaaaagtggattcagaaggtcattgatcagttcggagaatag

SEQ ID NO: 4278 - DNA, 195 bp, Artificial Sequence
  Description of Artificial Sequence: Synthetic coding sequence
ctccaaggagagttccttcctcagccacggcaacagcaccacgggacgcttgtcctgcattaccgccctcacagagaagaagctggcatgcaacatccgtgtttgtggcctggctcctcccattgtagcgatgactcaactctgcgacgcctccaatgcgaaagcgtcacttcaatcggggctgtatgcccatag

SEQ ID NO: 4279 - DNA, 1752 bp, Artificial Sequence
  Description of Artificial Sequence: Synthetic coding sequence
atggcacacgtgcggggactgcagctccccggatgcctggcattagcagcactctgtagcctggtgcacagccaacacgtgttcctcgcaccccaacaggccagatccctgctgcagcgagtgcgcagagccaatacattcctggaagaggtcaggaagggcaatttagagagggagtgcgtggaagaaacctgcagctatgaggaagcatttgaggcactggagagcagtaccgctaccgatgtgttctgggccaagtacacggcttgtgagaccgcgaggacaccacgagacaagttggctgcctgcctggagggtaactgcgcagagggcctgggtactaactaccgaggtcacgtgaacataacccggtctggcattgagtgtcaactgtggcgctctagatacccccacaagccagaaataaacagtaccacacatcccggagcagacctgcaggaaaacttttgccgcaaccctgactcttcaactacggggccttggtgttatactacagaccccacagtccgcagacaggagtgctctatacctgtctgcgggcaggatcaggtgaccgtcgcaatgaccccgcgaagtgaggggtccagtgtaaacctgtcccctcccctggaacagtgtgtgccagatcgcggacaacagtaccaaggtagactagccgtgaccacacatggactgccctgtttggcttgggcatctgcccaggcgaaggccttgtccaaacatcaagactttaatagcgctgttcagttagtagagaacttctgtaggaaccccgacggtgacgaggaaggggtttggtgttacgttgccggaaaaccaggcgactttgggtactgcgacctgaattactgcgaggaggctgttgaggaggaaaccggggatggccttgacgaggactccgatagggccatcgagggacgcaccgccacctccgaatatcagaccttctttaatcccaggactttcggatccggggaggcagattgcggtcttcgcccactgttcgaaaaaaaaagtttggaagacaagaccgaacgcgagttgctggagtcctacatagacgggaggatcgtagagggctccgatgcagaaattggcatgtctccttggcaggtgatgcttttccgtaagtcaccccaggaacttctttgtggtgcctccctgatttctgaccgctgggttctgaccgcagcacattgcctgttgtaccctccttgggacaaaaacttcacggaaaacgatctgctggtgaggatcggcaaacactctagaacccggtatgagagaaacattgagaagatctctatgttagaaaagatttatattcacccgagtctactgcaagccggatataagggaagggttactggctgggggaacctgaaggagacttggacagcaaacgtgggcaaaggccagccatccgtactgcaggtagtgaacctgcctatcgttgaaagacccgtctgcaaggactcgacccgtattcgaattactgacaacatgttttgcgcagggtataaacctgacgaaggcaagcgcggtgatgcctgcgagggtgattccggagggccattcgttatgaagtctccttttaacaaccgctggtaccaaatggggatcgtgagttggggtgaagggtgtgatcgggacggaaaatatgggttttatacgcatgtctttcgcctgaaaaaatggattcagaaggtcatagatcagttcggagagtag

SEQ ID NO: 4280 - DNA, 888 bp, Artificial Sequence
  Description of Artificial Sequence: Synthetic coding sequence
atggaaaccccagcttggcctcgcgtgcccaggccagagaccgctgtagccaggacattgctgctgggatgggtgtttgctcaggtagctggtgcatctggaaccacaaatactgtcgctgcatacaacctcacttggaagagtaccaacttcaagacaattcttgaatgggagcccaaacccgtgaatcaggtgtataccgtccagatctctactaagagcggagattggaagtccaaatgcttttacacgacggacacagaatgcgatctgaccgacgaaatcgtgaaggacgtgaagcaaacatatttggcacgggtattctcataccccgcaggaaatgtggaaagcaccggctccgccggtgaacctctgtacgagaattcacccgagttcaccccctacctggaaactaaccttgggcaaccaacgatccagtccttcgaacaggtgggcaccaaagtgaatgtcactgtcgaagatgaacggaccttagtaagacggaataataccttcctgagcttacgcgatgtatttggtaaagaccttatttatacattgtattactggaagtcttcgtcttccggaaaaaagaccgccaaaaccaacaccaacgaatttctgatcgatgtagacaaaggcgagaactactgttttagcgtgcaagccgtgatcccaagcaggacagtgaatcggaagagcacggacagtccagtggagtgtatgggacaggagaaaggagagtttcgagagattttctacattattggcgctgttgtctttgtggtcatcattcttgtgatcatccttgctatcagtctccacaagtgcaggaaagccggagtgggacaatcgtggaaagagaatagtccattgaatgtctcttag

SEQ ID NO: 4281 - DNA, 717 bp, Artificial Sequence
  Description of Artificial Sequence: Synthetic coding sequence
atggaaacccccgcttggccaagggtgcctaggcctgagactgctgttgcaagaacccttctcctcggctgggttttcgctcaggtggccggtgccagcggcactaccaacactgtggccgcttacaacctgacttggaagagcactaattttaagacaattctggagtgggagccgaagccggtgaaccaggtttatactgtccaaatctctactaagagtggagactggaaaagtaagtgtttttataccaccgatactgaatgcgatctgaccgacgagatcgtgaaggacgtcaagcaaacctatttagcaagagtgttctcgtacccagcaggtaacgtagaaagcactggctctgctggtgaacctttatatgagaacagccctgagttcaccccctacctggaaacaaacctgggtcaacctacaatccaatcgtttgaacaggtgggaaccaaagtgaatgtcaccgtggaagacgaaagaacattggtgagacgaaacaacacttttttatctctcagggacgtgttcggaaaagacctaatctatacgttatactactggaagtctagtagctctggcaagaagtatagcaccagcctcgaactgtggtatctatggagtagctctttatcaagcagctggctttacctgtacaccagcgtggaacgacaggagtggggcagagcagggagaagaacacctcattag

SEQ ID NO: 4282 - DNA, 3807 bp, Artificial Sequence
  Description of Artificial Sequence: Synthetic coding sequence
atgatcgctgcccctgagatcccaactgatttcaacctgctccaagagtccgaaacccactttagctccgacactgactttgaagatattgaggggaaaaatcagaaacaaggaaaaggcaagacctgcaagaaaggaaaaaaaggccctgcggaaaagggaaaagggggtaatggtggtgggaagcctcccagtggtcctaatcggatgaatggacaccaccaacagaatggtgtagaaaatatgatgctatttgaggttgtgaaaatgggtaagagtgctatgcagtctgtggttgatgactggatcgaatcctataaacacgatagagatatcgcccttctggatctgattaatttcttcattcaatgttctggttgtaaaggcgtggtaaccgccgagatgttccgtcatatgcagaattccgagatcattaggaagatgacagaggaatttgatgaggacagtggcgactaccctctaactatggccggacctcaatggaaaaaatttaaaagctcgttttgcgaattcattggcgtgctcgtaaggcagtgccagtacagcatcatttatgacgagtacatgatggataccgtgatatccttactgacagggttgagcgactcacaagtcagggcctttcggcatacatctacgctggccgcaatgaaactcatgacggccttggtgaacgtggcactaaacttgtcgatcaacatggataacacccagagacagtatgaggctgagcgcaacaaaatgatcggaaaaagagccaacgaacgactggagctgttgcttcagaagcgcaaggaactgcaagaaaatcaggatgaaatcgagaacatgatgaatgcgatctttaagggcgtttttgttcaccgctaccgggacgccatcgccgaaattcgagccatctgcatcgaggagattggaatctggatgaagatgtacagtgacgccttcttaaacgactcttatctgaagtacgtaggctggacaatgcacgacaagcagggagaagtgcgactgaaatgccttaccgcgctgcagggcctctactataacaaagagctgaactccaagctcgagctatttaccagtaggttcaaagaccggatcgtgtctatgactttggacaaggagtacgacgttgcggtgcaggctattaagctcctcactctcgtgctgcagagcagcgaggaagtgctaacagccgaggactgcgaaaatgtgtatcacctggtgtactcagcacacaggcctgtagccgttgcggctggtgagttcctgtataaaaaactgttttctcgcagggatcctgaggaggacggaatgatgaagcgcagaggccgacaaggcccaaacgcaaacctagtgaaaacactcgtatttttctttctcgagtctgagttgcacgaacatgccgcatatcttgtggatagcatgtgggactgcgcaaccgagttactgaaggattgggagtgcatgaacagtctactcctggaggaacccttgtcaggcgaggaagcactcaccgaccgacaggaatccgctctaatcgaaatcatgctttgcacaatacggcaggcagccgaatgccaccccccagtgggtagaggaacagggaagagggtgcttacagcaaaagaaaagaagacgcagctcgatgacagaaccaaaattaccgagctattcgcagttgcactgccccagctgctggctaagtacagcgttgatgccgagaaagtgacaaacctcctgcagcttccccagtacttcgatcttgagatttatactaccggaaggctggaaaagcacctggacgccttactgagacagatcaggaatatcgtagaaaagcatacagatactgatgtattggaggcttgttcgaaaacttaccatgctctgtgtaatgaggaattcacgatattcaatcgtgtggatattagcagatctcagctcattgacgagctcgccgacaagttcaatagactgcttgaggatttccttcaggagggcgaggaacccgacgaggacgacgcttaccaggttctcagcacccttaagaggatcaccgccttccacaacgcccatgacctcagcaagtgggacttgttcgcatgcaattacaagctgctgaagaccggaatcgagaatggggatatgcccgaacaaatcgttatacacgctctccagtgcactcattatgtgatcctgtggcagctggctaaaattaccgaaagtagctcgacaaaggaagatctcctgcggttgaagaaacaaatgagggtcttctgccaaatatgccagcactatttgaccaatgtgaacacaacagtgaaagagcaagcctttacgattctgtgcgacatccttatgatattctcccatcagatcatgagtggcggacgcgatatgcttgagcctttagtatacacacccgacagctcgctccagagcgaactcttatcttttattctcgatcacgtctttattgaacaggacgacgataacaactctgcggacgggcagcaggaggacgaagccagcaagattgaagccttgcacaagagacgcaacttattggcagctttctgcaaactgatcgtgtacactgtggtggaaatgaacactgcagccgacatcttcaaacagtacatgaagtactataatgattacggtgacattattaaagagaccatgtctaaaaccaggcaaatcgacaagatccaatgtgcgaagacactgatcttgtctttacagcaattattcaatgagatgatccaggaaaacgggtataactttgatcggtcctcatctaccttctcgggcattaaggaactggctcgaaggtttgctctcacttttggacttgaccagctgaaaacacgcgaagccatcgccatgctgcacaaggatggcattgaattcgccttcaaggagccaaatccccagggagaatcccatcctcctcttaaccttgccttcctggatatcttgtccgaattttcctccaagttattacgtcaggataagaggaccgtgtatgtatacctggagaagttcatgacttttcagatgtctctgcgccgtgaggacgtgtggcttccacttatgagctaccgaaactcactcctcgcaggtggcgacgacgatactatgagcgtgataagtggtatcagttctagagggtcaaccgttaggtccaagaagagtaagccgtccactggaaaaagaaaggtggtcgaaggcatgcagttgagcttgacagaagagtcatcttcatctgattccatgtggttaagccgtgaacagactctgcacacccctgtgatgatgcaaacacctcagctcacttcaaccattatgcgagaaccaaagagattgagacctgaggatagcttcatgtccgtataccccatgcagacagagcaccaccagactcctttagattacaatacccaagttacttggatgctggctcagaggcaacaggaggaggctcgacagcagcaggagcgtgcggcaatgagttacgtaaagctgaggaccaacctgcagcatgccatcagacggggaacctccctgatggaagacgatgaggaacccatcgtggaagacgtaatgatgtcttctgagggaaggattgaagatctgaacgaaggtatggactttgataccatggacatagacctgccaccatcaaagaaccgcagagaaagaaccgagttgaagcctgactttttcgatcccgcatccattatggacgaaagcgtattaggcgtatcaatgttttag

SEQ ID NO: 4283 - DNA, 1272 bp, Artificial Sequence
  Description of Artificial Sequence: Synthetic coding sequence
atgcagagggtcaacatgattatggccgagtctcctggcctaataacaatctgcctgctgggatatctcctgtcggccgaatgtaccgtcttccttgaccacgaaaatgcgaacaagattctcaatcgtcctaaaagatataattctggtaagctggaggaatttgtgcagggaaatctggaaagagagtgcatggaggaaaaatgcagctttgaagaggctcgagaggtgttcgaaaacacagagagaaccaccgaattttggaagcagtacgtggacgtgacttgcaacataaagaatggtcggtgtgagcagttctgcaagaatagtgcggacaataaagtagtgtgttcctgcaccgagggctacaggctagcagaaaaccagaaatcttgtgaacctgctgtgcccttcccatgcggaagagtaagcgtcagccaaactagtaagctcacacgggcagagactgtgttccctgatgtcgactatgttaatagtacggaagcagaaacaatcctggacaatatcactcagtctactcagtctttcaacgacttcacccgggtggtcggcggagaggatgcaaagcccggacagtttccctggcaagtcgtgctgaacggtaaagtagacgccttctgtggcggtagcatagtcaacgagaagtggatcgtgacagccgctcattgtgtggagaccggcgtcaagattactgtcgtagcaggtgagcataacattgaagagacagagcacacggagcagaaacgtaatgttatccggataattccccatcataattacaatgccgcaataaacaagtataaccatgacattgctttactggagctcgacgagcctctcgtccttaactcttatgtgaccccaatatgcatagctgataaagaatacaccaacatctttctgaaatttggtagcggctatgtgagtggatgggggcgagttttccataaagggaggagcgccctcgttctccagtacttacgggttccccttgtggatagggccacctgtctccgatcaaccaaattcaccatctataataatatgttttgcgcagggttccacgaagggggacgggatagttgtcagggtgattccggtggcccacacgtgaccgaagtggagggaacaagtttccttaccgggattatatcatggggggaagaatgcgctatgaaaggcaagtacggcatttacaccaaagtcagccgatatgtaaactggatcaaggagaaaacgaaacttacgtag

SEQ ID NO: 4284 - DNA, 6689 bp, Artificial Sequence
  Description of Artificial Sequence: Synthetic coding sequence
atgttccctgggtgtcctaggttgtgggtgctggtcgtgctcggcacttcatgggtgggatgggggtcccaaggcacagaagccgctcaactacggcaattttacgtggccgcacagggcatctcctggtcgtaccgacctgagccaacaaatagctccttgaatttgagcgtaactagctttaaaaagattgtgtatagagagtatgagccttatttcaaaaaagagaagcctcagtccactattagcggactgctcggaccgactttgtatgctgaggtcggcgatatcattaaagtgcattttaagaacaaggcagacaaacccctgagtattcacccccaaggtatccgatactcaaagctcagcgagggagcgagttatctggaccacacattccccgcagagaagatggacgatgctgtggcgccaggtcgggagtacacttatgaatggtcaatcagtgaggacagcgggccaactcatgatgatcctccctgcctcacccacatctactacagtcacgagaacctcatagaagactttaacagtggcctgattggccctctgctcatctgcaaaaagggtaccttaaccgaagggggtacccagaagactttcgataagcaaatagtcttgctcttcgctgtctttgatgaatctaagtcctggagtcagagcagttccctgatgtatacagtgaatggatatgtcaatgggaccatgcctgatataacagtgtgtgctcatgatcacatctcatggcaccttctagggatgagtagcggcccagaactgttcagtattcatttcaacggacaggtcttagagcagaatcaccataaggtgagtgctatcaccctcgtatccgcaactagcaccacggcaaatatgacagtgggtcccgaaggaaagtggataatcagtagtctgacacctaagcatcttcaggctggtatgcaggcttacatagacatcaagaactgccccaagaagacacggaatcttaaaaagattaccagagagcagagacgtcatatgaagcggtgggagtattttatagccgctgaagaagtcatctgggattatgcccctgtgattcccgctaatatggacaagaaatatcgatcccaacacctggacaatttttctaatcagatcgggaagcactacaagaaagtcatgtacactcaatatgaggacgagtcattcaccaaacatactgtgaatccgaacatgaaggaagacgggatcttggggccaattattagagcccaggtccgggacacgctgaaaattgtcttcaagaatatggcctctagaccgtacagcatttaccctcacggagtcaccttctccccttatgaagatgaggtgaactctagttttacctcaggcaggaacaataccatgatacgtgccgttcaaccaggagagacttacacgtacaagtggaacattcttgagtttgatgaaccaaccgagaacgatgcgcaatgccttacgaggccctactactccgacgtggatattatgagagatatcgcgtcagggctgatcggactgctcctcatttgtaaatctaggtcacttgaccggcaaggcattcaacgagccgcagatattgagcagcaggctgtttttgccgtcttcgacgagaataaatcctggtacctggaggacaacatcaacaagttctgcgaaaatcccgacgaggtgaagcgggatgatccgaaattctacgagtcaaacattatgagcaattttacattatcagctatcaacggctatgtgcccgaaagtattacaactctggggttctgtttcgatgacaccgtgcagtggcatttctgttctgtgggtacacagaatgagattctgaccattcacttcaccggacattccttcatctacgggaagagacatgaggatactcttacactgttccctatgagaggcgagagcgtgaccgtgaccatggacaatgtgggtacttggatgctcaccagcatgaactcatcacctcgaagcaaaaaattacgccttaaattcagggacgtgaagtgtatccccgacgatgacgaggattcatatgagatttttgagccaccggagagcaccgttatggcaacccgcaagatgcacgatcgactcgagcctgaggacgaagagtcggatgcagattacgattatcaaaatcggttggcagctgcacttgggatcagatcattccgaaattcttctctgaatcaggaggaggaagaattcaatctaacagccctggctctggagaatggcacggaatttgttagttccaacaccgacattatcgtgggctctaattactcctcaccttccaacatctccaaattcacggtcaataacctagctgaaccccagaaagctcctagccatcagcaggccactacagctggctcaccccttcgccatttgatcgggaaaaacagcgtgctcaactcatcaacagccgagcactcctctccctatagcgaggatcctatcgaagacccactgcagcccgatgtgacgggtattcggctgttgagtcttggcgcaggggagttcaaaagccaagaacatgctaagcacaaggggcctaaggttgagagggaccaggccgctaaacacagattcagctggatgaaattacttgcccacaaggtcggcaggcatctgtcacaggatacagggagccctagcggaatgagaccctgggaagatctgccttcacaggacacgggctcaccatcgcggatgaggccttggaaggacccaccctcagacttgctgttactgaaacagagcaactcctcaaagattctcgtcggtaggtggcacttggccagtgagaaaggatcatacgagattatccaggacacagatgaagataccgctgtgaacaattggctgatttctccacaaaacgcttctagggcttggggagagtccaccccactcgcgaataaaccagggaagcagtcaggtcaccccaagttcccacgcgtgcgacacaagagtttacaggtgcggcaggatggtggaaaatcccgtttaaaaaagagtcaattccttatcaagacccgcaaaaagaaaaaggagaagcatactcatcatgcgcctctgtcacccagaaccttccatccacttagatccgaggcttataacactttttcagaaagacgcttgaaacactcgctcgtcttgcacaagagcaacgaaacttcgctcccaaccgatcttaatcagactctgccatccatggactttggctggattgcttccttgcctgaccataatcaaaacagcagtaatgacactggccaggcgtcctgccctccaggcctttatcagaccgtgccacctgaagaacactaccaaaccttccctattcaagaccccgatcagatgcattctacatccgatccatcccatagatcatcatcacccgaactatccgagatgttggaatacgatcgctctcacaagtcattcccgaccgatatctcgcagatgtccccgagctccgaacacgaagtctggcagactgtcatctccccggacctgtcccaagttacattgagccctgagctgtctcagaccaatctgtccccagatctgagccataccacactcagccccgaacttatacaacggaacctctcacccgctcttgggcagatgcctatctctccggatctctcccatactacccttagtccagacctttctcatactaccttgtcccttgacctcagccagacaaatctgagtcccgagctctcccaaaccaatctctctcctgcgttaggacagatgcctctgtcgccagacctgagccatacaaccttgtctctggattttagccagacaaaccttagccctgagctttctcatatgacgctgtccccagagctgtcccagactaatctgtcccctgccctggggcagatgcccatttctcccgacttatctcatacgacgctgtctttggactttagccagaccaacctcagccctgagctgtcccagaccaacctaagtccagccctcggacagatgccactttccccagaccccagccataccacattgtccttggacctatcacaaaccaatttgtcgccagaattgtcccagaccaacctgagtccggacttgagcgagatgcctctcttcgccgatttgtcccagattcccctgaccccggacctggatcagatgacactctcccctgacctcggagagacagatttgtcaccaaattttggccaaatgtctctatcaccagatctcagccaggtaactctgagccccgatatctctgacactaccttgctgcctgacctgtctcagatctcacctccacctgacctcgaccagatcttttacccaagcgaatctagccaatcacttctgctgcaggaattcaacgagagttttccctatcccgatcttgggcaaatgccaagtccaagcagccccacacttaacgacaccttcctctccaaggaatttaatccactggtgatcgttggtctgtcaaaagacggcaccgattacatcgagattatcccaaaggaagaagttcaaagcagtgaggacgactatgccgaaatcgattacgtgccttacgatgatccatataagacagacgtgaggaccaatatcaacagctcacgggatccggacaacatagcggcatggtacttgcgctctaataatggtaatcgcaggaattattatatagcagcagaggagatttcatgggactattccgaatttgtgcaaagggagacggatatcgaagacagtgatgatattcccgaggataccacttataagaaagtcgttttcaggaagtacttagactctacatttacaaagcgcgaccctcggggagagtacgaagagcatctggggattctgggaccaatcattagagctgaggtagacgacgtgatacaggtgcgtttcaagaatctcgcatccagaccgtacagcctgcacgctcacggactgtcctacgaaaaatcaagcgagggcaagacatacgaggatgactctccggaatggtttaaggaggacaacgcggtccaacccaactcatcctacacctacgtatggcatgccaccgagcggagcgggccagagtcccctgggtcagcatgccgcgcttgggcatactacagcgccgtgaaccccgaaaaagacattcacagtgggcttatcggtcccctgctgatctgtcagaaggggattcttcataaagactctaacatgcctatggatatgagagaattcgtgcttctgttcatgaccttcgatgagaagaagtcctggtattatgaaaagaaatcacgctcaagttggcggctgacctctagcgagatgaaaaaatcacacgagtttcatgctattaacggcatgatctacagtctccccggattgaaaatgtacgagcaggaatgggttagactacatttactgaatatcggtggcagtcaggatatccatgtggttcattttcatggacagacccttctcgagaacggtaacaagcagcaccagttgggtgtctggcctttgctgccaggaagcttcaagactctcgagatgaaggcatcaaaacccggatggtggctgcttaatacagaagttggtgagaaccagcgcgctggaatgcagacccctttcctaattatggacagggattgcagaatgcctatgggactatccacgggcataatttcagacagccaaattaaagcttccgagttcttggggtactgggaacccagactggcacggctgaataatgggggttcatacaacgcctggagtgtggagaaactggccgctgagttcgcttcaaaaccatggattcaggtggatatgcagaaggaagttatcatcaccggtatacagacacaaggggctaaacattacctcaaaagttgttatacaacagaattttacgtcgcatattcctccaaccagattaattggcagattttcaaaggaaactcaaccagaaacgtcatgtattttaacggaaactccgacgcctctaccatcaaagagaaccagtttgatcccccaattgttgctcgatatattagaattagccctacgagggcttataacaggcccaccctgaggttggaactgcagggctgcgaagtcaacggatgcagtacacccctagggatggaaaatggcaaaatagagaataaacaaatcacggccagctctttcaaaaagagctggtggggggactattgggagccatttagggctcggctcaatgcacaaggcagggtcaatgcctggcaggccaaggcaaataacaacaaacagtggctcgagatcgacttgctcaagatcaagaaaatcacagccattataactcagggctgcaaatcactttcatcagaaatgtatgtaaaatcatacaccatacactactcagagcagggggtcgagtggaagccataccgcttaaagtcctctatggtagacaaaattttcgaaggaaacacaaatacgaaggggcatgtaaaaaacttttttaacccccctattatctctcgatttatcagggtgatcccgaaaacatggaatcagagcatcgctcttaggctggagctattcgggtgtgatatttacta

SEQ ID NO: 4285 - DNA, 6674 bp, Artificial Sequence
  Description of Artificial Sequence: Synthetic coding sequence
atgttccctggctgtccaagactctgggtcttggtagtcttgggtaccagctgggtaggatgggggagccaaggcaccgaggcggctcaacttcgtcaattttatgtggcagcacagggaatatcttggtcctaccgcccagagccaacaaactcctccctgaacctttccgtcaccagtttcaagaagatcgtgtacagggaatatgagccttacttcaaaaaagagaaaccacagtctaccataagcggactgcttggtcccacactgtacgccgaggtgggagatattatcaaggtgcacttcaagaacaaggctgataagccgctgtccatacacccacaagggatccgatattccaaattgagcgagggggcatcttaccttgatcacactttcccggctgagaagatggatgatgccgtggcacctgggagagaatacacgtacgaatggtctatttccgaggattccggaccaactcacgacgatcctccttgcctgacacacatctactactcacatgaaaacctgatcgaggatttcaattcaggactgatcggaccacttttgatatgtaagaagggtacactgacggaagggggaacacagaagaccttcgataagcaaattgtgttactcttcgccgtgttcgatgaatctaaaagttggtcacagtccagctctcttatgtatactgttaatggttacgtaaatggcaccatgcctgatattacagtatgtgcccacgatcatatcagctggcacctgctcggtatgtcctccggacccgaactgttttccatacatttcaacggccaggtcttggagcagaaccaccataaggtttccgccatcactctcgtcagcgcaacaagcaccacagcaaatatgacggtgggcccagagggtaagtggataattagcagcctgacccccaagcacttgcaggccggaatgcaggcctacatcgatatcaagaactgccccaagaagacccgcaatctcaagaagatcactcgggagcagcgtagacacatgaagcgatgggaatactttattgcagccgaggaggttatctgggactacgcccctgtgatccccgctaacatggataagaagtacagatcacaacacctcgataatttctcaaatcagatcggaaagcattacaagaaggtgatgtatacccagtatgaagacgagtccttcaccaagcataccgtaaatccaaatatgaaagaagacgggattctcggccctattatcagagcccaggtgcgagacactctgaagattgtgtttaagaacatggcatccaggccttattccatctatccacacggcgtgaccttttccccatatgaagatgaagtcaactccagcttcactagcggcagaaacaatacgatgattcgagctgtacagcccggtgagacctacacatataaatggaacattctcgaatttgatgagcctaccgaaaacgatgctcagtgtctcacgaggccatattacagtgacgtggatattatgcgcgacatagcaagcggcttgataggattacttctgatttgtaaaagcagatccttagatcggcaggggatccaaagggcagcagacattgaacagcaggcggtctttgccgtcttcgatgagaataaatcttggtaccttgaagacaatatcaacaaattctgcgagaacccggatgaggtgaaacgagacgatccaaaattttacgagtcaaatatcatgagcaccataaatggctatgtcccagagtccattactacactggggttttgttttgatgacacagtgcagtggcatttctgctctgtgggcacccagaacgagatcttgaccattcacttcactggacattcattcatctacggtaagagacatgaggacactctcaccctgtttcctatgcggggtgagtctgtaacagtgaccatggacaacgtgggtacctggatgctgacctccatgaatagcagtcccagatccaagaagctgcgccttaaatttcgtgatgtgaaatgcattccggatgatgacgaggactcctacgaaatattcgagccaccggaaagcaccgtaatggccactagaaaaatgcatgataggctggaaccagaagacgaagaatcagatgcggactatgactatcagaacaggctcgctgccgctctgggaataaggagctttaggaactcttcattgaaccaggaggaggaagaattcaatctgacagccctcgccctggagaatggcacggagtttgtttcctcaaatactgacatcatagtcggcagcaactatagcagcccgagcaacatctcaaagtttacagtcaataatttggctgagcctcaaaaggccccttcacaccagcaagccacaacggccggaagccctttgcgccacctcataggaaagaactctgtgttgaactcttcaaccgctgagcattcttctccatacagtgaggatccgatcgaagatcccctgcagcccgacgttaccggaatacggttactgtctcttggcgcaggagaatttaaaagtcaagaacacgcaaaacataaaggtcccaaagtggagagggatcaggcagccaaacacagattcagttggatgaaactcctggcccataaggtcggtaggcacttatcacaggatactggctctccaagcggtatgaggccctgggaggatctaccaagccaggatacaggatcgccatcacgcatgcgaccctggaaggaccccccttcagaccttctgctgctgaaacagtccaattcctctaaaattctcgtcggcagatggcacctagcctcggaaaaagggtcctacgaaattatccaggacacagatgaagatacagcagtcaacaactggctcatcagtccccagaacgcgagtcgggcatggggggagagtacgcccctagccaataagccagggaagcagtccggtcacccaaagtttccccgagttcggcataagtccctccaagtacgtcaagacggtgggaagtctaggcttaagaagtcacagttcttgatcaagactaggaagaagaaaaaagagaagcacacacatcacgcaccattaagccccaggacgtttcaccccctcagaagcgaggcttacaacaccttctccgagcgcagactgaaacactccctggtgctccataagagtaacgaaacctcattacccacagatctgaatcagaccctcccttccatggacttcgggtggattgcttcattaccagatcacaaccagaacagttcaaacgatacaggtcaggcctcctgccctccaggtctctatcagacggtcccacctgaagagcactaccagaccttccccatccaagaccctgaccaaatgcatagcacctctgacccctctcatcggtcatctagcccagagttgtccgagatgctcgaatatgacagatcccataaaagcttccccactgatatttctcaaatgagcccgagtagcgagcacgaggtctggcagacagtgatcagtcctgatctcagccaggtgactctttcaccggaactgtcccaaacaaatttgtcacctgatttgagccacactaccctgtcaccggagctcatccagcgcaacctatcccctgctctgggacaaatgcccatttctccagacctgtcgcatactacactgtccccagacctgagtcatactactctgtctctcgatctttctcagacaaatctttcgcccgaactctcgcagaccaacctttcgcccgcattgggacagatgcccctgtcccccgatctgtcccacacgacgctgtctctggattttagtcagacgaatctgagtccagagctgagtcacatgacactttctccagagctctcacagacaaatcttagtcccgctttaggacagatgcctatcagccctgaccttagccacaccaccctttccttggatttctcacagaccaacctcagccctgaattgtcccagaccaatctgtctcccgcactgggtcagatgcccctgagcccagatccaagtcatactaccttgtctttggacctgagccaaacaaacctttctccggagctgagccagaccaatttaagccccgaccttagcgagatgcccttattcgccgacctgtcgcaaatcccccttacccctgacctggatcagatgaccttgtcccctgatctgggggagactgacctctcccccaattttggccagatgagtctcagcccagatctcagccaagtcacattatcgccggacataagtgatactacactgctcccagacctctcccaaatctcccctccccctgacctggaccagatcttctacccctccgagagttctcagagcttgctactccaagaattcaacgaatctttcccctatcctgacttaggacagatgcctagtccatcaagccccaccttgaatgatacatttctgtccaaggagtttaatcccctcgtgattgttgggctgagtaaggacggaactgactatatcgagattatacctaaagaagaggtgcagtctagcgaagatgattacgcggagattgactatgtgccttacgatgacccctacaagacagatgtgaggaccaatatcaactcttcaagagatccagataatattgccgcttggtacttgcggagtaacaacggtaaccggaggaattattatatagcagcagaggaaatcagctgggactattccgaattcgtccagcgtgagacagatattgaggattctgacgacatccccgaggatactacctacaagaaagtggtctttagaaaatacctcgattctacctttactaagagggatcctaggggcgagtatgaagaacatctaggcattctgggccctatcatacgagccgaagtggacgatgtcattcaggtgcgttttaaaaatctggcatcacgaccttactctctccatgctcatggactatcctatgagaaaagcagcgagggcaagacctacgaggacgacagtccggagtggttcaaggaggataacgcagtgcagcccaatagctcctatacttatgtctggcatgctacggaaagatccggaccagagtctcccggttccgcctgtcgagcatgggcctactattctgccgttaacccagagaaggatatccactccgggctgatcgggccattgcttatctgccaaaagggtatcttgcacaaggatagtaacatgcccatggacatgcgcgaattcgtattattatttatgacctttgacgagaagaagtcatggtactacgagaaaaaaagtcgaagcagctggagactgaccagctccgaaatgaagaagtcccacgagtttcacgctatcaacggcatgatctactcattgccaggtctaaagatgtacgaacaggagtgggtccgcctgcacttactgaacattggaggatcgcaggacatacacgtggtgcacttccatggccagacgctgctggagaatggcaacaagcagcatcaactgggcgtgtggcctttgcttcctggatccttcaagactctggagatgaaagcaagcaaacctggatggtggttgctgaatacggaggtgggagagaaccaacgagccggaatgcagactcctttcctgataatggaccgggattgtcggatgcccatgggtctaagcaccggtatcatttcggattctcaaattaaggcatctgaattcctgggttactgggaacctcggctcgccaggctcaacaatgggggtagttataacgcatggtccgtggagaagctggctgccgagtttgcctctaagccttggatacaggttgatatgcagaaagaggtgattatcaccggcatccagactcagggagctaagcattacctgaaatcgtgctataccaccgaattttacgtggcttacagcagtaaccagattaactggcagatctttaaagggaattctacaagaaacgttatgtacttcaacggtaactcggatgcgagcaccataaaggagaatcaattcgatccccctatcgtggccaggtatatcagaatctctccaactcgggcatacaatagacccacgcttagattagagctgcaaggctgtgaggtgaacggctgctccactcctctgggaatggagaatggtaagattgagaataagcaaataacagcttctagtttcaagaagtcttggtggggggactactgggagccttttcgtgccaggcttaatgcgcagggcagggttaacgcatggcaggctaaagctaacaacaataagcaatggctggagatcgacttgttaaagattaagaaaatcacggccattattacccaagggtgtaaatccttgagcagtgaaatgtacgtaaagtcttatacgattcattactccgaacagggagtcgagtggaagccataccggctgaagtccagtatggtggacaagatctttgaagggaatactaacacaaaaggtcacgtaaaaaatttcttcaacccacctattataagtcggttcatcagagtgatcccaaagacatggaaccagtccatagcccttaggctggaactgtttggatgtgatatatatta

SEQ ID NO: 4286 - DNA, 999 bp, Artificial Sequence
  Description of Artificial Sequence: Synthetic coding sequence
atggatgacgctgtcgccccaggacgagaatacacgtatgagtggtcaatctccgaagacagcggtccgacacatgatgaccccccatgtctgacccacatctattattcccacgagaacttgattgaggattttaactccggactgattggccctctgcttatttgcaagaaaggaaccctcaccgaaggtgggacccagaagaccttcgataagcagattgtgttgctgttcgccgtcttcgacgagtccaagagctggtcccagtcttcctccttgatgtatacagtcaacggttacgttaatggcacaatgcctgacatcacagtgtgtgcccatgatcacattagctggcacctgcttggcatgtcgtcagggcctgaattgttttctatccactttaatggccaggttttagagcagaatcaccacaaggttagtgctattactctcgtgtcagctacatccacaaccgctaatatgactgtggggccagaaggaaagtggattatatcctctctgacgcccaagcatctacaagcaggaatgcaggcctacatcgacatcaagaattgtccaaagaaaacaaggaatttaaaaaaaatcaccagagaacagcggagacacatgaagcggtgggagtactttatcgccgctgaagaggtgatttgggactatgcaccagtgatcccagcaaatatggacaagaagtacagaagccagcatctggataacttctccaaccagattggcaagcactataaaaaagttatgtatacgcagtacgaagatgaaagctttaccaagcataccgtgaatcctaacatgaaggaagatggcatcctcggcccaatcattcgcgctcaggtgcgcgataccctgaagatcgtcttcaagaatatggcctcgaggccctattccatttaccctcatggggttactttcagcccatacgaggacgaggtgaatagttctttcacatcggggacgacaccctag

SEQ ID NO: 4287 - DNA, 1335 bp, Artificial Sequence
  Description of Artificial Sequence: Synthetic coding sequence
atggtgagccaggcgctgagactgctgtgcctattattgggcttgcagggatgcctggccgctgtcttcgttacccaggaggaggctcacggagttttgcaccggaggagaagggcaaacgccttccttgaggagctgaggccaggatctctggagagagaatgcaaagaggaacagtgcagttttgaagaggccagggagatttttaaggatgcggaaagaactaaacttttttggatttcgtattccgacggggatcagtgtgccagttccccttgccaaaatggaggcagctgcaaagaccaactgcaaagttacatttgcttctgtctgccagccttcgagggtcgaaattgtgagacccataaggacgaccagctcatctgcgttaatgaaaacggaggatgtgagcaatactgttccgatcacacaggaaccaaaagaagctgtagatgtcatgagggttactccctcctggcagatggcgtgtcctgcactccgacagtcgaatacccatgcggtaaaattccgatcctagagaaaagaaacgcttcaaagccacagggcaggatcgtgggcggaaaggtgtgtccaaagggcgaatgtccatggcaggtgctcctgttggtgaacggagctcagttgtgcggcggtacactcatcaacaccatctgggtggtatcggccgctcactgtttcgacaaaattaaaaactggcgtaatctgatcgcagtcctgggggagcacgacctctctgagcacgacggagacgaacagagccggagggtggcccaggtgataatccctagcacctatgtgccagggacaaccaatcatgacatagcactgctgagactgcatcagcccgtggtgctaactgaccacgtcgtgccgctgtgcttaccagaacgtaccttctctgagagaactctcgccttcgtgcgcttttctctggtgtccggatgggggcagctcctggatcgaggagcgactgccctcgagttgatggtactcaatgttccacgcctgatgacccaggactgtctgcagcagagtaggaaggtgggcgacagcccgaacattaccgaatatatgttctgcgccggatatagcgacgggtcaaaagattcatgcaaaggggactccggcggaccacatgcgacccactatcgaggtacctggtacttgaccgggattgtctcctggggtcagggatgcgcaactgtgggacacttcggagtgtatacccgcgtgtcccagtatattgaatggctgcaaaagctgatgcggtcagagccccgacctggtgtgctgctgagggcccctttcccctag

SEQ ID NO: 4288 - DNA, 1401 bp, Artificial Sequence
  Description of Artificial Sequence: Synthetic coding sequence
atggtgtcccaggcactgagactcctttgcttgcttctgggcctgcagggttgtctggccgcaggcggagtggccaaagcctcaggcggtgaaacacgcgatatgccttggaagcccggaccacaccgggtgttcgtgactcaggaggaggcccacggtgtgctacacagacgcaggagagccaatgccttcctggaagaactgcgtcctggatcactggaaagagaatgtaaagaggaacagtgttcattcgaagaggccagggagatcttcaaagatgctgaaaggactaaattattctggatttcgtacagtgacggggatcagtgtgcgtcctccccatgccagaacggaggatcatgcaaagaccagcttcagtcctacatctgcttttgcctgccagcctttgagggcagaaattgcgagacgcacaaggacgatcagctgatatgcgtgaacgaaaacggtggttgcgaacaatactgctcagatcatactggtactaagagatcttgtcggtgtcacgaggggtacagcctgctggcagacggcgtatcttgcacgcccacagtagagtatccatgcgggaaaatccccatactggagaaacggaatgccagcaagccacaagggcgtattgtgggaggtaaggtgtgccccaaaggcgagtgcccttggcaggtgctgctgttagtcaatggtgcacagctgtgtggcggtacccttatcaacacaatctgggttgttagtgcggcacactgctttgacaagattaagaactggcgaaacctgattgcggtgctcggcgagcacgatctttccgagcacgatggagatgaacagagtaggcgagtcgcacaggtgatcatcccctcaacatacgtgcccggaactacaaatcatgacattgcgttactgcggttgcatcagcctgtcgtgctaaccgaccacgtggtgccactctgtcttcctgagcgcactttttctgagcggacactggctttcgtgcggttctcgttagttagcggctggggccaactccttgataggggggctaccgctctcgaacttatggtattgaacgtacctagactgatgacacaagattgtctgcaacagtcaagaaaagtgggagactcacctaacatcactgagtacatgttttgtgccggatacagcgatggaagcaaggattcttgtaaaggtgactctggaggacctcatgctactcactaccggggaacatggtaccttactggtatcgttagttgggggcagggatgtgccaccgtaggccatttcggagtctacactagagtgagtcagtacattgagtggctacaaaaactgatgcggagtgaaccccgaccaggggttcttttgagggccccattcccatag

SEQ ID NO: 4289 - DNA, 1194 bp, Artificial Sequence
  Description of Artificial Sequence: Synthetic coding sequence
atgggaaatgtgaacaggcagggccagcattgccgggatttcatcatggtgtctcaggctctcagacttctttgtctacttctcgggttacagggatgtctcgctgcagacggtgatcaatgtgcttcatcaccatgccagaatggtgggtcctgtaaggatcagctccagtcctatatatgcttctgtctccccgcattcgagggcaggaactgtgaaacacacaaagatgatcaactcatctgtgtgaatgaaaacggcggttgtgaacagtattgctccgaccatacaggaaccaagagatcatgccgctgccacgaggggtattctctgcttgccgacggagtctcctgtacgcccactgttgaatacccctgcgggaagatccccatcctcgagaaacggaacgccagcaagccccagggccgaattgtcgggggaaaggtgtgccctaagggcgaatgcccatggcaagtcctgctgctcgtcaatggagcccagctgtgtgggggaactctgatcaacacaatctgggttgtgtctgccgctcactgcttcgacaagatcaagaattggcgtaacctgattgccgtgcttggggagcacgatttgtccgagcacgacggtgatgagcagtccagacgggtggctcaagtgatcattccctcaacatatgttccagggaccacaaaccatgacattgccctgcttaggttgcatcagcctgtcgtcttgaccgaccacgtggtgccactgtgtctgccagagcgtactttcagcgagcgaactctggccttcgttaggttctctctcgtcagtggttggggacagttgctagatcggggtgcaacagccctcgagctcatggtgctcaacgtgcctcgcttgatgacgcaggattgtttacagcaatctcgcaaagtgggcgacagtcccaacatcacagagtacatgttctgcgctgggtactctgacggctccaaggactcctgtaagggggattctggtggccctcacgccacccattaccgaggtacctggtacctgaccgggattgtgagctggggccaggggtgcgcgacggtgggccatttcggcgtctatacccgcgtctctcagtatatagaatggctgcagaagctgatgagaagtgagcctaggcctggtgtactgctgcgcgcaccttttccatag

SEQ ID NO: 4290 - DNA, 651 bp, Artificial Sequence
  Description of Artificial Sequence: Synthetic coding sequence
atgagaatccaggatcccggaaaagtgtttttcggcaacgtcgattccagcggtataaaacacaacattttcaaccctcccatcattgccagatatatccgcctgcacccaacacactactcgattcggagcacacttaggatggagcttatgggctgtgatttgaacagctgttcgatgcctctggggatggaaagcaaagctattagtgacgcgcagatcacagccagcagctacttcactaatatgtttgccacatggtctccatccaaagcaagactgcacctccagggcagaagcaacgcctggagaccacaggtcaacaatccaaaagagtggctgcaggtagattttcaaaaaactatgaaggtcactggcgtcacgactcaaggggtaaagagtcttctgacaagtatgtacgtgaaggagttcttgatcagtagctcccaggatggtcatcagtggaccctctttttccaaaacggcaaagtgaaggtgtttcagggcaatcaagacagcttcacacccgtagtcaacagtctggatcccccactgttaacccgctaccttcgcatccacccacagtcctgggtccatcagatagccctgcggatggaagttcttggctgcgaagcccaggacttgtattag

SEQ ID NO: 4291 - DNA, 7056 bp, Artificial Sequence
  Description of Artificial Sequence: Synthetic coding sequence
atgcagattgaactgtccacatgcttctttctctgtctattacgattttgcttttccgccaccaggagatactaccttggtgctgtcgaactgagctgggattacatgcagtcagacctgggggagttgcctgtggacgccaggtttccccctagagtcccaaaaagcttcccatttaacacttcagtcgtgtacaagaagacgctctttgtggaatttaccgatcatctgttcaacattgccaagcccagacctccgtggatgggcctgctggggccaacaattcaggccgaagtatatgatactgtagtgataaccctcaagaatatggcaagtcatccggtgtccttacatgctgtgggggtttcctattggaaggcttcagagggggctgagtacgacgaccaaacctcccagcgggaaaaggaggacgacaaagtatttccgggaggatcccacacctacgtatggcaggtcctgaaggagaacggtcctatggctagtgaccctttatgcttaacatactcgtatttaagccatgtggacctcgtgaaggacctgaatagcggccttatcggagccctgctggtgtgccgagagggatcactggctaaagagaaaacacagaccctccacaagtttatcctactgtttgcagtcttcgacgaagggaagagctggcattccgaaaccaagaattcactgatgcaggaccgggacgcagcatctgcaagggcttggcctaaaatgcacactgtcaatgggtatgtcaatcgttctttaccgggactgatagggtgccaccgcaagtctgtgtattggcacgtaattggaatgggcactactccagaggtccattccatctttttggaaggccacacctttctggtccgcaaccataggcaggcttcacttgagatatcccctatcaccttcttgaccgcacagactctcctcatggacctgggacagttcttgctgttttgtcatatctcttctcaccagcacgatggaatggaagcctatgtcaaggtggactcttgccccgaggaaccacaactgagaatgaagaataatgaggaagcagaagactatgacgacgacctcaccgattccgagatggacgttgtgcgctttgacgatgataactcaccttcctttatacagattaggtcggtggccaaaaagcacccgaaaacttgggtccattacattgcagccgaagaagaggactgggattacgcacccctcgttctggctcccgacgatcgcagctacaaatctcagtacctgaacaatggaccgcagcgcataggccgaaagtacaagaaagtccgattcatggcctacactgacgagacctttaaaacacgcgaggccattcaacacgagagcggaatcttagggccactgctgtatggtgaggtgggcgataccctgctcataatttttaagaaccaagcatctcgaccgtacaacatttatcctcatggcataaccgacgtcaggccactctattctcgaagactgccgaaaggcgtgaagcacctgaaggactttcccatccttcctggggagatctttaagtacaagtggacggtgacagtagaggatgggcctacgaagtccgatcctagatgtctgacaagatattacagcagttttgtaaatatggagcgtgacctggcgtccggccttattgggcctctcctgatttgctacaaggagtcagttgatcagagaggtaaccagatcatgtctgacaagcgcaacgtaatcctgttttctgtgttcgatgagaacagaagctggtatctgacagagaacattcagcggttcctgcctaatcctgcaggagtgcagttagaggaccctgagtttcaggctagcaacattatgcactctattaacggttacgtgtttgactccttgcaattatccgtctgcctgcacgaagtggcatattggtacattctttctattggggctcagacagacttcttgtctgttttcttctctggatataccttcaagcacaagatggtgtacgaagataccctcactctcttccccttttctggggaaaccgtctttatgagtatggaaaaccctggactgtggatcctgggatgtcataactccgacttcaggaatagaggaatgactgccctgctaaaggtgtccagttgtgacaagaacacaggagattactacgaggactcttatgaggacatcagcgcctacctcctgagtaagaacaacgccatcgagccgcgatcattcagccagaatagccgacacccatccacccgacagaagcagtttaatgccacaaccattccagaaaacgacatcgaaaagactgatccttggttcgcgcacaggacacccatgcccaaaattcagaacgtgtcaagctctgacctcctgatgttgctccgccagtcccccaccccacacggactgagcctgtctgacttgcaagaggccaagtatgagacgttctcggatgatcctagccctggggcaatcgattcgaacaactctttaagcgagatgacgcattttaggccacaattgcatcacagcggtgacatggtattcacacccgagtccggactgcaacttcgacttaatgagaagttggggacaactgcggcaaccgaactcaagaagctagacttcaaggtctcctccacctccaataacctgataagtaccattccgagtgataatcttgctgccggtacagacaacacttcctccctcggccctcctagcatgcctgttcactatgattcgcagctggacaccacgctgttcggcaagaagtcttcccctttgacggaaagtggtggtcctcttagcctgtcagaagagaataatgattccaagctgctcgagtctggactcatgaattcccaggaaagcagttggggcaaaaatgtgagctcaacagagtctggtagactgttcaaaggcaaaagggcccacggtcctgccctattgaccaaagacaacgccctttttaaagtgagcataagtctcctcaagaccaacaagacaagcaataacagtgccacgaatcggaagacccacatcgatggcccttccctgcttatcgagaacagtccatcagtatggcagaacatcctggagtctgacacagagtttaaaaaggtcactccgctaattcacgatcgtatgctgatggataaaaacgctactgccttgcggctaaaccatatgagcaacaagacgacgtcatctaagaacatggaaatggttcagcaaaaaaaggaagggcctatcccccctgatgcacagaatccagacatgtcctttttcaagatgttgttccttccagagtccgccagatggatccagcggacacacggcaaaaattccctgaatagtggccagggacccagccctaaacagctggtcagtctggggcctgaaaagtccgtggaaggacaaaactttctcagtgagaaaaataaggtggttgtgggcaaaggtgagttcaccaaggacgtcggcctgaaagagatggtgtttcctagttctcggaatctgtttctgacgaatctggataatctgcatgaaaacaacacccacaatcaggagaagaagatccaggaagaaattgagaaaaaggagaccctcattcaggagaacgtggtgcttcctcagattcacacagtcactggaacgaaaaacttcatgaaaaacttattccttctttccacgaggcagaatgttgaaggctcttatgatggggcttatgcccctgtactccaggacttccgctccctgaatgattcgacgaacagaaccaaaaaacacactgcccacttctccaaaaagggtgaggaagagaacctggaaggattgggaaatcagaccaagcaaatcgtggaaaagtacgcttgtaccacacggatctcaccaaacacctctcagcagaattttgtgacccagaggagcaagcgtgcattgaaacagttccgactccctctggaagagactgagcttgaaaaacggattatcgttgatgatacatcgacccaatggtcaaaaaacatgaagcacctcacaccttccactcttacacagatcgactacaacgagaaggaaaagggcgcaataacccaatcccctctgagtgattgcctgacacgcagtcattcaattccacaagccaaccgaagccctttgccaatcgccaaggtgagttccttcccttccatcaggcctatctatttgactagagtcctctttcaggacaactctagccatctgccagctgcttcatataggaagaaggactctggggtacaggaatctagccacttcctgcagggtgctaagaagaataacctgtctttggctattctaaccctggaaatgaccggagatcagcgggaggtaggaagccttggcacttctgctaccaattctgtgacctataagaaggtggagaatacagttctcccaaaacccgacttgcctaaaacttccggtaaggtggagttactgccaaaagtccatatctaccagaaggatctgtttcccaccgagactagcaatggatctcccggtcatttagatttggtagaaggcagcctactacagggaaccgagggagccattaagtggaacgaagccaataggcccggaaaagtgcccttcttaagagtggctactgagtcatccgctaagacgccctctaagctcctcgatccacttgcttgggacaaccactatggtacacagatccccaaagaagaatggaagtcccaagagaagtccccggagaagactgccttcaaaaagaaggataccatcctttcattgaatgcctgtgagagcaatcatgccatagcagccatcaacgaaggacaaaacaagcctgagatcgaagtaacatgggctaagcagggtcggacagaacgcctttgctcccagaacccgccagtgttgaaacggcaccaaagagaaatcacacgcactaccctgcagtccgaccaggaagagatcgattacgacgacacaatcagcgtcgaaatgaaaaaagaagatttcgatatatatgacgaggacgaaaaccagagccctagaagcttccaaaagaaaacccggcactactttatcgccgcagttgagcgcctgtgggattatggaatgagctcaagtccacatgtactgaggaatcgcgctcaatccggttcagtcccacagtttaagaaggttgtgttccaggagtttacggatggatcttttacgcagccgctctacagaggagaactgaacgagcacctgggcctcctgggaccctatattcgcgctgaggtcgaagataacataatggtaacatttcgaaatcaagcaagcaggccatactctttttactcgagcctgatctcatacgaagaagatcagcgtcaaggtgctgaaccccgtaaaaacttcgtaaagcctaacgagacgaagacttacttttggaaggtgcagcaccacatggcccctacgaaggacgaatttgattgcaaggcctgggcctatttctctgatgtcgatcttgagaaggacgttcattctggtttgattggccctttgctcgtgtgtcatacgaacaccctgaatcccgcacatggcaggcaagtcactgttcaagagtttgcgcttttcttcacgatatttgatgagaccaaaagttggtattttaccgagaatatggagcggaactgccgtgccccatgtaacatccaaatggaagaccccacgtttaaggagaactaccgtttccatgctataaatggctacataatggatacactccccggacttgtgatggctcaggaccagagaatcagatggtacctgctctccatggggtctaacgaaaacatacactctatccactttagcggacatgttttcacagtccggaagaaagaggaatacaaaatggctctttacaacttgtatccaggtgtttttgaaaccgtggaaatgctgcctagcaaggccggtatatggcgagtcgaatgccttattggcgagcaccttcatgctggcatgtcgacactgttcttggtgtacagcaacaaatgtcagacacccctgggtatggcgagtggtcatatcagagacttccagattaccgcatctgggcagtacgggcagtgggcccctaaattggctcggctacattactcagggtctattaacgcctggtcgacaaaagaacctttttcctggattaaagtcgacctccttgcacccatgattatccacgggatcaaaacccagggtgcaagacagaagttctcatcactgtacatcagccagtttattatcatgtattccttggacggaaaaaagtggcaaacctaccgtggcaatagcacaggaaccctaatggttttctttggcaacgttgacagtagcggtatcaaacacaatatttttaatccgccaatcatcgcccgatacattaggctccacccaactcactattccatcagatccacgttgcgaatggagctgatgggttgtgaccttaactcttgttctatgccactgggtatggagtcaaaggccataagcgacgcccaaataacagcatcttcatatttcaccaatatgtttgccacatggagtccctccaaagcccgtctccacctgcagggaaggtcgaacgcatggcgacctcaggtgaacaatccaaaggagtggctccaggtggacttccaaaagaccatgaaggttaccggagtcaccacccagggggtgaagtctctcttgacttctatgtacgttaaggagtttttgatttcctcatcacaggacgggcatcagtggacccttttcttccagaacggtaaagtgaaagtgttccagggaaatcaagattcctttacacccgttgtgaattcccttgacccccctctcttgacacgatacctcaggattcacccccagagttgggtgcatcagatcgcactccgaatggaggtgcttggttgtgaggcccaggacttgtattac

SEQ ID NO: 4292 - DNA, 999 bp, Artificial Sequence
  Description of Artificial Sequence: Synthetic coding sequence
atgggacggcctctgcacctagtcttgctgtctgcctctcttgctggcctgcttctgctgggtgaaagcctgtttatcagaagagagcaggccaataatattttggcaagagtgacccgcgctaattcctttttggaagagatgaagaaaggacacttggaaagggagtgcatggaggagacctgcagctatgaagaagctcgggaggtgttcgaagactccgacaagaccaacgagttctggaacaagtataaagacggggatcagtgcgaaactagtccttgccagaaccagggaaaatgtaaagacggtttgggagaatacacatgcacctgcctggagggctttgaaggaaagaattgcgaattgtttacccggaagctgtgttctttggataacggtgattgcgatcagttctgtcatgaggagcagaactccgtggtttgctcctgtgcaagaggctacacattggccgataatggcaaggcatgcattcctaccggcccatacccctgcggaaaacagaccctagagcgaaggaagaggtccgttgcacaggcaacctcctccagcggtgaggcacctgatagcatcacctggaaaccgtatgacgcagctgatctggatcctactgagaaccctttcgacttgctcgatttcaaccaaacgcagccggagcgcggagacaacaatttaacacggatagtcgggggacaagagtgcaaggacggagaatgcccttggcaggctctgcttatcaacgaggaaaacgaaggcttctgtggaggaacaattctgtcagaattttatatcctgaccgctgcccactgtttgtaccaggcgaagaggtttaagggtaccggaaccagaagcaggcgaagggcagtccggaggtgtactcgctggcgctggtccagttcgactactggcagccagcgaaggcctatgacttcaacttcaccttgctctgggtctcgtccaccctctccaagtgcttag

SEQ ID NO: 4293 - DNA, 1467 bp, Artificial Sequence
  Description of Artificial Sequence: Synthetic coding sequence
atgggcaggccacttcacttggtgctgttgagcgcctcactagcaggcctcctcttactaggggagtctctgtttattagaagagagcaggccaacaatatactggctagggtgactcgggcaaatagttttctcgaggaaatgaagaagggacacctagagagagagtgcatggaagaaacatgcagctacgaagaggccagagaagtatttgaggacagcgacaagactaatgagttttggaataaatataaagacggcgatcaatgcgagaccagtccatgtcaaaaccaggggaaatgcaaggatgggttgggtgaatacacctgcacttgcctggaagggttcgaggggaagaattgtgagctctttactcggaagttgtgctcacttgataatggagattgtgatcagttctgtcatgaagagcaaaattcagttgtgtgtagctgtgcccgtggctatactctggcagataacggtaaggcatgcatccctaccggcccttacccttgcggcaagcaaactcttgaacgcaggaagaggagtgttgcacaagcgactagttcaagcggagaggcccctgacagtatcacctggaagccatatgatgcagcggacctggacccaacagagaaccccttcgatctacttgacttcaaccagacacagccagagcgcggtgacaataacctgacaagaattgtcggcggacaagaatgtaaggatggcgagtgtccttggcaggcccttctcattaatgaagagaacgaaggtttttgcggagggacaattctctccgagttttatatccttacggccgcacactgtttgtatcaggcgaagagattcaaagtaagagttggagacagaaatacggagcaggaggaaggcggtgaagctgtgcatgaggtcgaagtggtcataaagcacaacagatttacaaaggaaacttacgacttcgacatagcagtgctccgtctcaaaacccctataacgtttaggatgaatgtggcccctgcctgtctgccagagagagattgggctgagtcaacgctgatgacacagaagacaggcatcgtgtctggcttcggcaggacacacgaaaaaggaagacagtcgactcggcttaagatgctggaggttccctatgttgatcgcaactcctgtaagttgtcaagctccttcatcataacacagaatatgttctgtgcagggtatgacacaaaacaggaggacgcttgtcagggcgactccgggggtccacatgttactcggtttaaagatacttattttgtgaccggtatcgtaagttggggagaagggtgtgccagaaaaggcaagtacggtatttatacaaaggtgacagcatttctgaagtggattgacaggtcaatgaagactcggggactacccaaggctaaaagtcacgctcccgaggtgattacctcgagtcctctgaaatag

SEQ ID NO: 4294 - DNA, 1005 bp, Artificial Sequence
  Description of Artificial Sequence: Synthetic coding sequence
atgggacgcccactgcacctggttctgctctctgcctctttggctggactgctgctgctgggagagagtctatttatccgacgagagcaggctaataacatactggccagggtgactcgggcaaacagctttctggaggagatgaaaaaggggcacctcgaaagagaatgcatggaagaaacgtgctcctacgaagaagcccgagaggtgtttgaagacagcgacaagacgaatgagttctggaataagtataaggacggagaccaatgcgaaaccagtccatgccaaaaccagggcaaatgtaaggatggtctcggcgagtacacctgcacctgtctcgagggattcgaaggaaagaactgcgagctgtttacccgtaagttatgctcccttgataacggggactgcgatcagttctgccacgaggagcaaaactctgtggtttgcagctgcgccagaggatatactctggcggacaacggcaaggcctgcatccccacgggcccttacccatgtggtaaacagacactggagaggcgtaaaagaagcgtggcgcaggctacaagttcctcaggtgaggctcctgatagcatcacctggaaaccatatgacgcggctgacttagaccctaccgagaatccatttgatctgctagactttaatcagacacagcccgagagaggcgacaacaacttaacccgcatcgtcggcggacaagaatgcaaagacggggagtgtccttggcaggctctgcttatcaatgaggagaacgagggcttctgcggcggtactatactgtccgagttctacatcctcactgcggcacattgcctgtaccaagcaaaacgcttcaaggtacgcggaaccgggacccgtagtagaagacgcgcagtgaggcggtgtaccagatggcgttggagcagcagcactactggctcccagcgtagacccatgacttcaacgagtccatgttcggggagccggccaccttctccttccgcatag

SEQ ID NO: 4295 - DNA, 1722 bp, Artificial Sequence
  Description of Artificial Sequence: Synthetic coding sequence
atgatctttctctatcaagtcgtccactttatcctgttcacatcagtctccggggagtgcgtaacccagctcctgaaggacacgtgtttcgaaggcggtgatatcacaactgtttttacaccgagcgcaaagtattgccaggtcgtgtgtacataccaccctagatgtctcctctttactttcacagccgaatccccatctgaggacccaacccgctggttcacatgcgtgctgaaggatagtgttaccgaaaccctgccaagggtgaacaggaccgctgccatcagtggctacagctttaaacaatgctcccaccagatttctgtgaacaacatctgccttctaaaacacacacagaccggtacgcctactaggattacgaagctggacaaggttgtctcaggttttagtctcaaaagctgtgcgctgtccaacctggcctgtattagggatatctttccaaacacagtgttcgccgactcaaacatagactctgtgatggctccggacgcgttcgtgtgtggtcggatttgcacacaccatccgggatgtctattcttcacgtttttctctcaggagtggcctaaggaaagtcagaggaacctctgcctgcttaagacgagtgagtcggggctgcccagcacccggatcaagaagagcaaagcactgtctggattctccctgcaatcttgtagacacagcatccctgtgttttgccactctagcttttaccacgacacagactttctgggtgaggaattagacattgtagcagcgaagagtcatgaggcttgtcagaaactctgtacaaacgcggttcggtgtcagtttttcacctatactccagcacaggcctcctgcaacgaagggaaaggcaagtgttacctgaaactgtcctctaatggcagtcccaccaagatcttgcatggtaggggagggatcagtggttataccctgcgcttatgtaaaatggacaatgaatgtaccactaaaatcaaacccaggattgtgggcggaaccgctagtgtcagaggagagtggccttggcaagtaaccctgcacactaccagtcctactcagcgccatctatgtggaggaagtatcattggaaatcaatggatcctcacagccgctcactgtttttatggtgttgaaagtccaaagatcctacgtgtctatagcggcatactgaatcagagtgagattaaagaggataccagtttctttggtgtgcaagaaattattatacacgatcaatataagatggcagaatccggctacgacatcgctctgttaaaattggagacaaccgtcaattacaccgacagccagagacctatctgtctaccgtccaaaggagacaggaacgtgatttacacagattgctgggtgaccgggtggggctaccggaaacttcgcgataagatacagaacacactgcagaaagctaagatccctctggtgaccaacgaagaatgccagaaacgctacaggggccacaagattactcataagatgatctgcgccggatacagagaaggaggtaaggacgcctgtaagggggatagcggaggtcctctgtcttgtaaacacaatgaggtgtggcacctggtgggcatcaccagctggggcgaaggctgtgcgcagagggagcgccctggagtgtacactaatgtcgtggagtatgtggactggattctggaaaagacccaggctgtctag

SEQ ID NO: 4296 - DNA, 1878 bp, Artificial Sequence
  Description of Artificial Sequence: Synthetic coding sequence
atgatcttcctgtaccaggtagtgcatttcatactgttcacctccgtatctggtgaatgcgtgacacaactcctcaaagatacctgctttgagggaggcgacattacgaccgtgttcacaccgagtgccaaatattgtcaagtggtgtgtacctaccatcctaggtgtctccttttcacttttaccgcagagagtcctagtgaagatcctaccagatggttcacatgtgtgctgaaggatagtgtcacggagaccctgccccgtgtaaataggacagcggcaattagtggctactcattcaagcagtgcagtcaccaaatctctgcgtgtaacaaggatatctatgtggatcttgacatgaagggaatcaactataactcttcggtcgctaagtctgctcaagagtgccaagaaaggtgtacagacgatgtgcactgtcactttttcacttacgcaacaaggcagttcccaagcctggagcaccgtaacatatgtctgctcaagcacacgcagactggcaccccgaccagaatcaccaagctggacaaagttgtctccggcttctctctgaagtcttgcgcactgagtaacctggcttgtattcgcgatatttttcctaataccgtttttgccgactctaatattgattccgtcatggcgccagatgcctttgtctgcgggcgtatctgcacgcaccaccccggatgcctctttttcactttcttctctcaggaatggccaaaggagtctcaaaggaacctgtgtttactgaaaactagtgagagtgggctaccctcaacacgcattaagaaaagcaaagctctcagcggcttctctctgcaaagctgtcgacatagcataccggttttttgccactctagcttttaccacgacacggatttcttgggcgaggagctcgacattgttgccgctaagtctcatgaggcttgtcagaagctctgtaccaacgctgttaggtgccagttcttcacgtatacccctgcacaggccagctgtaacgagggaaagggaaagtgttatcttaagctgtcttccaacggctctcccacaaagatcctgcatggtcgcggtgggatcagcggctataccctgagactttgtaaaatggataacgagtgcacgacaaaaatcaagccgcgtatagtcggtggaaccgcttcagtccggggagaatggccctggcaggtaacgctacataccacatcacccactcaacggcacctctgtggcggaagcatcatcgggaaccagtggattcttactgcagctcactgcttctacggagtggagtcacctaaaattctgcgggtgtattctgggattctgaaccaatcagaaatcaaagaagatacaagcttcttcggagtgcaagaaataattattcacgatcagtataaaatggctgaaagtggatacgacatcgccctgctcaaattggaaaccacagtgaactacactgattcccagcgacccatctgtctgcccagtaagggtgataggaatgtcatctacactgactgctgggttacaggatggggctatcgtaaattgagagataagatccaaaacaccctgcaaaaagctaaaattcccttggtgaccaatgaagaatgtcagaaaagatacagagggcataagattacacataaaatgatttgtgctggatatagggagggaggcaaggatgcttgcaaaggcgacagcgggggtccactgagctgtaaacataacgaggtctggcacttggtaggcatcacatcctggggcgagggatgcgctcaaagagagaggcctggggtatacaccaatgtcgttgagtatgtcgattggattctggaaaagactcaggcagtgtag

SEQ ID NO: 4297 - DNA, 633 bp, Artificial Sequence
  Description of Artificial Sequence: Synthetic coding sequence
taatccgggttttcattgaaatcttgtgctcttagtaatcttgcctgtattcgcgacatcttccccaacacagtgtttgcggatagcaatattgattccgtaatggccccagacgcgttcgtgtgcggtaggatttgcacacatcaccctggctgtttgtttttcacattctttagtcaagagtggcctaaagaaagtcaacgaaacctctgtctgttgaagacctccgaatccgggcttccgagcacaaggatcaagaagtctaaggctctctctggattcagtcttcagtcctgtcggcacagcatccccgtattctgccacagcagcttttatcacgataccgatttcctgggagaggaactggacatcgttgccgctaaaagccacgaagcctgtcagaaattgtgtactaacgctgttcgctgtcaatttttcacatacactccggcacaagccagctgtaacgaaggcaaggggaaatgttacttaaaactgagttctaatggttcgcccacgaaaatactgcacggcaggggaggtatctccggatatactctccggctctgtaaaatggataatgagttgcgcggtgcaccaatgaagatctccggctggctcaagacgagctag

SEQ ID NO: 4298 - DNA, 2199 bp, Artificial Sequence
  Description of Artificial Sequence: Synthetic coding sequence
atgagcgaaacaagtagaaccgccttcggcggacggcgagcagtgcccccaaataacagcaacgcggctgaggatgatctgcccacggtagagctgcagggcgtggtgccccgaggagttaatcttcaggagtttcttaatgtgacatctgttcacctttttaaagagcggtgggacaccaacaaagtggaccaccacactgacaagtatgagaacaataaattgattgttaggcggggacagtccttctacgttcagatcgacttttccagaccctacgacccgcgaagggacctgttcagagtggaatacgtgatcggccgatatccacaggagaataagggtacttacattcccgttccaatcgtatcagagctgcaaagcgggaaatggggagccaagattgttatgcgtgaggatcggtctgtgcggctctctatccaatctagccccaagtgcattgtcggcaaattccggatgtacgttgcagtttggactccctatggggtgctgcggactagtaggaacccggagactgacacctatattctattcaacccctggtgtgaagatgatgccgtgtacctcgataatgaaaaggaaagggaagaatatgtacttaatgatattggcgtgatcttctacggtgaggtgaacgacataaagacccgttcttggtcatacgggcagtttgaagatggtattttggacacttgcctctatgttatggatcgggctcagatggatctctctggtcggggaaatccaatcaaggtttctcgggtgggctctgccatggtgaatgccaaggatgacgagggcgtcctcgtggggtcttgggataatatttacgcttacggagtccccccatctgcctggacagggtctgtcgacatcctgctagagtaccgctcttctgaaaatcccgtacgctacgggcagtgctgggtgttcgcaggagtatttaacacatttttgagatgtctcgggatcccagcacgcatcgtgaccaattactttagcgctcatgacaatgatgcaaatttgcagatggacatatttctggaggaggacggcaatgtcaattcgaagctgaccaaagattccgtctggaattaccactgttggaacgaggcgtggatgactcgccctgatcttcctgtgggttttggtggctggcaggcggtcgactcaacgccacaggaaaattcagatggaatgtaccgttgcggccctgcatcagtgcaggctattaagcatggccatgtgtgtttccagttcgacgcacctttcgtgttcgccgaggtcaactcagacctgatatacattacagctaagaaggatgggacccacgtggtggaaaatgtcgatgccacacatatcggaaaactgatcgtgactaagcagatcggcggagatggcatgatggatattaccgacacttacaagttccaggagggccaggaggaagaacgacttgccttagaaaccgcgcttatgtatggggctaagaagccactgaacacagaaggtgtgatgaagtctcgatcaaatgttgacatggacttcgaggttgaaaatgctgtgttgggaaaggatttcaaactgagcattacctttaggaataacagccacaatcggtacaccattactgcttacctatcggctaacatcactttctataccggggtccccaaggccgaattcaagaaggaaacattcgacgttacattggagccactgagcttcaagaaagaagcagttctgatccaggccggagaatacatgggtcagctcctggagcaggccagtcttcacttttttgtgactgctaggatcaacgagacacgcgatgtgctggctaagcagaaatctaccgttcttactatccccgagattattatcaaggtgagagggacccaggtagtcggatccgacatgacagttacggtggaattcaccaaccccctgaaggagacattgcgcaacgtttgggtccatctggacggccctggggtgactcgccctatgaaaaaaatgtttcgcgagatccgccctaacagcaccgtgcagtgggaagaggtgtgcaggccctgggtgagcggccacagaaagctgatcgcaagtatgtctagtgactctctcagacatgtctatggtgagctcgacgtacagatccaaagacgcccttctatgtag

SEQ ID NO: 4299 - DNA, 417 bp, Artificial Sequence
  Description of Artificial Sequence: Synthetic coding sequence
atgtcagagactagcaggacagctttcggaggacgcagggccgtccctcctaataactctaacgcggctgaggacgacttaccgaccgtggagttacaaggtgtggtgccccgaggggtcaacctgcaagagtttctgaacgtcacctcggtgcatctgttcaaagaacggtgggacaccaacaaggtggaccatcacacagacaaatacgagaacaataaactgattgttcgtcggggtcagagcttttatgtccagatcgacttctcacggccatacgatccaaggcgggacttgtttcgtgtggaatatgttatcggcaggtacccccaggaaaacaaaggcacatacatccccgtgcccatcgtgtccgaactccagagtgggaagtggggggcaaagattgtcatgcgctag

SEQ ID NO: 4300 - DNA, 1881 bp, Artificial Sequence
  Description of Artificial Sequence: Synthetic coding sequence
atgtcagagacatctcgtaccgcgttcggagggagacgagccgtgcctcccaacaatagcaatgcagcggaagacgacttgcccacagtggagttacaaggcgtggttccacgaggtgtgaatttacaggggcgatacccccaggagaataagggcacgtatatcccagtaccaattgtatctgaactgcagagtggaaagtggggggctaagatcgtgatgagggaagatcggagcgtccgcttgtctatccagagcagcccaaaatgtattgtgggcaagttccgcatgtacgttgccgtatggacaccatacggcgtcttgagaacctcgagaaaccccgagactgacacatatattttgttcaatccctggtgtgaagatgatgctgtgtacctggacaatgagaaagagcgtgaggagtacgtgttaaacgacatcggagtgatcttctatggcgaggtcaatgatataaagacgcgatcatggtcctatggccagtttgaggacgggatcctggacacttgcctttacgtaatggaccgcgctcagatggacctgagcgggaggggaaatcccataaaagtaagccgcgtgggatccgcaatggtgaacgcgaaggatgatgaaggcgtgctggtaggctcttgggacaatatctatgcttacggcgtcccaccctctgcgtggaccggttccgtcgacattctgttggaataccgcagcagcgagaatccggtgaggtatggacagtgttgggtgtttgccggtgttttcaatactttcctgcgatgtctaggtattcccgcaaggatcgtgacgaactactttagcgcccatgacaacgacgccaaccttcagatggatatattcctggaagaagatggaaatgttaatagcaaactcaccaaggattctgtctggaactatcactgttggaacgaggcgtggatgacacggccagacctgccggtgggattcggtggctggcaggccgtcgattccacccctcaggaaaacagtgacgggatgtatcgctgcggacctgccagcgtacaggctattaaacacggccacgtctgctttcagttcgatgctcccttcgtgtttgccgaagtcaattcagatctgatatacatcaccgcgaagaaggacgggacccatgtagtggaaaacgtcgatgccacccacatcggaaagctcattgtgaccaagcagatagggggagatggaatgatggacatcaccgacacctataagttccaggaagggcaagaggaggaaagacttgcgttggaaactgccctcatgtacggggcaaagaagccccttaatacggagggggttatgaaaagccggagcaacgtggacatggatttcgaagtggaaaatgccgtactgggcaaagacttcaaactttctatcacgtttcgaaacaatagccacaaccggtacaccataacagcttatttgagcgccaacatcacattttatactggcgtacctaaggcagagttcaagaaggagacatttgacgtgacactggagcctttaagctttaaaaaggaagccgtgctcatacaggccggagagtacatggggcagctgctggaacaggcatccctgcacttttttgttaccgctcgcatcaatgaaactagagatgtgctggctaaacagaaatccacggtcctgactattcctgaaatcattattaaggtgcgcggaacacaagtggtgggttccgatatgaccgtcactgaagtttgccgaccctgggtttccgggcatcggaaattgattgctagcatgagcagcgatagcctgagacacgtctatggagaattagatgtgcagatacagcgcaggcccagcatgtag

SEQ ID NO: 4301 - DNA, 8835 bp, Artificial Sequence
  Description of Artificial Sequence: Synthetic coding sequence
atgactctcagactactggtcgcagccctctgcgcgggaatcctcgcagaagctccaagggtgcgcgctcaacaccgggagcgcgtgacttgtacccggctgtatgccgctgacatagtttttcttctggatggctcttcgtcgatcggacgttctaatttccgcgaggttagaagcttcctggaggggcttgtccttccgttctctggcgctgcttccgcccagggtgtgcggtttgccactgtgcagtatagcgatgacccccgtacagagtttgggctggatgcactcgggagcggtggcgacgtaatcagagcaataagagagctaagctataagggcggtaacactagaaccggagctgccatcttacacgttgccgatcacgtgtttttaccgcagttggcgaggcccggtgtaccaaaggtgtgtattttgattactgacggaaagtcacaggatcttgtggatactgctgcccagagattgaagggacagggggtcaagctgtttgcagtgggcatcaagaatgctgatcccgaagagctcaaacgcgtcgcttcccagcctacatcagatttcttcttctttgttaacgatttttccatactccgaaccttactgccgctagtgagcagacgggtctgcaccacggccggaggcgtcccagtgacccgcccacctgatgacagcacaagcgctccacgtgacttggtgttgtctgaaccttcctcacaaagtttacgagttcagtggacagccgcttccggtccggtgaccggctacaaggtccagtacacaccactcaccgggcttggccagccccttccctccgagcgccaggaggtcaatgtgcctgccggagaaacatctgtccgactccgaggactccggcctcttactgagtaccaggttactgtgatagccctatatgctaattcaatcggcgaagccgtgagtgggactgccagaacaactgcccttgaaggcccagaactgacaatccagaacactaccgcacactcactcctggtagcatggagaagtgtccccggagccacaggataccgagtaacctggcgggttctgtcagggggaccaacccaacagcaggagctcggacccggacaggggtccgtgctcctgagggacctggaacccggtactgattacgaagtaacagtgagtacgctgttcggtagatcggtaggtcccgctaccagcctcatggctcggacagacgcttccgtggagcagaccctgcggccagtcatacttggcccaacatctatactgctgagctggaatctagtccctgaggcgagggggtatcgtctcgagtggcggagggaaactgggctggagcctccccagaaggtggttctgcccagcgacgttacgcgatatcagttggatggcttgcagcccggaactgaatataggttgacactgtacactctcctggagggccacgaggttgccaccccggctactgtggtgcctactggcccagagctgcccgtgtccccagtcaccgacctgcaggccacagagttgccgggacaacgggttagggtatcttggtcacccgtgccaggggctacacaatatagaataattgtccgcagcacacaaggtgtcgagaggacacttgtcctgcctggctcccagacagccttcgacctggacgatgtgcaggccggactgagctacaccgttagggtgtcagctcgcgtgggaccacgcgaaggctcagcgagcgtcctcactgtcaggagagagcccgagacccctttggcagtacctgggctgcgggtggtcgtaagcgacgccacaagagtaagagttgcttggggacctgttccgggtgcatccggctttcgcatcagttggtcaaccggtagtggtccagagtccagtcagaccttacctccggacagcaccgcgaccgacataactggcctccagcctggaacaacttaccaggtggctgtgtctgttctacgtggacgtgaggagggacctgccgctgttatcgttgccagaactgaccccttaggtccagttagaaccgttcatgtgactcaggcttcctccagcagcgttacaataacatggacccgcgtgcctggggctacaggctacagagtgtcttggcacagtgctcatggacccgagaagtcacagttggtatcaggagaagccacggtggccgaactggacggcctggagcccgacactgaatatacagttcacgtgcgagctcatgtcgcgggtgtggacggacctccagcttcggttgttgtccgaacagccccagagcccgtgggacgggtgagccgactgcagattctgaatgccagttcagacgtcctgagaatcacctgggtcggcgtcactggtgcgaccgcttaccgactcgcatggggtagatcagaaggtggtcctatgagacatcagatcttgccaggaaacaccgactctgcggaaatcagaggactagagggaggtgtctcatacagtgttagagtaacagccctggtgggagacagagaggggacacccgtttccatcgttgtgacgacccctcctgaggccccacccgcactcgggactctgcacgttgtccagcggggagagcactctctcagactgcggtgggaacctgtccctcgagcacagggatttctccttcattggcagcccgagggagggcaggagcaaagtcgggtcctcggacccgagctgtcttcctaccacctcgacggactggagcctgccactcagtacagggtgagactgagtgtgttaggacccgcaggcgaagggcctagcgccgaagtgacagcgagaactgaatcaccacgtgtaccgagtattgagcttagggtggtcgacaccagcatcgactccgttaccttagcctggacacccgtgtcccgggcttcctcctatattttgtcatggagacccctgagaggcccagggcaggaagtaccaggcagtcctcaaaccctcccgggaatctccagcagtcagcgggtgactggactcgagcccggagtgtcttacatcttctcactgactcctgtactggatggtgtccgcggacccgaggccagcgtcacccagacaccggtctgtcctcggggactggccgatgtcgtgtttttaccgcatgcaacacaggataacgcgcatcgggctgaggccacccggagggttctggagcgcctagttctggctctgggtcctctcgggcctcaagcagtgcaggttggattgctgagctatagtcaccgcccttctcctctgtttcccctaaatggcagccatgacctgggcatcattctgcagagaatcagagatatgccatatatggatccgagcggaaacaatctcggcactgccgtggtcaccgctcatcggtacatgctggcacccgacgccccaggacgccgtcaacacgtgcccggagttatggtgcttcttgtggacgaacctctacgcggagacatatttagtccgatcagggaggcgcaggcttcaggcctgaatgtcgtgatgctgggcatggctggcgcagaccctgagcagctcaggaggttggctccaggaatggactccgttcagacgtttttcgccgtggatgacggcccatctttagatcaagcggtctccggactagccaccgctctgtgccaagcgtcatttactacacagcccaggcccgagccttgcccagtgtattgccccaaggggcagaagggggagccgggtgagatgggtctccggggtcaggttggaccccctggagacccaggtctacctggcaggaccggcgctcccggtcctcagggccctcccggtagtgcaacagcgaaaggggaaagagggttccccggtgccgacgggagaccaggctcacccggaagagcaggtaaccccggaacacccggtgcacccggactaaaggggagccctggattgccgggaccgaggggtgatccaggcgagcggggacccagaggtccaaagggagaacctggtgctcctggacaggtgatcggtggtgaaggtcctgggctcccaggcagaaagggggatccaggaccctcaggccctccaggcccaaggggacccctgggcgaccctggcccacgcggtccacccggacttccaggtactgccatgaaaggcgacaagggtgaccgaggagagcgcggtccccctggaccgggtgaaggcggaattgcacccggagagcctgggctgcctgggcttcctgggagcccgggtccacagggtcccgtcggaccacccggaaaaaagggcgagaagggtgattccgaagacggcgcaccgggtctgcccggtcagcccggttcccctggcgaacagggccctcgaggcccaccaggcgcaattgggcctaagggcgaccgaggcttcccaggtcccctgggagaggctggagaaaaaggcgagcgcggtccgcctggtcctgccggaagccgagggctacccggagtcgccggacgacctggcgcaaagggccctgagggaccgccagggcctaccggcagacaaggcgagaagggagagccgggaaggcccggagatcccgcagtggtgggtcccgcagtcgctgggcctaaaggggaaaaaggtgacgtagggcctgctggcccacgtggcgctacgggcgttcagggtgaaagaggtccacctggcctagtgctccccggtgaccctgggcctaaaggcgatccaggagataggggccctatcgggttgaccggacgagccggtcctcctggagatagcggtccgcctggcgagaaaggagatccaggtcgaccgggaccgccaggtccagtgggcccacgaggcagggacggagaggtaggtgagaaaggtgacgagggccctcccggagacccagggctgccaggaaaagccggtgagcgtgggcttcggggagcacccggtgtgcggggacccgtgggagagaagggagaccagggggaccctggtgaggatggccgaaacggctccccaggcagctccggcccaaagggcgatcgcggtgaacccggaccacccggaccaccaggacggctcgtggacacaggcccaggtgccagggaaaaaggggagccaggcgatcggggtcaggagggaccccgtggtcccaaaggcgaccccggattgccaggcgcacctggggagcgcggtatcgagggatttaggggacctccgggaccgcagggggaccctggagtcaggggtcctgctggcgagaagggcgaccgaggaccaccgggactagacggaaggtcggggctcgacggcaagccgggagccgctgggccaagcggcccaaacggggctgcaggcaaggccggtgaccccggaagggatggccttcccggactgaggggggaacaggggctgcctggaccttccggacctcctggcttgcccggaaaacctggcgaggatggtaagcctggcttgaatgggaagaacggagaacccggtgaccctggtgaagacggacgtaagggtgaaaaaggagattcgggggcttctggaagagaaggtagggatggacctaaaggcgaacgcggagcgccaggtatccttggacctcagggaccccctggcctgcccggacccgtgggaccaccagggcagggatttccaggtgtacccggagggacaggcccaaaaggtgaccggggagaaactggctctaagggcgagcaaggactgcccggtgaaagaggcctgaggggtgagcctggctctgtccccaacgttgatcggttgctggaaacagcagggatcaaggcaagcgcactgcgcgagattgtggaaacatgggacgaatcaagtgggtcctttttaccagtgcctgaaagaagacgcggacctaaaggagatagtggtgagcaaggcccacctggaaaggaaggccctatcgggtttcctggagaaagaggccttaagggcgacagaggcgaccctggtccgcagggtcctccaggtctggccttaggtgaaagaggccctccaggccctagcggattggcaggtgaacccggaaaaccaggtatccccggactacctggaagagctggtggagtgggagaagcaggcagacctggcgaacgcggagagcgtggagagaaaggcgagcgaggcgaacaaggtagagatggccctccaggacttcctggcacccctgggccaccagggcctcccggacccaaggtgtctgttgatgaacccggaccaggactcagtggtgagcaaggaccgccaggtctcaagggtgctaagggggaaccaggatccaatggagaccagggccctaagggggaccggggagtccctggcataaagggggataggggagagccgggaccacgtggacaggatggaaaccccggtttgcccggagagcgagggatggccggacctgagggtaagcccggtctgcaagggcctcggggaccacccggtccagtggggggtcacggtgacccagggcctcccggagcacccggattggcaggcccagcagggccacagggtccctcagggctgaagggcgaacctggagagacgggcccacctggtcgaggtctgacaggccctactggtgctgtcggactgccgggacccccagggcctagtggcctggtcggaccgcagggatctcccggactacctggacaggtgggtgaaacagggaaacccggtgctcccggacgcgacggagcctcagggaaggatggggaccgtgggtcacccggagtaccagggtccccagggctgccagggccagtggggccaaagggcgaaccgggacccacgggcgctccaggacaagcggtggttggattaccaggggctaagggtgaaaaaggagcacctggaggcctagccggtgatttagtgggcgagccaggcgcaaagggggatcggggacttccgggtccacgcggagaaaagggagaggcagggcgtgccggagaacccggagacccaggagaggacggacagaagggtgcccctgggccaaagggcttcaagggggatcccggagtgggagtacctggcagtcccggtcccccaggacctcccggagtcaagggagatctcggcctccctgggctcccaggcgcacctggagtcgtgggctttcccggtcagaccgggccaaggggcgaaatgggccagcctggaccgtctggcgagcggggactggccggaccccctggcagagaaggcattccaggacccctgggacccccagggccacctgggtccgttggcccacccggtgcatccggcttaaaaggtgataagggtgaccctggggtcggactccccggtccaaggggggagcgcggagagcccggaatccggggagaagacggccgacccggtcaagagggcccaaggggtctaaccgggcctcctggatcacgaggagagcggggagaaaagggggacgtggggtccgccggtcttaagggagataaaggcgattcagctgtgatactaggacctcccggtccacggggagccaagggagacatgggcgagaggggcccacgcggactggatggggataagggacccaggggcgataatggagaccctggagataaaggatccaagggcgagccaggggataagggcagcgcgggattgcctggcctgagggggcttcttggcccacagggacagcccggagcagccggaatccctggcgaccccggttcacctggaaaagatggcgttcccggtattaggggagagaaaggcgacgtgggctttatggggccaagaggacttaagggggagcgaggtgtgaagggcgcttgcggtctcgacggcgagaagggggataagggggaggccggtccaccagggaggccagggctggcaggccacaaaggcgagatgggagagccaggcgtgcccggtcagagcggggctcccggtaaggaaggcctgatcggcccaaagggagaccggggtttcgatggtcagcctggtccgaagggggatcagggggagaaaggcgaaagggggacccctggtataggtgggttccccggtccctccggaaacgatggaagtgctggcccacctggccctccgggaagcgtgggccctcgaggaccggaaggcctgcagggccaaaagggcgagcggggaccacccggagaacgggtggttggagcaccgggagtgcccggagcacccggtgagcgcggtgagcagggacggcctggccctgctgggccaaggggtgagaaaggtgaagcagcactgaccgaggacgatatcagaggctttgtgcgccaggagatgtctcagcattgtgcctgtcaggggcagttcatagcttcgggttcgcgtccccttcccagttatgctgccgacacagctggctctcagctgcacgctgttccggtgctccgggtgagccacgctgaggaggaggagagggtaccgcctgaggatgatgagtacagcgagtattcggagtactctgtcgaagaataccaagatcccgaggcaccttgggactccgacgacccctgtagtttgcccctggacgagggttcttgcactgcctacaccctgcgctggtatcacagagccgttacaggtagcactgaagcgtgtcacccattcgtctacggaggatgcggcggtaatgccaacagattcgggactcgcgaggcgtgtgagcgtaggtgtccaccaagggtggtacagagccaggggactggcaccgcccaggactag

SEQ ID NO: 4302 - DNA, 8738 bp, Artificial Sequence
  Description of Artificial Sequence: Synthetic coding sequence
atgactctgcgcctcctagtcgctgccctgtgtgctggaattcttgccgaggcgccacgggttcgcgctcagcatagagagagagtgacttgtacccgcctttacgccgctgatattgtcttcctgcttgacggaagctcttctatcggcaggagcaactttagagaggtgcggtcctttctggagggactggtcttaccatttagcggggcagcgtcagcccagggggtgaggttcgcgactgtgcaatattccgacgatccgagaacagagtttggtctagacgctttgggatcaggaggggatgtgattcgggctatccgagagctttcctataaaggaggaaacacgagaaccggcgctgcgattctccacgtggcagatcacgttttcttgccccagctcgctcggccaggggtgcctaaagtatgtattttgattacagacggtaagagtcaggatctggtggatactgctgcacagagattgaagggccaaggcgtcaaactcttcgcagttggaatcaagaacgccgaccccgaagagcttaaacgagtggctagtcagcctactagtgattttttctttttcgtgaatgatttcagcatcctgcgcactctactccctctggttagtcgccgtgtctgcaccacagccggtggggtgcccgttacaagaccaccagatgatagtacttccgctccacgcgatctggtgctgtcagaaccgtcgagccagagtctccgggtgcagtggacagctgccagcgggcctgtcactggttacaaggtgcagtatactccactgacgggcctcggccagccgctgccatccgagcgccaggaagtgaatgtgcccgctggcgaaaccagcgtgcgcctcagaggactgcgcccactaacagagtaccaagtcacagtgattgctttatatgcaaacagcattggcgaagctgtctccggaacagcacgcacaaccgctctcgagggaccagagctaaccatccagaacaccaccgcacacagtttgctggtcgcgtggcgctctgttccgggtgctaccggctacagggtcacctggcgggtgctgtcggggggtcccacacagcagcaggaactgggaccaggacagggctccgttctgttgagagatctggagcctggaactgactatgaagtgactgtgagcaccctgttcggacgttctgtaggacccgctacatcactcatggcacgaacggacgcaagcgttgagcagaccttgcgaccagtgattctggggccaaccagcatcctgctcagctggaacctagtaccagaggcgaggggttatcggctcgagtggaggcgcgaaaccgggttagagcccccacagaaggtggtactccccagcgacgtaacacgatatcagctagatgggctgcagcccggtactgagtacaggttaaccctctacacactgctggagggccacgaggtggccacccctgctaccgtggttccgactggtccggaactgcctgtttctcccgtcaccgatctccaggcaaccgaactgcctggccagagggtgcgcgtatcttggtctccagtgcctggggcaactcagtatagaattattgtgcgctcgacccaaggagtagaaaggacactggtgctgcccggttctcagacagctttcgatcttgacgatgtgcaagcagggctgtcctatactgtcagggtttccgccagagttgggcctcgagagggctcagcatccgtgctgactgtgcgacgagagccagaaactcccctggcagttcctggtcttagggtagtggtcagcgacgcaacacgagtgcgcgtggcttgggggccagtacccggtgcgtctggcttccgcatttcttggtccaccggatctggccctgaaagcagtcaaacccttccgcctgatagtacagcgacagatattaccggcctacagcccggtactacataccaggtcgcggttagcgtgctcagaggccgagaggagggcccagctgctgtgatagttgcaagaacggatccactgggacccgtccgtacagtccacgtgactcaggcatcttcgtcgtcggtgacgattacctggacaagggtccctggcgcaaccggctatcgggtatcatggcacagcgcacatgggcctgagaagagccagctagtctccggagaagccacagtagccgaacttgacggactcgaacccgacacagagtatacggtccatgttcgcgctcacgtggccggagtggatggtccaccggcatctgtggtggtgaggacggctccagagcccgtgggcagagtgtcccggcttcaaatactgaatgcatctagtgacgtgctcaggattacatgggtgggtgtaaccggcgctactgcctacaggctagcatggggcaggagtgagggcggaccaatgcgtcaccagatactccctggcaataccgatagtgccgagattaggggccttgagggcggtgtgagttatagtgtgcgggtgactgccctggttggggacagagaagggactcccgtctctatcgtggtcaccaccccaccggaggctccaccagcacttggcacactgcacgtagtccagcgcggagagcactctctgcggctgcgatgggagcctgtgccccgagcccagggatttctgctgcattggcagcctgagggaggccaagagcagtctcgtgtgcttgggccagagctgtccagttaccacctggatggactggagccagctacccagtacagagtcaggctttcagtgttagggccagcgggtgaagggccttcagccgaggtgacggccagaacggaatcacctcgcgtgccgtctatcgaactccgtgtggtagatacgtctatcgactctgtcacgctggcctggactcctgtatctagggcgtcttcgtacatcctgagctggaggcccctgcgcggaccaggccaggaagtcccagggtcccctcagactctccctggcataagctcttctcagcgcgtgacagggttagagccaggcgtgtcttacatcttctccctcacacctgttctggatggtgtgcgcggacctgaagcatcggttactcagaccccggtctgtccgcgtgggttggctgacgtcgtctttctgccacatgccacccaggacaatgcacatcgggcagaagccacacgtcgcgtactagaacggctggtgctggcgctcggtcctctcggtccgcaagcagtccaagtgggcctgttatcctactcacatcgtcccagtcctcttttcccccttaacggtagccacgacctcggtataatactgcaaaggatccgggatatgccttacatggaccccagcggcaacaatctgggcacagctgtcgttactgcccataggtatatgcttgctccagacgctccgggtcggcgacagcacgtaccaggcgtgatggttttgcttgtcgatgagccactaaggggcgatatcttttcaccgattagagaggcccaggccagcggcttgaacgttgtcatgctcggtatggcaggcgcagatcccgagcagttgcgacgcctggctcccggaatggattcagtgcaaacattctttgcagtggatgacggtccctcgttggaccaggctgtgtccggactggcgacagctctgtgccaggcttcattcactacacaacctcgcccagaaccctgtcctgtgtattgccccaagggccaaaagggcgagcctggtgagatgggtctgagaggccaggtgggacctcctggggacccaggcttgcccggacgtacaggagctccagggcctcagggcccacctgggtctgctaccgccaaaggtgagcggggatttcctggggcagacgggagaccaggctcacctggcagagcaggcaacccgggtactcccggtgctcccggtctcaaagggtcacctggccttccaggccctcgaggagaccccggtgagagggggccacgcggacccaagggagaaccaggcgcacctggacaggtgatcggaggagagggccctgggttgcccggtcgaaagggggaccccggaccttcgggcccaccaggacctagagggcctctgggcgatccaggcccacggggtcctcccggattgcccggaactgccatgaagggcgataaaggagaccgcggagagaggggcccacccggaccaggcgaggggggaattgcgcctggtgaacccggacttcccggactacctggcagccctggtcctcaaggccctgtgggaccaccgggtaagaagggcgagaagggagactccgaagatggagctccaggcctcccagggcagcccggttccccgggtgaacagggcccacgcggaccacccggagccattgggccaaagggcgacaggggcttcccgggacctcttggagaagccggtgagaagggcgaaaggggtcccccaggcccagctggatctagggggcttcctggcgtagccggacgacctggcgcaaaaggtcccgagggccctcccggaccgacaggacggcaaggagaaaagggtgagccgggaagacccggtgatcccgctgtggttggccctgctgtcgcaggaccaaaaggcgaaaagggagatgtgggccctgcagggccaagaggcgctactggcgtgcaaggcgagaggggcccacccggattggttctccctggagatccgggaccaaagggtgatcctggcgacagaggacccatcggacttacaggacgtgcaggcccaccgggtgatagtggcccaccaggggagaaaggagatcctggcaggcctggtcctccgggacccgtgggaccgaggggcagagacggtgaagtgggtgaaaagggggatgagggccctcccggagatcctggtctgcctggcaaagccggtgagcgcggactacgaggagcccctggggtcagaggaccagtcggcgagaagggcgaccagggagatccgggtgaggacggcaggaatggcagccctggatctagcgggcctaagggtgatagaggcgaacctggccctcccggacctcccggtaggttagtcgatacaggaccgggtgcgagggaaaaaggggaacctggtgaccgaggacaagaggggccacgagggcctaagggcgaccctggcctgcccggtgcccctggagaacggggaattgaaggattcagagggccaccagggcctcagggagaccctggagtgcggggaccagcaggtgagaaaggtgacagaggcccaccaggattggacggcaggtctggactggatggcaaacctggcgctgccggtcccagtggccctaatggggctgccggtaaagcaggtgatccagggagagacggcttacccggactccgaggcgaacaaggtctgccaggaccctcggggccacccggactgccgggaaagcctggcgaagacggaaaacctggtttgaatggaaagaatggcgagccgggtgatccaggggaagatgggaggaagggtgagaaaggagacagcggtgcctcaggccgtgagggattcccaggggtgcccggtggtacaggtccgaaaggtgatcgtggcgaaacaggttcaaaaggtgagcaggggctccctggagagcgtggcttaagaggggagccaggatccgtgcccaacgtagacaggctgctggagaccgcgggaattaaagccagcgccctcagagagattgtcgagacatgggacgaatccagtggaagtttcctgccagttccagaaagacgcagaggtcctaagggcgacagcggggagcaaggccctcctggcaaggaaggtcccattggctttcctggagaacgcggactgaagggagaccgaggtgacccaggaccccagggccctccagggctcgctctcggcgagcgcggtccgccaggcccatccggccttgcaggcgaacctggcaagccgggtatccccggactgcctgggagagctggaggtgttggagaggcaggcaggccaggcgagcgcggtgaaaggggggagaagggagaacgaggcgaacaagggagggatgggcctccgggactgcctggcactccaggtccacccggacctcctggtcccaaggtctctgtcgacgagcctgggccagggctgagtggggagcaaggtccccctggcctcaaaggggcaaaaggcgagccgggtagcaacggcgaccagggtcctaaaggcgacaggggagtcccaggcattaagggagatcgcggagaacccggacccagggggcaggacggaaatccagggctgccaggggagagaggaatggctggcccagagggtaagcccggtctgcaaggccctagggggccacctgggcctgttggaggccacggagacccaggcccacctggtgcccctgggctagctggcccagccggaccacagggccctagcgggctgaagggggaacctggcgaaactggacctcccggtcggggactgaccgggccaaccggcgctgtcggtctgccgggacctcctggcccttccggtctggtgggtccgcaggggagcccgggactcccaggacaggttggggaaaccgggaagcccggtgcccctggccgagatggagcatctggaaaggacggcgacaggggctcacctggcgtgcccggttcgcctggcctacctggcccagtgggaccaaagggagaaccagggccaacaggtgcaccgggacaggccgtcgttggtctgccgggagcaaaaggagagaaaggcgctcctggcggtctggccggagaccttgtcggggaacctggcgctaagggtgaccgaggcctgccagggccaagaggcgaaaaaggagaagccggacgagccggagagccaggggatccaggcgaagatggccaaaaaggggcacccggtccgaagggatttaagggggaccccggtgtgggggtgcccggatctcccggacctccaggtccgccaggtgttaaaggtgatctgggacttcctggtctgcccggagcccctggtgttgtaggatttcctggtcagaccggaccgaggggggagatgggtcagcccggaccctctggtgaacggggattagccggacctcctggcagggaggggatcccaggacctctcggcccacccggtccacctggttcagtcggacctcccggtgcatccggactgaagggcgacaaaggagatccgggagtcggattacccggtccacgtggagagaggggagagccaggcattcggggtgaggatggcaggcccggacaagagggaccaaggggcctcaccggaccgccaggatcgcgcggtgagcgtggagagaagggagacgtcggatctgcaggcctgaagggtgacaagggcgactccgcggtgattctgggcccaccagggccaaggggggcaaaaggtgatatgggggagcggggtcccagaggactggacggcgacaaaggacccagaggtgataatggggaccccggtgacaaaggctcgaagggggaaccgggagacaaggggtccgctggactgccgggactccggggactcctcggacctcagggacagcccggagctgctggcattccgggagacccaggatcgcctgggaaggatggcgtccccggaatcaggggagagaagggagacgtgggattcatgggccctcgagggctcaaaggcgagcgtggggtgaagggcgcttgtgggctggacggagagaaaggagataagggtgaggctgggcctccagggagaccgggactggccggtcacaaaggagagatgggagagccgggtgttccgggacagtctggtgcccctgggaaggaggggctgattggcccaaaaggcgatagaggattcgatgggcagccgggtccaaagggcgaccagggagagaagggcgaacgtggcaccccaggcattggcggatttcccggaccgagtggtaatgacggctccgccggaccaccagggccaccaggctcggtgggcccaagaggacccgagggcctgcagggacaaaaaggcgagcgcggaccccctggcgagcgcgttgtgggtgctccaggggtgcccggtgccccaggagaaaggggcgagcaagggagaccgggtccggcagggccaagaggtgagaagggcgaggctgccctgacagaggacgacatacgaggtttcgttaggcaagaaatgtcgcaacactgcgcctgtcaagggcagttcatcgccagtggaagtcgtccactgcccagctacgcggcagatacggccggatcacagctccacgcggttccagtgctgagggtgagccacgccgaagaggaggagagagttccccctgaggatgacgaatatagtgaatactcagaatacagcgtagaagaataccaggaccctgaggcaccttgggattcagacgatccctgtagtctcccactggatgaaggatcctgcacggcctacaccctgcggtggtatcatcgggctgtcacggggtctactgaggcctgtcatccgtttgtgtatggaggctgcggaggcaatgcgaatcgatttggcacccgggaggcctgcgaacgcaggtgccccccacgcgtggtacaatcccagggaacagggacagctcaggatta

SEQ ID NO: 4303 - DNA, 435 bp, Artificial Sequence
  Description of Artificial Sequence: Synthetic coding sequence
atgtggctgcaatcgttactccttctgggaaccgtggcctgtagcataagtgctccagctagaagcccttccccatccacccaaccatgggagcacgtgaatgctatccaggaggcccgacgcctcctgaatctgagtcgcgacactgcagccgagatgaatgaaaccgtggaagtgatcagtgagatgttcgatctccaagaaccaacttgcctgcagaccagattagagctgtataagcaggggctgagaggatcgctcacaaaacttaaaggtcccctaacgatgatggcgtcgcattacaagcaacactgtcctcctacccccgaaacatcgtgtgctacgcagatcattacattcgagagctttaaggaaaatctaaaagacttccttctcgttattcctttcgactgctgggagcccgtgcaggaatag

SEQ ID NO: 4304 - DNA, 1218 bp, Artificial Sequence
  Description of Artificial Sequence: Synthetic coding sequence
atggaagctagcttcgtgcagacgacgatggcattgggtcttagctcaaagaaagccagctcccgcaatgtggccgtcgagcgaaagaacctaattaccgtgtgtaggttctcagtaaaaacactactggaaaaatacactgcagaacctattgatgattcttcagaagagttcgtgaatttcgccgcaattctggaacagatccttagccaccgttttaaagcttgcgcacccgctggcccagtgtcctggttcagctcggacgggcagagaggattctgggactacataaggctggcatgtagtaaagtgccgaataattgcgtctcaagtatagagaacatggagaatatttcaacagccagggctaagggccgagcttggatccgcgtggcacttatggaaaagaggatgagtgagtatatcaccacagctctgagagacacacgtaccacgcgaaggttctacgactccggtgcaatcatgctgcgagatgaagcgacgatcctaactgggatgctcatcggactgagcgccatcgactttagcttttgccttaaaggggaagtcctggatggcaaaacacccgtagtgattgactacaccccatacctgaagtttactcaaagttacgattacctgacggacgaggaggagcggcatagtgcagaatcttctacctccgaggacaactcgcctgagcatccgtatttgcctctggttaccgacgaggactcatggtactcaaaatggcacaagatggagcagaaatttcggatcgtgtatgcgcagaaagggtacctagaggagctggtgcgccttagggagtcccaacttaaagatctggaagccgagaatcggcgactgcagttgcaactggaagaagccgctgcccagaatcagcgcgagaagagagaactggagggcgtcatattggagctccaggagcagctcaccggactgatcccctccgaccacgcacctttggctcagggtagtaaagaactgaccactccactcgttaaccagtggccctctctcggcacgctgaatggagccgaaggcgcatctaatagcaagttatatcgtagacactcctttatgagcacagaaccactttcagccgaggcatccctaagcagcgattctcaaaggttgggcgaaggtactagagacgaggaaccttggggtcccattggcagcagtgaacccaattag

SEQ ID NO: 4305 - DNA, 603 bp, Artificial Sequence
  Description of Artificial Sequence: Synthetic coding sequence
atgtcgcccgaacctgccctttctcctgcgctccaactgctgctgtggcattctgccctctggaccgtccaggaggcaacccccctgggccctgcctccagcctccctcaaagttttctccttaagtgtctcgaacaggttagaaagatccaaggggatggggctgctcttcaagaaaaactgtgcgcgacttacaagctgtgtcatcccgaggagctggtcctgctgggacacagcctgggtattccctgggccccactatcttcttgtccttcccaggctttgcaattagctggttgtctgagccaactgcattctggcctttttttgtaccaaggactcttacaggcactcgaggggatttccccagagcttggcccaaccctggatactcttcaattggatgtcgccgattttgccacaaccatttggcagcagatggaagaacttggtatggctcccgctctgcagccaacacaaggcgcaatgcctgctttcgcctccgcctttcagcggagagctgggggagtactggtggcttctcatctccaatcatttctcgaggttagttatcgggtcctgcggcacctggcacagccttag

SEQ ID NO: 4306 - DNA, 516 bp, Artificial Sequence
  Description of Artificial Sequence: Synthetic coding sequence
atggccggacccgctacccagtctccaatgaagctcatggcactccagctccttttgtggcacagcgccctgtggactgtgcaggaagctacacctctgggacccgctagctctctgccacaaagttttctcctcaaatgtctggagcaggttcgtaagattcagggcgacggtgccgctctccaggagaaattagtgtctgaggcgggttgcttatcccaactgcattcaggcttatttctgtatcagggtctgttacaggccctggaagggatcagcccagagctggggcctaccttagacaccctacagctcgacgtggccgactttgccacaaccatctggcagcagatggaggaattgggcatggcaccagctttgcagcccactcaaggagcaatgccagcgttcgcgtctgcatttcagagacgggctgggggagtcttagtggccagccatttacaatcgttcctcgaggtgtcgtaccgagtactgcggcatttggctcagccctag

SEQ ID NO: 4307 - DNA, 615 bp, Artificial Sequence
  Description of Artificial Sequence: Synthetic coding sequence
atggctggacccgcaactcagtcgccaatgaaactgatggccctgcagctgctgctgtggcactctgcactttggaccgtccaggaggctacaccccttggtcctgcctctagtctgccccagagtttcttacttaagtgtctggagcaagtgcgcaaaatccaaggagatggagcggcactgcaggaaaagttgtgcgccacctataaactatgccatccagaggaactggtgctgctcgggcatagcttgggtattccctgggctccactgtctagctgccccagccaggccctgcagctcgcaggttgcctgtcacaactacactcagggctatttctgtaccaaggactcctccaagctctggaggggatatcccccgagcttggtcccaccctagacacactgcaactggatgtggctgatttcgcaacaacgatctggcagcagatggaagaactgggcatggcaccagccttacagcctacccagggcgcaatgcctgcattcgcctccgcgtttcagcgtagggccggaggtgtcttggttgccagtcatctgcagtctttcctagaagtgtcttacagagtcctgaggcatttggcgcaaccatag

SEQ ID NO: 4308 - DNA, 3696 bp, Artificial Sequence
  Description of Artificial Sequence: Synthetic coding sequence
atgcgcctgcttgctaagattatatgcctgatgctctgggctatatgcgtcgccgaggattgtaacgaactgcccccacgacgcaacaccgagatccttacgggctcatggagtgatcagacgtatcccgagggaacccaggctatctataaatgtagaccaggctatcgctctctcggaaacgtgattatggtgtgtcggaaaggagaatgggtggcgctgaatcctcttcggaagtgtcagaaaagaccttgcggacatccgggagatacaccatttggaacttttacacttacagggggaaacgtgttcgagtatggagtcaaggccgtgtatacatgcaatgaaggctaccaactattgggagaaatcaactacagggagtgtgatactgatggatggaccaacgacatcccaatttgtgaagtggttaaatgtctgccggtgacagctcctgaaaacggaaagatcgtgagttcggccatggagcctgatagagaataccatttcggacaagccgtgagattcgtgtgtaattccgggtacaagattgagggcgatgaggagatgcattgtagtgatgatgggttttggtcaaaagaaaaaccaaaatgcgtggagatttcatgcaagtcccctgatgtgatcaacggaagccccatctcacagaagattatctacaaagagaacgagaggtttcagtataagtgcaatatggggtacgagtacagtgagaggggggacgcagtgtgcaccgagagtggatggcggcctctgcctagttgtgaggagaaatcatgcgataatccatatatccctaatggagattactctcccctcagaataaagcaccgcacaggagacgagattacctaccagtgtcgtaacggcttctaccctgccacgagggggaatacagccaaatgtacatccacgggatggatacccgctccaagatgcaccctgaaaccctgcgattatccagatataaagcacggtgggctttaccatgaaaatatgcgtcgtccatactttcccgtcgctgtgggcaaatattacagctactattgcgatgagcattttgagacaccaagcggttcctactgggatcacattcactgcacccaggacggctggagccccgctgtcccttgccttcggaagtgctatttcccataccttgagaacgggtacaaccaaaaccacggacgcaaatttgtccagggtaaatccattgatgttgcctgtcatcccggatacgccttaccaaaagctcaaacgacagttacctgcatggaaaacgggtggtcaccgacgcctaggtgcatccgggtcaaaacctgctctaaatcctccatcgatattgagaacggcttcatcagcgagagtcagtatacctacgccctgaaagagaaagccaagtaccagtgcaaactgggttacgtgacagctgacggggaaaccagcgggtcaatcacatgcgggaaggatggctggtcagctcagcctacctgcattaaatcttgtgacatcccagtatttatgaacgccaggacaaagaatgattttacctggtttaagctgaacgacacccttgattacgagtgtcatgacggatatgaatcaaacacaggatctacaactggctcaatcgtatgcggttacaacggttggtctgatctccctatctgctatgagcgcgagtgtgaactgcccaaaatcgacgttcatctggtgcccgatcgcaagaaggaccagtataaagtcggtgaggtactgaagttcagttgcaagccgggtttcacaatcgtggggcctaatagcgtgcagtgctatcacttcgggctgagtcccgacttgcctatctgcaaggaacaagttcagtcctgcggccctccacctgaattgttgaacggtaatgtcaaggaaaaaacaaaggaggagtatggtcactcagaggtagtagaatactactgtaacccacgttttctcatgaaggggcctaacaagatccagtgtgtcgatggcgagtggactacactgcctgtttgtatcgttgaggagagtacctgtggggacatccccgagttggaacatggttgggctcagctaagctcacctccatactactacggggactcggtggaatttaactgctcagaaagcttcacaatgattgggcatcggtccatcacctgtattcacggagtgtggacgcagctacctcaatgcgtggctatagacaaactgaagaagtgtaaatccagcaatctcattatcctcgaagaacacttgaagaacaaaaaagagtttgatcataactcaaacattcgctaccgctgtcgaggtaaagaaggctggatccatacagtctgtatcaacggtcggtgggatcccgaggttaattgctctatggcacagatccaactgtgtccaccacccccacaaatcccaaattctcacaacatgactacgactcttaattatcgggatggcgagaaggtgagcgtgctgtgtcaagagaactacttaattcaggagggagaggaaattacctgcaaagatggcagatggcagtctatccccctgtgcgtggaaaaaatcccatgtagccagcctccccagatcgaacatggtactataaacagttcgagatctagccaggagtcttacgcacacgggacgaaactgtcctatacttgtgagggcggattccggatctccgaagaaaacgaaaccacctgttatatgggcaaatggagcagccccccacaatgcgaggggttgccctgcaaatcacctccagagataagccacggagttgtggctcacatgtcggattcttaccagtacggcgaggaggttacatataaatgcttcgaggggttcggcattgacggcccagccatcgcaaagtgcctgggtgagaaatggagtcaccccccatcttgtataaaaaccgactgtttaagtctgcctagcttcgaaaatgccatcccgatgggtgagaaaaaagacgtgtataaggccggtgagcaagtcacatacacctgcgcaacgtactacaagatggacggagcctcaaatgtaacatgcatcaatagccgttggactggcagaccaacgtgccgggatacaagctgcgtaaaccctccaactgtccagaacgcttacattgttagccgccagatgtccaaatacccgtcaggtgaacgagtacgctatcagtgtagatcaccctacgagatgtttggcgatgaagaagtgatgtgcctaaatgggaattggacggagccccctcaatgcaaagattcaacaggaaaatgcgggccaccgcctcccattgataatggggatattacttcatttcctctgtcagtctacgctcctgctagctccgtagagtaccagtgtcagaatctgtaccagctggaagggaacaaacgaattacatgccgcaatggacaatggtccgagccaccaaagtgtttacatccctgcgtgatctcccgcgagatcatggagaattataacattgctctgaggtggaccgctaaacagaaactgtatagcagaacaggtgaatccgtcgagtttgtgtgtaaacgaggctaccgcttatccagcaggtcccataccttgcgcaccacctgctgggatggtaagttggaatatcctacctgtgccaagaggtag

SEQ ID NO: 4309 - DNA, 1350 bp, Artificial Sequence
  Description of Artificial Sequence: Synthetic coding sequence
atgcgactcctggcaaagatcatctgcttaatgctctgggccatctgtgtcgccgaggactgtaatgaacttccacccagaaggaatacagaaatcctgactggctcctggagcgatcaaacctatcccgaaggtactcaggctatctataagtgtaggcctggctaccgatccctcggaaatgtcattatggtgtgccgaaagggcgagtgggtggctctaaacccactgcggaaatgtcaaaaacgtccgtgtggccacccgggtgatactcctttcgggacattcacactaaccggcggtaacgtgttcgagtatggcgtcaaagccgtgtacacttgcaatgagggctatcagctcctaggcgagataaattatcgcgagtgcgacactgatggctggactaatgatatcccaatttgcgaagtggtgaaatgtctgccagtgacagcccctgaaaacggcaaaatagtgtccagtgctatggagcctgacagagaatatcatttcggacaggcggtccgtttcgtgtgtaatagcggctataagattgagggcgatgaagaaatgcactgttccgatgatggcttctggtctaaggagaagcctaagtgcgtcgaaatttcctgtaagtcccccgacgtgatcaacggtagtcccatcagccaaaaaattatatataaggagaatgaacgtttccagtacaagtgcaatatgggttatgaatacagcgaacgcggagacgccgtgtgtacagaaagtggttggagaccactgcctagttgtgaggagaagtcatgcgataacccgtacattccaaacggggactactccccactgagaatcaagcatagaaccggtgatgagatcacctatcagtgcagaaacggcttttatcctgctacacgcggaaacacagctaagtgtacatcaaccggatggattccggcaccacggtgcaccttgaaaccctgcgactatcctgatatcaagcacgggggtctctatcacgaaaacatgagacggccatatttcccagtggcagtgggaaaatactattcctactactgtgacgaacactttgagacacctagcggcagctactgggatcatattcactgcacccaggacggctggagtccggctgttccgtgcttgcggaagtgctacttcccttatttggagaacggatataatcagaatcatggccgaaaatttgttcagggtaagagcattgacgtggcctgccatcccggttatgccctgcccaaggcccaaactaccgtgacgtgtatggagaatgggtggtcaccaacccctcggtgtatcagagtgattttccagttgtag

SEQ ID NO: 4310 - DNA, 1350 bp, Artificial Sequence
  Description of Artificial Sequence: Synthetic coding sequence
atgagactcttagctaagataatctgtctgatgctgtgggctatttgcgttgcggaggattgtaatgaactccccccacgcagaaacacggaaattctcactggctcctggtcagatcagacttacccagaagggacccaagccatctacaagtgccggcctggctatcggagcttgggcaatgttatcatggtgtgtagaaagggagaatgggtagcgctgaatccacttagaaagtgtcagaaacgtccctgcggccatccaggcgatacaccctttggaaccttcacactcacaggcggtaatgttttcgagtatggagtgaaggccgtctatacttgcaatgagggctatcagctgctgggggagatcaattacagagagtgtgacacagacggctggaccaatgatatccctatatgcgaggttgtgaaatgcttgccagtcactgccccagaaaacgggaagattgtctcctctgccatggagcccgaccgggaataccacttcggccaagccgtgcggtttgtgtgcaattcaggctataagatcgaaggggatgaggaaatgcactgctccgacgatggattctggtctaaggaaaagcccaaatgtgtagaaatcagctgtaaatctccagatgtgatcaatggatccccaatctcccaaaagattatctataaggagaacgaacggtttcaatacaagtgcaatatgggatatgaatacagcgagcggggagatgcagtgtgcaccgaatcaggctggagaccccttccatcatgtgaggagaagtcgtgtgataacccctacatccctaatggggattacagtcctcttcgtataaaacaccggactggcgatgagatcacgtaccagtgcagaaacggattctaccccgcaaccagggggaatacggctaaatgtacatcgacgggatggatacctgcaccacgatgcactctgaagccctgcgattaccctgatattaaacacggaggtctgtaccacgaaaatatgagacgaccgtatttccctgtcgctgtcgggaagtactacagctattactgcgacgaacactttgagacaccgtcaggcagctattgggatcatatccattgcacccaggacggctggagtccagccgttccttgtctcagaaaatgctatttcccttacctcgagaatgggtataaccagaaccacggacgtaaattcgtacagggtaagtcgattgacgtggcttgtcatccaggctacgccttgcctaaggcgcaaacgacggtgacatgcatggaaaacggatggtcacctacgcctaggtgcatccgcgtatcttttactctatag

SEQ ID NO: 4311 - DNA, 573 bp, Artificial Sequence
  Description of Artificial Sequence: Synthetic coding sequence
atggccgcaggcgagctagagggcggtaagcctctgagcggcttgcttaacgccctagctcaggataccttccacgggtatccgggaataaccgaggaattgctccgcagtcagctgtaccccgaagttcctcccgaggagtttaggcccttcttagccaagatgcggggtatcctcaaaagcattgcgagcgcagatatggatttcaaccagctagaagcctttctgacggcacagacaaagaagcagggcggtatcacaagtgaccaggccgctgtgattagcaagttctggaaatcgcacaaaactaagatccgggagtctctgatgaaccagtccagatggaattctggtttgcggggactgtcttggcgtgttgacggcaaatctcaaagtcgtcattccgcccaaatacacaccccagtcgcgattatcgaactggaactgggaaaatacggccaggaaagcgagtttctgtgtctcgaattcgacgaagtgaaagtaaatcagatcctgaagaccctgtctgaagtcgaggaaagcatcagtacactcatctcccaacccaactag

SEQ ID NO: 4312 - DNA, 117 bp, Artificial Sequence
  Description of Artificial Sequence: Synthetic coding sequence
taacaagaatcagaatttctgtgcctcgagttcgacgaggtgaaggtgaaccaaatcctcaaaaccctgtcagaagtcgaagaatctatctctactttgatcagccagcccaattag

SEQ ID NO: 4313 - DNA, 99 bp, Artificial Sequence
  Description of Artificial Sequence: Synthetic coding sequence
tgatgcctggaatttgatgaggtgaaagtgaatcagattttaaagaccttatccgaagtggaggagagtatttcaaccttaatctcccagccaaactag

SEQ ID NO: 4314 - DNA, 117 bp, Artificial Sequence
  Description of Artificial Sequence: Synthetic coding sequence
tagcaagagagtgagtttttgtgtctggagttcgacgaggtcaaggtaaaccagatcctgaagacattgagtgaggtggaggaaagtattagcactctgatttctcagcctaactag

SEQ ID NO: 4315 - DNA, 480 bp, Artificial Sequence
  Description of Artificial Sequence: Synthetic coding sequence
atggcagctggggagcttgagggtgggaagccactgtccgggctcttaaatgctttggctcaagacacattccacggatatccgggaatcaccgaggagctgctgcgatcccaactctaccccgaggtgccacctgaggagttccgtccattcttggctaaaatgaggggcattctgaaatcaatcgctagtgccgatatggatttcaatcagttagaggccttcctgaccgcccagactaaaaagcagggcggaattacatctgaccaagccgctgtgatttcaaagttctggaagtcacacaagaccaagatcagagagtccctaatgaatcagtcacggtggaatagtggtctccgaggcctgagttggagagttgatggcaagtctcaaagccgacattcggcacagatacacaccccggttgctataattgaattggagctgggaaaatacggtcaagtccattgtaaccagtag

SEQ ID NO: 4316 - DNA, 591 bp, Artificial Sequence
  Description of Artificial Sequence: Synthetic coding sequence
atgcgtcttccgttgcttgtgtctgccggagtattattggtggctctgctgccttgtcctccatgcagggcactgctctcccgaggcccagtaccaggagctcgacaagccccacagcacccccagccccttgatttcttccagccaccccctcagagtgagcagccacagcagccccaggccagacctgtccttctccgtatgggcgaagaatactttctcagactcggaaacctgaacaagagcccggctgcccctctatcgccggcttcatccctcctagccggaggcagcggctcacgcccttccccagaacaggctaccgccaattttttccgggtgctactgcagcaactactgctgccacggcgaagtcttgactctcccgctgcccttgcggagagaggagcgcgaaatgctttgggcggacatcaagaggctcccgaaagagagcgcaggagcgaagagcctccaatctcattagacctcaccttccatctgctgagagaggtgctcgaaatggcaagggctgaacaactcgctcagcaggcccacagtaatcggaagctgatggagatcatcggcaagtag

SEQ ID NO: 4317 - DNA, 4443 bp, Artificial Sequence
  Description of Artificial Sequence: Synthetic coding sequence
atgcagcggagtcccctcgaaaaggcatctgtggtttcgaagctgttcttttcctggacccgcccaatactcaggaagggttaccggcagagattggagctgagcgatatttatcagatcccaagcgtggactctgccgacaatctttccgagaagcttgagagggaatgggatcgggagctcgctagcaaaaagaacccaaagctaataaacgctctacggcgatgtttcttttggaggtttatgttctacggaatattcctctacctcggcgaagtgactaaagccgtgcagcccctactgctgggacgcattatcgcttcatatgaccctgataacaaggaggaacggagcatcgccatctacttagggatcggactctgcctgctcttcattgtccgaactctgttacttcatcccgcaatctttggtctgcatcacattgggatgcaaatgaggattgctatgttttcgctgatttacaaaaagacgctaaaactttcaagcagggtcctcgacaagattagcataggacagctggtcagccttctgtcgaacaacctgaacaaattcgatgagggactagccctggctcacttcgtgtggatagcgcctctgcaggtggcccttctgatggggttgatatgggaactactgcaggccagcgcgttttgtggcttgggctttctgatagtacttgccttatttcaagctggtctgggacgcatgatgatgaaatatcgggaccagcgagccggtaagatcagcgaacgactggttatcacctctgaaatgatagaaaatatccagagcgttaaagcttactgctgggaggaagcaatggagaagatgatcgaaaacctacgccagacagaattgaagctgacccgtaaggccgcttacgtgaggtacttcaattcgtccgccttttttttttcaggctttttcgtggtcttcttaagtgtattgccttacgccctgattaaggggatcatcttaagaaagatctttactactatttctttttgtattgtcctaaggatggctgttactaggcagttcccctgggctgttcagacctggtatgatagcctcggagcaattaataagattcaggatttcctgcagaaacaggagtacaaaactttagaatacaaccttactacaacagaagtagtgatggagaacgtcacagctttttgggaagagggattcggtgaactctttgagaaggcaaaacagaacaataataatcgaaaaacctcaaacggtgatgattctctgttcttcagcaacttctctctgctcgggactccagtactgaaggatatcaattttaagatcgaacgtgggcaactgcttgccgtagcaggctccactggtgctggcaagacctccttgcttatggtgattatgggagaactagaaccgtccgagggcaagataaagcattccgggaggatatcattttgtagtcagttcagctggatcatgcctggtactataaaggaaaacatcattttcggggtttcttacgatgagtaccgatacaggagcgtgattaaagcgtgccagctggaggaggatatatcaaagtttgccgagaaagataatatcgtcctcggcgaaggcggtatcaccctgtcagggggtcaacgggcacggatcagtctagcacgcgctgtttacaaggacgctgatctgtatctgctggactcgcctttcggctatctggatgtgctcacagagaaggagatattcgagtcctgcgtgtgtaagctgatggctaacaagacacggattctcgtgacgtccaagatggaacacctgaagaaggcagataagatcctcatattacacgagggtagcagttacttctatggaaccttcagcgagctgcagaatctgcagccagactttagctctaagctgatgggatgcgactcctttgaccagttctctgccgagcgccgaaattccatactgaccgagacacttcacaggttttcactggaaggagacgctcctgtctcctggactgagactaaaaagcagagctttaaacagactggggagttcggcgaaaagaggaaaaatagcatcttgaatcccattaacagtatacggaaatttagcatcgtccagaagacccctctgcagatgaatggcatagaggaagattcagatgagccacttgagagacggctgtcgctggtaccagactccgaacaaggcgaggccatactgccccgaatctccgttatctccactggtcccacattgcaggcacggaggagacaatccgttttgaacctgatgacacattcagtgaaccagggccagaatatacatcgaaagacaacggccagcaccagaaaggtgagcctggctccgcaggcaaatttaaccgagctcgatatatattcccgtcgtttgtcccaggagactgggcttgaaatcagcgaagaaatcaacgaggaggatctgaaagaatgctttttcgacgatatggaatccattcccgctgtaactacctggaacacctacctgcgctatattaccgtgcacaaatcacttattttcgtgctgatctggtgcctggtcatctttctggctgaagtcgccgcttcacttgttgtgctttggctgcttggaaacaccccccttcaggataagggcaatagtactcatagtcggaacaactcctacgctgtaatcatcacttctacatcatcttactatgtattctacatatacgtaggtgtggctgacactttattggccatggggtttttccggggattaccactggtgcacacactcatcaccgtgtctaaaatactccatcataagatgctgcacagtgtgctgcaagcccctatgtcaactcttaacaccctcaaagccggagggatactgaatcgtttctctaaggacattgctattctggacgatctgttgcctcttaccatctttgactttattcagctcctgctgatcgtgatcggagcaattgcagtggtagctgtgctgcagccatatatctttgtcgctacagtgccagtcatcgtggccttcattatgttaagagcgtatttcttgcaaacatcccagcagctcaagcaactggaaagtgaaggcaggtcacctatcttcacacatttggtgacaagtctgaaaggcctctggacgctgagagcctttggcagacagccatattttgagacccttttccataaagcgttaaatctacacaccgctaactggtttctgtatctcagcactctccgttggtttcagatgcggatcgaaatgatctttgtgatcttttttatagcagtaacctttatctccatcttgaccaccggcgagggtgagggccgtgttggtattatcctgacattggctatgaatataatgtctacccttcagtgggccgtaaatagcagcatcgacgtcgacagtttaatgagatcagtgtcccgggttttcaagtttatcgatatgcctacagaaggcaaacccacgaaatccaccaagccatacaaaaacggtcagttatccaaggtgatgatcatagagaattcccacgttaagaaggacgacatctggccttcgggcggacaaatgactgtgaaggacctcacggctaagtacacagagggcggtaatgccatcctcgaaaacataagtttcagcataagtccaggacagagggtgggcctcctcggtcgaaccggaagcgggaaatccacgcttctgagtgctttcctccgcctgctcaacaccgaaggagagatccagattgatggagtgtcatgggacagcatcacactgcagcagtggcggaaagctttcggggtaatccctcaaaaggtgtttatcttttcaggaaccttcaggaaaaacctggatccgtatgagcagtggagtgatcaggaaatttggaaagttgcggacgaagtgggactcaggtctgtgatcgagcagtttccgggaaagctggactttgtgctggtagacgggggttgtgtgctatcccatggacacaagcagctaatgtgcttagcgcgatccgtgctcagcaaagccaagattcttcttctggacgagccaagcgcacacctggaccccgtcacttatcagatcattagacggacactaaaacaggcttttgccgactgtacggttatcctatgcgagcaccggatcgaggccatgctggagtgtcagcagttcctggtaatcgaagagaataaggtacgccaatacgattcaattcagaaactcctcaacgagcggtcattgttccggcaagccatcagtcctagtgaccgggtcaagctttttcctcatcgcaactctagcaaatgtaagagcaagccccagatcgccgcacttaaggaggagactgaagaggaagtacaagacacgcgtttgtag

SEQ ID NO: 4318 - DNA, 4317 bp, Artificial Sequence
  Description of Artificial Sequence: Synthetic coding sequence
atgcagcgctcacctctggaaaaggcttcggttgtaagtaaactgttcttttcctggacccgacctatactccggaagggataccggcagagactcgaactatccgacatttatcagatcccaagcgttgactcggcagacaacctgtctgaaaaactcgaacgtgaatgggacagggaactcgcgagtaaaaagaatcctaagctcattaatgctttgcgccgttgttttttctggcggttcatgttctacgggatctttttgtatcttggagaagtcacgaaggctgtgcagccactcctgctgggcaggatcatagcgagttacgaccctgacaataaggaggagaggtccatcgccatttacctaggaataggcctgtgtctgctgtttatagtgagaacattgcttctgcatcccgcaatctttggcctacaccatattgggatgcagatgaggattgccatgttctctctgatctacaagaaggggctggctcttgctcatttcgtgtggatcgcccctttgcaggttgccctgctcatgggtctgatctgggagctgctgcaggcaagcgctttctgtgggctgggttttctgatagtcctggctctctttcaagcgggactgggccgtatgatgatgaaatatcgggatcagcgggctggtaaaatcagcgaacgtctggtgataacttctgagatgatcgagaatattcagagtgtgaaagcttactgctgggaagaagccatggaaaagatgatcgagaatctccgacaaacagaactgaagctcactagaaaagctgcctacgttagatattttaacagcagtgccttctttttctctggtttctttgttgtgttcttaagcgtgcttccatacgcattaatcaagggcatcatcttgcggaaaatcttcaccactatttctttttgcatcgtcttgcgcatggctgtaacacggcagttcccctgggccgttcaaacatggtacgattccctgggtgcaatcaataaaatccaggacttcttgcagaagcaggagtacaaaactctcgaatacaatcttacaaccactgaggtcgtgatggaaaacgtgacagccttctgggaagaaggattcggggaattatttgagaaagcgaagcagaacaacaataatagaaagacatcgaacggcgacgattcgctatttttctcaaacttctccctgctgggtacccccgtcctcaaggacattaatttcaaaatcgagcggggtcaactgctggccgtcgctgggtccacaggcgctggcaaaacatcgctgttgatggtgatcatgggggagctggagccaagcgagggtaaaatcaagcactcaggcagaattagcttctgctcccagttttcttggattatgcctggcacaataaaggaaaacataattttcggtgtgagctatgatgaataccgctataggtccgtaatcaaggcgtgtcagcttgaggaagacataagcaaattcgctgagaaagataacattgttcttggggaaggaggcatcacattgtccgggggacagagagctcgaatttctctggctcgggctgtctacaaggatgctgacctgtacttactggattctcccttcggctacttggatgtgctgaccgaaaaggaaattttcgagtcttgcgtctgtaaactgatggccaataagacgagaatcctcgtgacctctaagatggaacacctcaagaaggcggataagattctcattctgcacgagggctcctcctacttctacggcacattctcggagctgcagaatttgcaaccagatttctcctcaaaattaatggggtgcgatagcttcgaccaattttccgcagaaaggcggaactccatactgactgagactttgcaccggttttcgctagaaggagacgcaccggtgtcctggacggagacaaagaaacaatctttcaagcaaacaggtgaatttggcgagaagcggaaaaacagcatcctgaaccccatcaactctattcgcaagttcagtatagtccagaagacccccttacagatgaacgggattgaggaggacagcgatgagccgctcgaacggaggctaagcttagtgcctgacagcgaacagggagaggctatcctcccgaggatatctgttatatctacaggccctacattacaagcacggagaaggcaatcagtgctgaatttgatgacccactccgtgaaccaagggcagaacatacatcggaaaactacagctagcactcgcaaggtgagtcttgcgccacaggctaatctgaccgagttggatatctactcacgcagattaagccaggagactggtctagagatctccgaagagataaacgaagaggatctgaaagaatgtttttttgatgatatggaatctatccccgctgtaacgacatggaacacctacctccgctacattaccgtccacaagagcctcatctttgttctcatatggtgtctggttatttttctggctgaagttgccgcatccttagtggtcttgtggttactaggtaatactcccctgcaggataaaggaaactccacacattctaggaataactcttatgcagtgatcataacatccacatcttcttattacgtgttttatatttatgtgggtgtggctgataccctgctggccatgggatttttcagaggactacccttagttcatactctgatcaccgtctctaagattctgcatcataaaatgctgcattccgtgctccaagctcctatgagcactctgaacaccctcaaggctgggggtatcctcaatcgattctcaaaggacatcgcaatccttgatgacctcctgcctctgaccatctttgacttcatacagctcctgctgatcgtaatcggcgctatagccgtggtggctgtcctccagccctacatattcgtagctaccgtgcctgtgattgtggctttcattatgttgcgcgcttactttctgcagacatcacagcagttgaaacagctagaatcagagggtaggagccccatctttacccatctcgttacaagtttaaagggcctctggactctccgggcttttgggaggcaaccgtacttcgaaacacttttccataaggctctaaatctgcacaccgcaaactggttcttgtatctgtctacactgagatggtttcagatgcggatcgagatgatattcgttatctttttcattgctgtaaccttcatctctatcctgactactggtgaaggggaggggagagtgggcatcatcctaactttggccatgaacatcatgtcaacactgcagtgggctgtaaacagctcgattgacgttgatagcctaatgcggtctgtatctagggtgtttaagtttatcgacatgcctacagagggaaagcctacaaagtcgactaaaccctataaaaacgggcagttatccaaggtgatgattatcgagaattcccacgtaaaaaaagacgatatttggccatccggtggtcagatgacggtgaaggacctgacagctaagtacaccgagggcggaaacgccatcttagagaacatttcattttctatctcacccggtcaacgggtcggactcctcgggaggaccgggtcaggcaagtctacactattgtccgccttcctgaggctccttaacacggaaggcgaaatccagatcgacggagtttcctgggactccatcaccctgcagcagtggcgcaaagcctttggtgtgattcctcagaaagtgttcatatttagtggcacctttcggaagaatctcgatccctatgaacagtggtccgatcaagaaatctggaaggtcgccgacgaagttggcctacgctctgttatagaacagtttcctggcaagctagacttcgtgcttgtagacgggggttgtgttttgagccatggccataaacagttaatgtgtctggcccgatctgtccttagcaaggctaaaatcctgctcctggacgagccgagcgcccacctggaccccgtgacgtatcagatcattcgaaggactctgaaacaggccttcgcggattgtactgtcatactgtgtgaacatagaatcgaagctatgctcgagtgccaacagtttttagttatagaggagaacaaagtcaggcagtatgactctattcagaaactgcttaatgagaggagtctgttccgccaagctatcagtccgtccgatagggtaaagctctttcctcataggaacagttcaaagtgtaaaagcaaaccacagatcgccgcactcaagtag

SEQ ID NO: 4319 - DNA, 4260 bp, Artificial Sequence
  Description of Artificial Sequence: Synthetic coding sequence
atgcagagatccccattggaaaaagcaagcgtggtgagtaagttattcttctcatggactcgaccaatcttgagaaaaggatatcggcagaggctggagctgagtgatatataccaaattccatccgtggatagtgccgacaacctctctgaaaaactggagcgggagtgggaccgcgagctggcaagtaagaagaaccctaagcttatcaacgctttgcgcagatgcttcttctggaggtttatgttttacgggatctttttgtatctgggtgaggttaccaaagctgtacagccactgttgctgggcagaatcatagcatcctatgatcctgacaacaaggaagagagaagcatcgcaatctacctggggattggcctctgcttactgtttatagtgcgcaccctgctgctacatccagcaatctttggtttacatcatatcggaatgcagatgcgcattgctatgttctccttgatttacaaaaagactttaaaactctccagtagagtcctcgacaaaatttcaatcggccagctcgtttccctgctgtctaataacctgaataagtttgacgagggtcttgccttggcacacttcgtctggattgcacccctgcaggtagctctgttaatgggccttatctgggagcttctccaagcctctgccttctgtggcctaggatttctgattgtgctggctctctttcaagccggtctcggtcggatgatgatgaaataccgtgaccaaagagcaggcaaaattagcgaacggctcgtgatcacaagcgagatgatcgaaaatatccagtccgttaaagcatattgttgggaggaggcgatggaaaagatgattgagaacctgcgccagaccgagctgaagctgacaagaaaagccgcatacgtcagatatttcaacagttctgcttttttcttctccggctttttcgtggtcttcctgtctgtactgccgtacgccttgatcaaagggattattctgaggaaaatcttcacaaccataagtttctgcatagttctgcggatggccgttacgcgccagttcccgtgggcggtgcaaacctggtacgattcactcggcgctatcaacaagatacaagatttcttgcagaaacaggaatacaaaacactcgagtataatctgaccacaaccgaagtcgtgatggaaaacgtcacggccttttgggaagagacctcccttctgatggtgataatgggcgagttagagcctagcgaaggaaagattaagcattcaggacgcattagcttttgcagccaattttcttggatcatgccaggtacaattaaggagaatattatctttggggtgtcatacgatgagtacaggtataggtcagttatcaaggcgtgccagctggaggaggatatatccaaattcgctgagaaggacaacattgtcctgggcgagggcggtatcacactcagcggcggacaacgtgcgcgtatcagtctcgcccgtgccgtctacaaagacgcggatctgtatctgctggacagcccttttgggtatctggatgtcttgaccgagaaggagatttttgaatcctgcgtgtgcaagctcatggccaacaaaactcgcatcctggtgacctccaaaatggaacacctgaagaaggccgataagatactgattctgcacgaagggagcagctacttctatggaacgttcagcgaacttcaaaatttgcagccggactttagcagcaaattaatgggctgtgacagtttcgaccagttctccgccgagagaaggaacagcatcctgacggaaaccctccacagatttagtctggagggagacgcacctgtgtcctggaccgaaacaaagaaacagtctttcaagcagaccggcgagtttggagaaaaacgaaaaaattctatcctaaatcccatcaatagcattcgcaaattcagcattgtacagaaaacaccgctccagatgaacggcatcgaggaagactcggatgagcccctcgagcggagactgtccctagtaccggatagcgaacaaggtgaagccatcttgccgaggattagcgtcatctccactggccctacactccaagctcgccgaagacaatccgtccttaaccttatgacacattccgtcaatcaagggcaaaatatccacagaaagacaaccgcctccacaagaaaagtctctctagcgcctcaggcgaatctcacagagctggatatttattccagaaggcttagtcaggaaacaggcctggaaatttccgaggaaatcaatgaagaggacctcaaagaatgcttctttgatgatatggaatctatcccggctgttacgacctggaacacgtacctgcggtatattaccgtgcataagtcacttatatttgtgcttatttggtgcctggttatcttcctggccgaggtggccgcatcattggttgtcctatggcttctaggcaatacaccgctgcaggacaaaggaaactctacacatagtaggaacaacagttacgctgtcatcattaccagcacctcttcctattatgtgttttacatctacgtgggggtagctgacaccttgctagcaatgggctttttcagaggtcttccccttgtacatactctgattaccgtcagcaagattttacaccacaagatgcttcattccgtcctgcaggccccaatgtcaacactaaatacgcttaaggcaggcggtatcctgaaccgttttagtaaggacattgcaatactggatgacctgctgcccctgacaatctttgactttatacagctacttctgattgtgatcggggcaatcgccgtggttgctgttctccagccgtacatcttcgtggctaccgtacctgtaattgtggcttttattatgctacgcgcttactttcttcagaccagccagcagttgaagcaactcgagtcagaaggacgctccccgatctttacacatctggtgacaagcttgaagggactatggacattgagggcatttggtagacagccgtactttgagaccttgttccacaaggcccttaaccttcacacagccaactggttcttgtacctctcgactctccgttggttccagatgagaattgagatgatctttgtcattttcttcatcgcagtcacgtttatctcaatactgacaacgggagagggagaaggtcgggtcggcattatactcacactggctatgaatattatgtctaccttgcagtgggccgttaacagctccatcgatgtcgactcccttatgcggagtgtttctagggtttttaagttcatcgacatgcccaccgagggaaaacccacgaaatccacaaagccttataaaaacggccagctgtctaaggtgatgattattgagaacagtcatgtaaagaaggatgacatttggccttcaggcggacagatgaccgtgaaggatctgacagcaaaatacaccgaggggggtaatgccatccttgaaaacatttcattctctataagccctggtcaacgtgtcggcctgctcgggagaacgggtagcggaaaatcaaccctactctcagcattccttcgtctgttaaatacagaaggggaaattcagatcgatggtgtttcatgggacagcattaccctgcaacagtggagaaaagctttcggggtcatcccacagaaggtcttcatcttctcgggcaccttccgcaaaaacctcgacccttatgagcagtggtctgatcaggaaatctggaaggtggctgatgaggtgggcctcaggagtgtcatcgagcagttccccggaaaactggatttcgtgctggtcgatggtggatgtgtcctcagccacgggcacaagcagctgatgtgtctggctcgctccgtgctgtctaaggccaagatcctgcttttagacgagccctccgcccatcttgaccccgtgacgtatcagattatacgccgaactctcaaacaggcattcgcagactgcactgttattctatgcgagcatcggatcgaggccatgctcgagtgccagcagttcttagtgattgaggagaacaaggtgcggcaatacgacagtatccaaaagcttctgaacgagcgctcccttttcaggcaagctatttcccctagcgaccgggtcaaactgtttccccatcggaactccagtaaatgtaaatctaaaccacagatcgcagctctcaaggaagagacagaggaggaagtgcaggacacacgcttatag

SEQ ID NO: 4320 - DNA, 573 bp, Artificial Sequence
  Description of Artificial Sequence: Synthetic coding sequence
taaaaaggactctggaccctgcgtgcctttggacgccagccttacttcgaaacactgtttcacaaagcactcaacctccatacagctaattggttcttatatttgtccaccctgcggtggtttcagatgaggatcgaaatgatttttgtgattttcttcattgccgtaaccttcatttcaatcctcactaccggcgagggcgagggaagggtcgggattattctgacactggcaatgaacatcatgagtaccctccagtgggctgtcaatagttccatcgatgtagatagcctgatgcggagtgtctcccgagtctttaagtttatcgatatgccaacggagggcaaaccgactaaatctaccaagccatataagaacgggcagctcagtaaagtgatgattattgagaactctcatgtgaagaaggatgacatctggcccagcggcggtcagatgactgtaaaagacctgactgccaagtacactgagggtgggaatgctattctggaaaatatcagcttctccatctccccaggccagcgggtacggttcgagcactgcttgctgtgttag

SEQ ID NO: 4321 - DNA, 1203 bp, Artificial Sequence
  Description of Artificial Sequence: Synthetic coding sequence
atgattcggaactggctcactatctttatacttttccccttaaagctggtggagaagtgcgagagtagtgtgtcacttaccgttcctcctgtcgttaagctggagaatggctcatctaccaatgtttctctgaccctgagaccgcctcttaacgctaccctggtgattaccttcgaaatcactttccggagcaaaaacatcacaatcctggagctgcccgacgaggtggtggttccacccggagtcactaactccagctttcaggtgacttcacagaatgtgggacaattgacggtataccttcacggtaaccatagtaatcagactggccctagaattcgtttccttgtcatcaggagttctgccatctcaatcatcaatcaagtgatcggctggatttactttgtagcttggagcatttctttttacccgcaggtaattatgaactggcgcagaaagtccgtcatcggactgagcttcgattttgtggccttaaatctcacaggttttgtcgcttatagcgtgtttaacataggacttctctgggtgccttatatcaaggaacagttcctattaaagtatcccaatggagtcaaccctgtaaactcgaacgatgtcttcttttcattgcatgccgtcgttctcacactcattatcatcgtgcagtgctgtctctatgaacgcggaggacagagggtgagctggcctgccattggtttcctggttctagcctggctgtttgcctttgtcacaatgatcgtcgcagccgtcggagttaccacctggctacaattcctgttttgcttcagttatataaagcttgctgtaactttggtcaagtacttcccccaggcgtatatgaacttctactacaaatccacagaaggatggagcattggtaatgttctgcttgacttcaccggtggatcctttagcttactacagatgttcctgcagtcctacaacaacgatcagtggacgctcatctttggggacccaacaaagttcggtctgggagtattttccatagtgtttgatgtcgtgttttttattcagcatttctgcttgtatagaaaaagacccggtctgcaggccgctcgcacaggctccggatctcgattgcgacaagattgggccccttccctccagcctaaagcccttccccaaaccactagcgtctccgctagctccctgaagggctag

SEQ ID NO: 4322 - DNA, 1104 bp, Artificial Sequence
  Description of Artificial Sequence: Synthetic coding sequence
atgatcagaaattggctgacaatcttcatccttttcccattaaagctggtggaaaagtgcgagtcttctgtgtcactcacagtcccaccggtagtaaagctggaaaatggatctagcactaacgtaagcttaaccttgcggcctcccctcaatgctaccttggttatcacattcgagattaccttcagatctaagaacataacgatcctggagttgcccgacgaagtcgtggttcccccaggggtgaccaattcatcattccaggtaacttcccagaacgtggggcaactgacggtctatctccacggcaaccatagcaatcagaccgggccacgaattcgcttcctggtcatccggtctagcgcgatctccattatcaaccaggtgatcggctggatctactttgtggcatggagcatctctttttaccctcaggtcatcatgaattggcggcgaaaaagtgtgattgggctttcgttcgacttcgtggccctgaacctgaccggctttgtggcctattccgtattcaacatcggtctgttatgggttccttacataaaagagcaattccttctgaaatatcctaacggggtgaaccccgtcaacagtaatgacgttttcttttcacttcacgcagtcgtgttaacactgattataattgtacagtgttgtctgtacgagagaggcggtcagcgagtgtcttggccagccatcggttttctggtcttggcgtggctgtttgcattcgtgacaatgatcgtggcagccgtgggggtcacaacttggcttcaatttttgttttgcttctcttacatcaaactggcagtaacactggtcaaatacttcccacaggcttatatgaatttttactacaaatcgaccgagggatggtctataggcaacgtcctcttggatttcactggaggaagcttttcacttctgcagatgtttctgcagtcctacaacaacgaccagtggacgcttatattcggcgaccccaccaaattcgggctgggagtgttttcaattgtatttgacgtggttttctttatccaacacttttgcctgtatcggaagcgccctgggtacgaccagcttaactag

SEQ ID NO: 4323 - DNA, 663 bp, Artificial Sequence
  Description of Artificial Sequence: Synthetic coding sequence
atgaactggcgtaggaagtcagttattgggctcagctttgatttcgtcgccctcaatcttactggctttgtggcctattcggtgttcaatatcggcctgctatgggtgccttacattaaggagcagttcctgttgaaataccctaatggagtaaatccagtgaactctaacgatgttttcttcagcctgcatgcagtggtcctgacactgattattatcgtccagtgctgtctttatgaaagggggggacaacgggtttcctggccagcaatcggcttcttggtcctagcctggcttttcgcgttcgttaccatgatagttgctgcagtcggggtgacgacctggctgcagttcctgttctgtttctcatatattaagctggccgtgactctggtgaagtactttccccaggcctacatgaacttttactataagagtactgagggctggagcatcgggaatgtcctgctcgactttaccggaggatccttcagcttacttcaaatgtttttacagtcttacaataatgaccagtggacactcatttttggagaccccaccaaattcggactgggcgtgttttccatcgtttttgacgtcgtcttctttatccagcatttttgtctgtaccggaagcggcctggatatgaccagcttaattag

SEQ ID NO: 4324 - DNA, 879 bp, Artificial Sequence
  Description of Artificial Sequence: Synthetic coding sequence
atgtgtcctaggatacggttcctagtcatcagatcatctgctatctctattatcaaccaagtgataggctggatctattttgtggcctggtctatctccttctatccgcaggtcatcatgaactggaggcgaaaaagcgttattgggctgtcttttgattttgtcgccttaaatctgacagggtttgtcgcatattctgtgtttaatatcgggctgctgtgggtgccttacatcaaggaacagttccttctgaagtaccccaatggggttaaccccgtcaactccaacgacgtgtttttttctctgcatgccgtggtcttaacccttataatcatcgtgcaatgttgtctgtatgagcggggaggtcagagagtatcctggcccgctattggattcttggtcttagcttggttattcgctttcgtcacgatgatcgtagccgcagtgggggtgacgacatggctgcaatttttattctgcttctcctatattaagctcgccgtgacattagttaagtacttcccacaggcatacatgaacttctattataaaagcactgaaggctggtccattggcaatgtgctgcttgacttcactgggggatccttttctcttttacaaatgttcctacagtcttataacaacgaccaatggacactgatttttggggatcctacaaagtttggactgggggtgttcagcattgtctttgacgttgtattctttatacagcacttctgtctatataggaaacgcccaggcctgcaagccgctcgaactggctctggtagtcgtctgcggcaggactgggccccatccctgcaacccaaggcactgcctcagacgacctcggtgtctgccagttcactgaaaggctag

SEQ ID NO: 4325 - DNA, 228 bp, Artificial Sequence
  Description of Artificial Sequence: Synthetic coding sequence
atgattcgaaattggttgacaatcttcatcctgtttcccctgaaattggtcgaaaagtgtgaatcctctgtatcccttaccgttcccccagttgtgaaactcgaaaatggcagtagcaccaacgtcagtcttactctgcggcctcccctgaatgccaccctggtgatcacattcgaaattaccttccgaagcaagaatatcacaatcctagaattgcctgacgagtag

SEQ ID NO: 4326 - DNA, 204 bp, Artificial Sequence
  Description of Artificial Sequence: Synthetic coding sequence
atgcgaatccactatctgctctttgctcttctgttcttattcttggtccctgtccccggacacggcggaatcataaacacgctgcaaaagtactactgccgggttaggggagggcgttgcgcggtcttgagctgcttgccgaaagaagaacagatcgggaagtgcagtactcgaggacgtaaatgctgtcgaagaaagaagtag

SEQ ID NO: 4327 - DNA, 204 bp, Artificial Sequence
  Description of Artificial Sequence: Synthetic coding sequence
atgcgaatccactacttgctctttgctttgttgtttttgttcttagtgcccgtccctgggcacggaggaattattaacaccttacaaaaatattattgccgcgtgagaggaggcagatgcgctgtactttcatgtctacccaaggaggaacagataggaaagtgctccactaggggcaggaagtgttgcagacggaaaaaatag

SEQ ID NO: 4328 - DNA, 195 bp, Artificial Sequence
  Description of Artificial Sequence: Synthetic coding sequence
atgagagtactttatctcctgttcagcttcctgtttattttccttatgcctctacccggagtgttcggaggtatcggtgacccagtgacgtgcctgaaatcaggagccatctgtcatccagtcttctgtcccaggcgctacaagcagattggcacctgcggccttcctggcaccaagtgttgcaagaaaccatag

SEQ ID NO: 4329 - DNA, 195 bp, Artificial Sequence
  Description of Artificial Sequence: Synthetic coding sequence
atgcgtgtgctctaccttttattctctttcctattcatattcttaatgcctctgcccggagtgttcggagggattggcgatccagttacctgtctgaagagcggcgcaatctgtcatccagttttctgtcccaggcggtataaacagatcgggacctgtggactgcccggaactaagtgttgcaagaagccatag

SEQ ID NO: 4330 - DNA, 849 bp, Artificial Sequence
  Description of Artificial Sequence: Synthetic coding sequence
atgcgcggtatgaagttactgggcgctctcctagccctggccgctttactgcagggagctgtttccctgaagatagcggctttcaatattcaaacatttggagagactaaaatgtcaaatgcaacacttgtaagttatattgtgcagatcctgtcaaggtacgacattgccttagtccaagaggtccgagactcacatctgactgcagttggaaagctgctggataacctgaaccaagatgccccagatacctaccactacgtggtcagcgaaccccttgggaggaatagctataaggagaggtatttatttgtgtacaggcccgatcaggtaagcgcagtggatagttattattacgatgacggctgcgagccttgcggtaatgacaccttcaacagggaaccggcaatcgttcgattcttctcaagatttactgaggtccgcgaatttgcaatagtgccccttcatgccgctcccggtgacgccgttgcggaaatcgacgccctgtacgacgtgtacctggatgtgcaggagaagtgggggctggaggatgtgatgttaatgggggactttaacgcgggatgcagttacgtacggccttcccagtggagttcgattagactgtggacttctccaacgttccaatggctcatcccggattcagctgataccaccgctacacccactcactgcgcttatgatcgtatcgtggtggccggaatgttgttacgcggtgccgtggtgcctgacagcgccctgccatttaacttccaagctgcatacgggctatctgatcagttagctcaggctattagcgatcattacccagtagaggtgatgctaaagtag

SEQ ID NO: 4331 - DNA, 849 bp, Artificial Sequence
  Description of Artificial Sequence: Synthetic coding sequence
atgcgtggaatgaaactgttaggtgctctgctagctctggcagcactgctgcaaggggctgttagcctgaagattgcagctttcaacattcagacatttggggaaacaaagatgagtaatgcaaccctggtctcatatattgtccagatcctgtcacgatatgatatcgccctcgtccaggaagtccgcgattctcatctcactgcagttggcaagctgctcgataatttgaaccaggatgcgcctgacacatatcattacgtagtgtccgaaccactcgggcgaaattcctataaagagcgctatttgttcgtttacaggcctgatcaggtctcggccgtcgattcctactactacgacgatggatgtgaaccctgtggcaacgacacatttaaccgggaacctgcaattgttcgatttttttcaaggttcaccgaggtgagggaatttgctatcgttccattgcacgcagccccaggtgacgccgtagccgaaattgatgctctttacgatgtctatctcgatgtgcaagaaaagtgggggctcgaagatgtcatgttgatgggggatttcaacgccggatgctcctatgttcggccatcccagtggagttccatacgactctggacatcaccaacatttcagtggttaattcccgattccgccgacaccaccgctacacccacccactgtgcctatgataggatcgtggttgcgggtatgctcctacgcggagctgtagttcctgacagtgcgctgccgttcaactttcaagcagcatacggtcttagtgatcagttggctcaggccatttccgatcactatccagttgaggttatgctgaagtag

SEQ ID NO: 4332 - DNA, 564 bp, Artificial Sequence
  Description of Artificial Sequence: Synthetic coding sequence
atgcaccagacaccaataacgacctggagtgtaagccattgggacggcacagccatccgatccgccacctgtagttgtaccggccttacgcgttgtctcaggtggactgccaccaccacaatgatggccgctagcccagcgggtacaaccccttctacagaatctcagcctctttccggatccagtcctggatctcaggacgtgatgttgatgggcgactttaatgcaggctgctcatacgtgaggccttcacagtggtcatcaatcaggttgtggacatccccaacttttcaatggctgattccagattcggccgacacgactgctacgccgacacactgtgcttatgatcgaattgttgtagcaggcatgttactgagaggcgctgtcgtcccagatagtgctctaccatttaatttccaggccgcatacggcctgtccgaccagctgttttccgtgcacacttgctcaggcgctgggctgggagagcggcatggtttgccagcatccgcggctctcccctcaaatacctgcagggcgggaacacaccgtgtgtctacctag

SEQ ID NO: 4333 - DNA, 6242 bp, Artificial Sequence
  Description of Artificial Sequence: Synthetic coding sequence
atgttacgcgtctttatactgtacgccgagaacgtgcacactcccgacaccgacatctcagatgcctattgtagtgctgtgttcgccggagttaagaaaagaacaaaggtgatcaaaaatagtgtcaatccagtgtggaatgagggctttgagtgggacctgaagggcataccattggaccaagggtctgagctccacgtggttgtgaaggaccacgagaccatgggtcgcaatagattccttggcgaagccaaagttcccctccgcgaagttttggcgacaccttcactgtctgcttcattcaacgcacccctcctggacacaaaaaagcagcctacgggggcaagtctggtgcttcaggtctcctatacccctctccccggagctgtccccctttttcctcccccaactcctctggagccttcccccactctccctgacctggacgtagtcgcagacacgggcggagaagaagatacagaggaccaaggactcactggcgatgaagctgagcctttcctcgatcagagcggcggacccggagccccaaccacaccccgtaagctgccttcaagacccccaccacactatcccggtatcaaacggaaaagatcagcacctacttcaaggaaattgttgtcagacaagccacaggactttcagatcagagtacaagtcatcgagggtcggcagttacccggagtaaatatcaaacccgtggtgaaggtcaccgccgcagggcagacaaagagaacgaggatccacaagggaaattcccctctcttcaatgaaacccttttcttcaaccttttcgattcacccggtgaactcttcgacgaacccatatttatcactgtcgtggattcgcgctcgctgagaactgatgcactgttaggggaatttagaatggacgtgggaaccatctaccgagagcccagacatgcgtatctgaggaaatggctgcttttgtccgaccctgacgatttttctgcgggagcaaggggctacctcaagacaagtctttgtgtgctgggtccaggcgacgaagcgccactggaacggaaggacccctcggaggataaggaagacattgagagcaatcttttacgccctacaggcgtggcactgcggggagcccatttctgcctgaaggtgtttcgcgctgaggaccttcctcagatggatgatgccgtaatggacaacgtcaaacagatttttggctttgagagcaataaaaagaacctggtcgacccattcgttgaagtgtctttcgccggtaagatgctctgctcaaagattttggaaaaaactgccaatccccagtggaatcaaaatatcaccctgcctgctatgttcccttctatgtgcgaaaagatgaggattcgcataattgactgggataggctgacgcataatgacatcgtggccaccacttatctctctatgtccaagatctctgcccctgggggagaaatagaggaagaacccgcaggagccgtcaagccttccaaagcttctgatttggacgattacctgggctttttgccaacatttggaccatgctatataaacctctatggctccccgagggagtttacgggcttccccgatccatacactgagctgaataccgggaaaggcgagggagtagcgtaccggggacgattgcttctgtcccttgaaacaaagttagtggagcactccgagcagaaggtggaggatctccccgcagacgacattctgcgggtggagaaatacctgagaagaaggaaatatagtctcttcgccgctttttatagtgctacaatgctccaggacgtcgacgatgctattcagttcgaggtctctatcggaaattacggcaataagttcgacatgacgtgcctccccctggcttccactacccaatattcgagagccgtgttcgacggctgccactactattaccttccatggggtaacgtgaagccagtcgtggtgctgtcgtcttattgggaggatatctctcaccgcattgagacccagaatcagctgctcggtattgccgatcgcttggaggcaggtttagagcaggtgcacctagcactcaaggctcaatgtagcaccgaggacgtcgactccttggtagctcagctgaccgacgagctgatcgctggatgttcacagccgctaggcgacattcatgaaactcccagcgcaacacacctagaccagtatctgtatcagctgagaacccaccatctttctcaaataaccgaggccgctctcgcgctgaaacttggacatagcgagcttcccgctgctctggaacaggctgaggattggttgctgcgcttacgcgcacttgctgaggaaccccagaattccctcccggatattgtgatctggatgctgcaaggcgataagcgggttgcctatcagagagtccccgcacaccaagtgctcttctcgcgcagaggagcaaattactgtgggaagaattgtggcaaactgcaaacgatcttcctcaagtaccccatggaaaaggttccgggtgcacggatgccagtgcagatcagagttaaactgtggtttgggctgtcggtggatgaaaaagaattcaatcaattcgccgaaggaaagttgtctgtcttcgccgaaacatatgagaacgagacaaagctggccttggtcggtaattggggcaccacagggctgacctacccaaaattctctgacgtcacaggtaagattaaactgccaaaggactccttccggccatcggccggatggacttgggcgggagactggttcgtatgccccgaaaagacactgctgcacgacatggatgctggccacttgagctttgtggaggaagtttttgagaatcagaccagactcccagggggacaatggatctatatgagtgacaattatactgacgtgaatggcgagaaagtgctaccgaaggacgacattgagtgtccgctagggtggaaatgggaggacgaggagtggtcgacagacctcaatcgcgctgtcgacgagcagggttgggagtacagcatcactataccacccgaacgcaagcccaaacactgggttccagcagagaagatgtactatactcatagacggaggcgttgggttcgccttaggcgcagagatctgagccagatggaggctctcaaacgacaccggcaggccgaggctgagggggagggctgggagtatgcttctctgttcggatggaaattccatctggagtatcgcaaaaccgatgcctttcgccgacggagatggagacgtaggatggagcccctcgaaaaaaccggccctgccgctgtgtttgctctggagggagccctcggcggagtgatggacgataaatccgaagactcgatgtcggtgtcaactctcagtttcggcgttaaccggccaaccatatcctgcatctttgactatgggaataggtaccatcttcgatgttacatgtatcaggctagggatctggccgctatggacaaggattcgttttccgatccatatgccatcgtgtcgttcctacaccagtcccaaaaaaccgtcgtggttaagaataccctgaacccaacgtgggaccaaacactgatcttttacgagatagagattttcggcgaacctgccacggttgcagagcagccacccagtattgttgtagaactgtacgaccacgacacctacggtgccgacgaattcatggggcgttgcatctgtcagcccagtctcgaaaggatgcctagactcgcttggttcccgcttacgcggggaagccagccctccggagagctgctggccagctttgagcttatacagagggagaagccggctatccatcacatccctggatttgaggtccaggaaacttcacgtatcctggacgagtccgaagataccgatttgccttacccacctccacaaagagaggcaaacatttatatggtgcctcaaaacattaaacctgcactgcagcggacagcaattgagattttggcctggggtcttaggaatatgaagagttatcagctggcaaatattagctccccttccctggtagtggagtgtgggggacagacggtgcagtcatgcgtgatcagaaacctacgtaaaaatcccaattttgatatctgtacactgtttatggaggtaatgctgccaagagaggagctgtattgcccaccgattacggtgaaggtcatcgacaacaggcagtttgggcgaagaccagttgtgggccaatgcaccattaggtctctggagtccttcctatgcgacccgtattctgctgaaagccctagtccacaaggcggtcctgacgacgtgtccctcctctcgcccggagaggacgtgctcatcgacattgatgataaggagcccctcattccaattcaggaagaagaattcattgactggtggtcgaagttcttcgcctcaataggggagagagagaaatgtggctcttatctggagaaagatttcgatacgctaaaggtttatgacactcagctcgaaaatgttgaggcttttgagggcttgtctgacttttgtaatacgttcaagttataccgtggcaagacacaggaagaaacagaagacccatctgtgatcggagagttcaagggcctgttcaaaatttatcctctccccgaggaccccgcaataccgatgcctccccgacagtttcaccaacttgccgctcagggcccacaggagtgccttgtgagaatatatattgttagagccttcggtctgcagccaaaagaccccaatggcaagtgcgatccttacattaaaatcagcatcggcaaaaagtccgtatcagatcaggacaattacataccttgcactctcgaacccgtgtttgggaaaatgtttgagctcacctgcacccttcctctagaaaaggatctgaaaattacactgtatgactatgatctgctgtcaaaggatgagaaaatcggggagaccgtcgtggatctcgagaaccggctcttgagcaaattcggagctagatgtggactgcctcagacatactgcgtgtcggggccaaatcagtggcgggatcaattgagaccgtcacagttactgcacctgttttgccaacagcaccgagtgaaggctccagtatatcgcactgacagggtgatgttccaggataaagaatactccatagaggaaatcgaagcaggtcggatcccaaaccctcacctggggccagtggaagaaaggcttgccttgcacgttctacaacagcagggcctcgtgccagaacacgtggaaagtaggccactttattcacctctccagcccgacattgagcagggaaaacttcagatgtgggtagatttattcccaaaagcacttggcaggcctgggccacctttcaacatcacaccacggcgagcgcgacgctttttccttcgctgcatcatttggaatactagagatgtgattctggatgatctgtccctgacgggggagaagatgtctgatatctatgtaaagggttggatgattggattcgaggaacacaagcagaagaccgacgtgcactacagatcacttgggggagagggaaatttcaactggcggttcattttcccgttcgattaccttcctgccgagcaagtttgcactatcgcaaaaaaggacgcattctggaggctcgataagactgagagcaaaatccccgctagggtagttttccagatctgggacaatgacaagttttcattcgatgatttcctcggttcactccagctggacctgaaccgaatgcctaagccagcaaagactgccaagaaatgcagcttggaccagctggatgatgccttccaccctgagtggttcgtatctctgttcgaacagaagactgtaaaaggctggtggccctgcgtcgctgaggaaggggaaaagaagatactggcagggaaactggaaatgaccttagagatagtcgcagagtcggagcatgaagagcgacctgccggacaggggagagatgagccaaatatgaaccccaaacttgaggatccgcgtcgacctgacacctctttcctgtggtttacttccccttataaaacaatgaagttcatcctttggcggaggttcagatgggccataatcctgttcattattctgttcattctcctgctgttcctggctattttcatttatgcctttccaaactatgctgcaatgaagctggttaagcctttcagcta

SEQ ID NO: 4334 - DNA, 6246 bp, Artificial Sequence
  Description of Artificial Sequence: Synthetic coding sequence
atgctttgctgcctgctggtgagagcatccaacctgccttcagccaagaaagatagacggtccgacccagtcgccagcttaacattcaggggagtgaaaaaaagaaccaaagttataaaaaacagcgttaatcctgtttggaacgagggatttgagtgggacttgaagggaatccccctcgatcagggcagcgaactgcatgtcgtagtgaaggaccatgaaacgatggggagaaacagatttttgggtgaggccaaagtgcctcttcgtgaagtgttggccacaccatctttatccgcttcgttcaacgctcccctccttgacacaaaaaagcagccaacgggcgcttccctggtgctccaggtgagttacacacctcttcccggtgccgtcccattgtttcccccacctacacccctggaacctagtcccactcttcccgatttggatgttgtagccgatactggtggggaagaggacaccgaggaccaaggactgactggcgacgaagccgagcctttcctcgaccagtcaggcggtcccggtgcacctactaccccacggaagctcccgagtcgaccgcctccacactaccctggtatcaaacggaagcgatcagcccctacctctcgaaaactgctgtcagataagccgcaggactttcagatcagggttcaagttattgaaggcaggcagctgcctggggtcaacatcaaacccgtcgttaaagtgaccgctgccggtcagaccaagaggaccaggattcacaagggcaactctccattattcaatgaaaccctgttctttaacctgtttgactctccaggagagctcttcgatgagccaatattcataactgtcgtggactctagaagtcttaggactgacgcactgctgggcgaattccggatggacgtgggaaccatttatcgcgaaccacgacacgcctatttgcgtaagtggctccttctgtctgatccagatgatttctctgccggtgcacggggttacctgaagaccagcttatgtgtgttgggccctggggacgaggccccactggagcgcaaggacccctcagaggataaagaagatatagagagcaatctattaagacccacgggcgtggcgcttcgaggcgctcatttttgcctgaaggtgtttcgggctgaagacctaccccagatggatgacgcagttatggacaatgtaaagcagatattcggctttgaaagcaacaaaaagaacctggtggacccctttgtggaagtgagttttgccggaaaaatgctttgctcaaagattcttgagaagactgcaaacccccaatggaaccagaacattaccctccccgctatgttccccagtatgtgtgagaaaatgagaattaggataatcgactgggatagactgacccacaatgacatagtcgcaactacttatctgagtatgagtaaaatctccgccccaggtggggagatcgaggaagaacctgccggtgccgtcaagccttccaaagcttcagacctggacgattatttgggtttcttgcccacgtttggtccttgttatatcaacttgtatggatctccgcgtgaatttactggctttcccgatccttataccgaacttaacactgggaagggagagggtgtcgcttacaggggccgactccttctcagcttggagaccaagttggttgagcattctgagcagaaggtggaggatctgccagccgacgacattctgcgcgtggagaagtacctcaggaggaggaaatacagcctattcgcagcattctatagcgcgactatgctgcaggacgtggatgacgccatacagttcgaggtatctattggcaattacggcaacaaattcgacatgacgtgtctgccgctcgcaagtactacgcagtacagtagagccgtattcgacggctgccactactactatctgccatggggcaacgtaaaacctgtggttgttctgagtagttattgggaggacatctcacacaggatcgaaactcagaatcagcttctgggtatagcagacagattagaggccggattggagcaagtgcacctggcgttgaaggctcagtgctcaactgaagacgtagacagcctggtggcacagttaacggacgaactgattgcaggttgcagccaaccactcggggacattcatgagacaccaagcgccacacacctggatcagtatctataccaactgagaactcatcatctgtcacagatcacagaagctgcactggctcttaagctcggccattctgagctgcccgctgccttggagcaagcagaggattggttactgcgactacgggctctggcagaagagccacagaattctctgcccgacatcgtgatatggatgcttcagggtgataagagagtggcgtaccagagggttcctgcccatcaggtgttattctctagaagaggagctaactactgtggaaaaaactgcgggaagctgcagactatctttctgaagtaccccatggaaaaagtgccaggcgcacggatgccagtccaaattcgtgtcaagttgtggttcgggctgagtgttgacgagaaagagtttaaccaattcgccgaggggaagctgagcgtgttcgctgaaacctatgagaacgaaactaaactagccctggtcgggaactgggggacgactggtctcacgtacccaaaatttagtgatgttaccggcaaaatcaagcttccgaaggattccttccgccctagtgctggatggacatgggcaggcgattggttcgtgtgcccagaaaaaaccctactccatgatatggacgccggacaccttagcttcgtggaggaggtttttgagaatcaaactagacttccagggggacagtggatatacatgagtgataactataccgatgtaaacggagagaaagtgctgcccaaggacgacatcgaatgccccctcggctggaagtgggaggacgaagagtggagtaccgacttgaacagggctgtcgacgaacaggggtgggaatatagtatcacaataccccctgagcgaaagccgaagcactgggtccctgcagaaaaaatgtactacactcataggaggagaaggtgggtgagactgagacggagagatctgtcacagatggaggcccttaagcggcatcgccaagccgaggctgaaggagaggggtgggaatatgccagcttgttcggttggaaattccatctagagtaccgtaaaacagacgccttccgccgtcgtcgctggagacggaggatggaaccactagaaaagaccggaccagctgccgtatttgcactcgaaggcgcactgggtggtgtaatggatgacaagagcgaagattctatgagcgttagtacgctgtcatttggggtcaatcggcctactatttcatgtatctttgattatggcaaccgttaccacttaaggtgttatatgtaccaggccagagatttagcggctatggacaaagattcattctctgacccctacgctatcgtcagcttcctgcaccagtctcagaaaaccgtcgtcgtaaagaacaccctgaatccaacatgggaccagactttaatcttctatgaaatcgaaatatttggagaacccgctactgttgcagagcagcccccatccatcgtagtcgaactctacgatcacgatacatacggcgctgacgaattcatgggcagatgcatttgtcagccctcgctggaaagaatgcccagactcgcctggtttccgctcacaaggggatcccagccctccggcgaactcctggcctccttcgaacttatacaaagagaaaagccagccattcatcacatccccggtttcgaggtgcaagagacgtcccgaatactggacgaaagcgaagacacagatttaccttaccctcctccgcagcgcgaagctaacatatacatggtgcctcagaacattaagcccgcactgcaacgaaccgcaatagagatactcgcttggggactgcgcaacatgaagtcctatcagctggcgaatatctcatccccttccctggtcgtggagtgtggagggcagaccgtgcagtcctgtgttattcgcaatctacgtaagaaccccaattttgacatatgtaccttgtttatggaggtgatgctacctcgcgaagagctgtactgcccacccatcaccgtgaaagtgattgacaataggcagttcggcaggagaccagttgtaggccagtgcacaatccggagcctggaaagcttcctgtgcgacccttactcggctgagtcaccttccccgcagggaggtccggacgatgtgtctctgttgtctccaggcgaagatgtgctaatcgacatcgacgataaagagcctctcatccccatccaagaagaggagttcatagactggtggtccaagttcttcgcttctatcggggagcgcgaaaagtgcggatcttatctcgaaaaggacttcgacacattgaaggtatacgatacgcaactggagaatgtggaagcgttcgaaggattgagtgacttctgtaacactttcaaattatacagggggaagacacaggaggagacagaggacccgtccgtgatcggtgaatttaaggggcttttcaaaatctatcccctgccagaagatcctgccataccaatgcccccacgacaattccaccaactggccgctcagggaccacaggagtgtctcgtcaggatctacatagtcagggcattcggactccaacctaaagatcccaacggcaagtgtgacccgtatatcaagatttccattggaaagaagagcgtcagcgaccaggacaattacattccatgtacattggagccagtgttcggcaaaatgtttgaactgacatgcacactacctctggagaaagacttgaaaatcaccttgtacgattacgatctgctgagcaaagacgagaagattggcgagaccgtcgtcgatctcgagaaccgacttctgtccaaattcggagcccgatgtggcttgccccagacctattgcgtttccggccctaatcagtggagggaccagcttagaccaagccagcttctgcacctgttctgtcagcagcacagggtgaaggctcccgtgtacagaacggaccgcgtgatgtttcaggacaaggagtactctatcgaggagattgaagccggtcgcatacccaaccctcatctcggcccagtggaagagagactggccctacacgtcctgcagcaacagggactagtccctgaacatgttgaaagccgtcctctctatagccccctgcagccagatatcgagcaggggaagctgcagatgtgggttgatctgtttccaaaggccctggggagacctggcccacccttcaatattacccctcggcgagcgaggcgattttttctccgttgcattatctggaacacacgggatgttatcctggacgacctgtcactgactggggagaagatgagtgacatatatgtaaaaggatggatgattggcttcgaggaacataagcagaagaccgacgtccactatagatcactgggcggtgagggaaactttaactggcggtttatctttccttttgattatctacctgctgagcaagtgtgtactatagccaaaaaggatgccttctggagattagacaagacagagtccaagataccagcacgcgtggtgtttcagatatgggataatgacaaattctcgtttgacgattttcttggctccctgcagctcgacttgaacagaatgcctaagcccgctaagactgcaaaaaagtgctcgctggaccagcttgacgacgccttccaccccgagtggtttgtttcacttttcgagcagaagaccgtaaaaggatggtggccctgcgtggctgaagagggtgaaaagaagatactggcaggtaagctagaaatgacattagaaatcgtggcagagagtgaacatgaagaacggcctgcaggccaggggagggatgagcctaatatgaatcctaagctggaagatcctcggcgacctgatacatccttcctgtggtttacctctccctataagacaatgaaatttatactctggcgaagattcaggtgggccattattctctttataatactcttcatcctgctattattcctggccatattcatatatgcctttcccaactatgccgcaatgaagctggtcaagcctttttcgtat

SEQ ID NO: 4335 - DNA, 6309 bp, Artificial Sequence
  Description of Artificial Sequence: Synthetic coding sequence
atgttatgctgtctgttggtccgtgcatcgaatctgccaagcgccaaaaaagaccggagaagcgatccagtggcttcactcacttttcgcggagtgaagaagagaaccaaggttatcaagaacagcgtgaaccccgtatggaatgaggggttcgaatgggacctaaaggggattccgctggatcaggggagcgagttacacgttgtggtgaaggatcacgagacaatgggcagaaaccggtttctgggggaggccaaggtgcccctccgtgaagtcttggcaactccatcgctctcagcaagcttcaacgcacccctcctggataccaagaagcagcccacaggcgcttcactggttctccaggtttcttacacccccttgcccggagccgtgcccctcttccctcctccaacgcccctcgagccttcccctacactgcccgatcttgatgtggtcgccgacaccggaggcgaagaagacacagaagatcagggtctgactggcgatgaggccgaacccttccttgaccagagtggtgggccaggcgcaccgaccacgcccagaaaactgccctctcggcctccaccacactatcccggtattaagcgtaaacgaagcgccccaacaagtaggaaactactaagtgacaagcctcaggatttccagattagagtgcaggtgatagaggggaggcaattgcccggtgttaacataaaaccagtggtcaaggtgaccgcggctggccagacaaagcgaacgcgaatccacaaggggaatagcccactcttcaatgaaacactttttttcaatctgttcgattccccgggagagctgtttgatgagcctatctttatcaccgtcgtggacagtagaagcctgcggaccgatgccctgttaggagaattcagaatggatgttggcacaatttaccgggagccacgccacgcttacttgcggaaatggttgctcctctccgatccagacgacttctcagccggtgccagggggtacctgaagacaagcctttgtgtgctcgggcctggagacgaggctcctctggagcgcaaggatccctctgaagataaagaggacatcgagtcaaacttgctgaggcccaccggcgtggctctaagaggagcccatttctgtctcaaagttttccgggcagaggacctcccccagatggatgatgctgtcatggataacgtaaagcagatctttggttttgagagtaataagaagaatttggttgacccgttcgtggaagtatcctttgccggtaaaatgttgtgctcaaaaattctggagaagaccgcaaatccgcaatggaaccagaatatcaccctccccgcaatgtttccttccatgtgcgaaaaaatgcgcatcaggattattgactgggatcgtctgacccacaacgatattgtggctacaacttacttgtcgatgtccaagatatccgcccctggtggagaaatcgaagaggagcccgcaggcgctgtcaaaccctctaaagcttctgatctcgacgattatttggggtttcttccgacctttgggccttgttacattaacctgtacggctcccccagggagttcactggatttcccgatccttatactgagttgaacaccgggaagggagaaggggtggcgtatcgaggccgtttactactctctttggagacaaagttggttgaacattccgaacagaaagtggaggacttacccgctgacgacattctaagagttgaaaaatacctgcgaagacgcaaatatagcctcttcgcagctttttatagcgcgaccatgttgcaggatgtggacgacgcaatccagtttgaggtttctataggcaattatggtaataaatttgacatgacatgtctacccctggcatctacaacacagtactccagggctgttttcgacgggtgtcattattactatctgccctggggaaacgttaaaccagttgttgtgctaagcagttactgggaagacatttcccacagaatcgagactcagaaccaactgctgggaattgccgatagactcgaggcaggactggagcaagtgcatttggctctcaaagcccagtgtagcaccgaggacgtggattcgcttgtggcgcagctgaccgatgagctgatcgccggatgttcgcagcctctgggagatatccacgaaactccaagtgctacacacctggaccaatacctgtatcaactgaggacccatcaccttagtcagatcacggaggcagctctggccctaaagctgggtcactcggagctccctgcagccctcgaacaggctgaggactggctgcttcggctccgggcactggcagaggagccacagaattcacttcccgacatagtcatctggatgcttcagggagacaagagagttgcttaccagcgcgtcccggctcaccaggtgctgttctcacgcagaggggcaaactactgtgggaagaattgcgggaaattgcagaccatattcttaaagtatcctatggaaaaagtcccgggagcaagaatgccagtgcaaatccgagtgaagctgtggtttggactgtcagtcgacgagaaagaatttaaccagtttgctgaaggcaaactttcggtgttcgccgaaacttacgaaaacgagactaagctagcgttagtcggcaattggggcactaccggccttacatacccaaaattctcagatgttacaggtaagatcaagctgccaaaagactcattccgccctagcgccggatggacctgggctggagattggttcgtgtgccccgagaaaaccctgctgcacgacatggatgccggtcacctgagttttgtggaggaagtttttgaaaaccagaccaggctaccaggcggtcaatggatttatatgagcgataattacacagatgttaacggagaaaaagtgttacccaaagacgacatcgagtgccctcttgggtggaagtgggaggatgaggaatggtctacagacttgaacagggcagtagacgaacaggggtgggagtatagtattacaatccctccagaaagaaaacccaagcattgggttcccgcagaaaagatgtactacactcatcgcaggcgccgttgggtgcgcttaaggagacgcgatttatctcagatggaggccttaaaaagacaccggcaggccgaggcagagggagaaggctgggaatacgcatctctttttggttggaagttccacctagagtatagaaaaacagacgccttcaggcggaggaggtggagacgacgtatggagccattggagaaaaccgggcctgccgctgtgtttgcactagagggggctcttggaggggttatggatgataagtcagaggacagcatgagtgttagcaccctctcatttggcgtgaatcgcccaactatctcctgcattttcgactatggtaatcggtaccatctcagatgctatatgtaccaggctagggaccttgcagctatggataaagactcattttcagatccctacgcaattgtctcatttctgcatcagagtcagaaaactgtggtggtgaaaaacacgctgaaccctacctgggaccagactctgatcttctacgagattgaaatatttggtgaacctgctacagtcgcagagcagcctccctcaatcgtggtggagctgtacgaccacgatacatacggtgccgatgagttcatgggacgctgcatctgtcagccttcactcgagcgtatgccgaggctcgcatggtttcccctcactcgaggctcacagccctccggagaactgctcgcttcctttgaactgatccagagagaaaaacccgctatccaccatattccaggctttgaggtgcaggagacctcaaggattctagatgagagcgaggacacagacctgccctatccaccgcctcagcgcgaggcaaatatttacatggttccccagaacatcaaaccggcacttcagcgaaccgccatcgagatcctggcttggggcctacgtaacatgaaatcataccagctcgccaatatttcctctcccagtctggtggtagagtgcggaggccaaaccgtccagtcatgcgtcattagaaatctgagaaaaaatccaaatttcgatatctgtactttatttatggaggtgatgctgcccagagaggagctttactgtccaccaatcactgtcaaggtgatagacaataggcaatttggccgaaggcccgttgttgggcagtgtaccattaggtcactggagtcctttctgtgcgatccctattctgctgagtcccctagtccacagggcggaccagatgacgtgagcctcttgtcccctggcgaagatgtgctgattgacatcgacgataaggaaccactgattcccatccagctcgctgacggcttatcctctctggcacctacaaataccgcctcgccacccagttcaccgcatgaggaagagtttattgattggtggagcaagtttttcgcatcgattggagagcgggaaaagtgcgggagttacctcgagaaagattttgataccttgaaggtgtatgatacacagctagagaacgtcgaggcctttgagggcttgtctgatttctgcaacacattcaagctgtatagaggtaagacacaagaagaaacagaagacccatctgttatcggcgagttcaagggactcttcaaaatatatccgctcccagaggaccctgcaatcccgatgcctccacgtcagttccatcagctcgcagcccaagggccacaagagtgcctagtccgcatctacattgtgagggcatttggtcttcagccaaaagaccctaacggaaagtgtgacccttacattaaaatttcaatcggtaagaaaagtgtttcagaccaggacaattacattccatgtactctcgaaccggtttttgggaaaatgttcgaactaacctgcaccctgccccttgagaaggatcttaagatcaccctgtacgactacgacctgctgtcaaaagatgagaagattggtgaaaccgtcgttgatctggagaatagactgttatcgaagttcggcgcaagatgtggactgccccagacatactgcgtgtctggccctaatcagtggcgggaccagctacgtccatcacagcttctgcaccttttttgccagcagcatagagtcaaggcaccggtgtaccggaccgatcgtgtgatgtttcaggataaagagtacagcatagaggaaattgaagccggacgaataccaaatccacatctgggaccagtcgaagagagattggcactccacgtcctccagcagcagggattagtgccagaacatgtagagtcccggcctctgtattcacccttgcagccagacatcgagcaggggaaactccagatgtgggtggatctgtttccaaaggcactgggcagacccggtccaccattcaacatcacaccgaggcgagccaggcggtttttccttcgctgcattatttggaacactcgagacgtgatattagatgatctttcacttactggagaaaagatgtccgacatttacgttaaaggctggatgatcggctttgaggaacataagcagaaaacggacgtgcactaccggtcacttggaggcgagggaaactttaattggcggttcatcttcccctttgattaccttcctgccgaacaggtatgtaccatcgccaagaaggatgcattttggcgtctcgacaagaccgagagtaaaatccctgctagggtggtcttccagatttgggacaacgataagttttcctttgatgattttctgggttcattacaattagatctcaaccgaatgccaaaaccagccaagacagcgaaaaagtgctccctggaccaactggatgacgctttccatcctgaatggttcgtctcgctgttcgaacaaaaaactgtgaaaggctggtggccctgcgtggcggaagagggagagaagaagatcctagcgggaaaactagagatgaccctcgagatcgtcgcggagtctgagcatgaggagcgacctgccggacagggtcgcgatgagccgaatatgaatcccaaattagaagatcctcggaggcccgataccagcttcctgtggtttacctccccatacaagaccatgaagttcatcctctggagaaggtttcggtgggccattatattgttcatcatcctgtttatccttctgctctttctggccatttttatatacgcatttcctaactatgcggctatgaaactggtaaaacctttttcttat

SEQ ID NO: 4336 - DNA, 6357 bp, Artificial Sequence
  Description of Artificial Sequence: Synthetic coding sequence
atgttacgtgtctttatcctctacgccgagaatgttcacacacccgacactgacatctctgacgcctactgttcggccgtgttcgcgggtgttaaaaaacgcacaaaggtgatcaaaaactctgtcaaccctgtatggaatgaaggcttcgagtgggacttgaagggcattcccctagaccaaggttctgagttacatgtagtggttaaagaccacgaaaccatgggacgaaaccgattcctcggggaggcgaaagtccccctgcgtgaggttttagctacaccatcactatccgcctcctttaatgctcccttattggacactaaaaaacagcctactggcgcatctcttgtcctgcaggtgagttacaccccgctgcctggcgctgtgcccctttttcctccacctacacccttagagccctcacccacattgccggatcttgacgtcgtggccggaggaggccagtcaagagctgaaacatggagccttctgtctgatagtacaatggacacccgctatagcggcaagaagtggcccgcaccaacggacactgggggagaggaggacacagaggatcagggtctgacgggggatgaggccgaacccttcctggaccagtccgggggaccaggggcacccactacgcctcgcaaactgccaagcagacctcctccacactatccaggtatcaaacgcaagcgatccgctcctacgtcaagaaagcttctgagtgataagcctcaagatttccagattcgagtccaagttattgagggaagacagcttcccggtgtcaatattaagcctgtggtgaaagtgactgcagccggacaaacaaaacgcacaagaatccacaaaggaaactccccattgtttaatgagaccttatttttcaatctgttcgattctccgggtgagcttttcgatgagcccattttcatcactgtggttgactcacggtccctccgtaccgacgctctgctgggcgaatttaggatggacgtgggaactatctaccgagagcccaggcacgcgtacctgcgtaaatggttgctgctgagtgacccggacgacttctctgccggagcccgaggctacctgaagaccagtctctgcgttctgggaccaggcgacgaagcgcctctggagagaaaggacccatcagaggataaggaggacatagaaagcaatctgctgcgcccaaccggcgtggctctcagaggggcacatttctgtctcaaggtgttcagggctgaagatttgccccagatggatgatgcggtcatggacaacgtcaaacagatttttggcttcgagtctaataaaaagaaccttgtggacccgttcgttgaagtgtctttcgctgggaagatgctgtgctccaagatattagagaagaccgccaacccccagtggaaccagaacataaccttacccgcaatgtttccctccatgtgtgaaaagatgagaataaggataatagattgggacaggctgacccataacgacatagtggctaccacgtacctgtcaatgtccaaaattagtgcccctgggggagagatcgaggtagacgactatctcggtttcttacccacatttggaccgtgttacattaatctctatggttctccgcgtgagtttacaggatttcctgatccatacacggaactgaataccggcaagggggagggagtagcttatcgcggtaggttactgctctcgctggaaaccaaactggtcgagcactctgaacagaaagtcgaagacctgccggctgacgacatcttacgtgtggagaaatacctgcgacggcgtaaatactctctctttgccgctttttatagcgccacaatgctgcaggacgtggatgacgccattcagttcgaggtcagtatcgggaattatggcaataagttcgatatgacctgcttgcccctggccagcactactcagtattccagggcagtgtttgacggttgccactactactatcttccttggggcaatgtgaagccggtcgtagttctgtcatcatactgggaagacatctcacaccgaattgagactcagaatcagctcttaggcatcgctgaccggctggaggcaggactggagcaggtgcatctggctttaaaggctcagtgttccacggaagacgtcgattccctggttgcacagctcacagacgaactgattgccggatgttcccaacccttgggcgatattcatgaaactccaagcgccactcaccttgaccaatatctttaccagcttaggactcaccacctgtctcagatcactgaagctgcattggctctgaagttgggccactcagaactgccagcagctttggaacaggcagaggactggctgttgagactgcgagccctagccgaggagccgcagaacagcctccccgatattgtcatctggatgttgcaaggggataaaagggtcgcataccaacgggtgcccgctcaccaggtgctgttttcccggaggggtgctaattactgcggaaaaaattgtggaaaactgcagaccatcttccttaaataccccatggagaaggtcccaggagctaggatgcccgtgcagatcagagtgaagttgtggtttggtctgagcgtggacgagaaagaatttaatcagtttgctgaaggaaagctaagcgttttcgcagagacttacgaaaacgagactaaactcgcactagtcggaaactggggtacaaccggtcttacgtaccccaagttcagcgacgtgactggaaagatcaaactgccaaaagattcctttaggccgagcgctggatggacttgggctggagactggttcgtgtgtccagaaaagaccctgctacatgacatggatgccggacatttatcatttgtcgaagaggtcttcgagaatcagacacggcttcctggtggtcagtggatatacatgagtgacaactatacagatgtaaacggcgagaaagtactgcctaaagatgatatcgagtgccccctaggctggaagtgggaggatgaggagtggagtacggatctgaatcgcgcagtggatgaacagggctgggaatactcaatcacaattcctcctgagagaaagccgaagcactgggttcctgccgagaaaatgtactacactcacagaagaaggaggtgggtgcgcctccggagacgagacctatctcaaatggaggctcttaagcgtcatcgtcaggctgaggcagaaggtgaaggttgggaatatgctagcctatttgggtggaagtttcacttagagtaccgcaaaacggatgcattccgccgacgcagatggcgtagacggatggagcccctggaaaagactggccctgccgcagtcttcgcgctagaaggggcactggggggtgtgatggacgacaaaagcgaagattccatgtccgtttccactctttcttttggagtgaaccggccaacaatcagctgcattttcgactatggtaatcgttatcacctgcgttgctatatgtatcaggcgagagacctggccgcaatggacaaggactctttttctgacccctacgcaatagttagcttcctgcatcagagtcagaaaacggtagtggtgaagaacacactgaaccccacatgggaccaaaccctcatcttctacgagattgaaatcttcggtgagcctgcaacagtggctgaacagccaccatctatcgttgtcgaactctatgaccacgacacctacggagctgacgagtttatgggccgatgcatttgtcagccatccctcgagagaatgcctcgattggcgtggttccctttaacacgaggcagccagccttctggtgaacttctggcctcattcgaactcatccagcgggaaaaacccgctatacaccacatccccggttttgaagtccaggagacctcaagaatcctggacgagtctgaggacacggacctcccttatccccctcctcaaagggaagccaacatctatatggtgcctcaaaacatcaaacctgcccttcagcgcactgcaatcgaaatcctcgcttgggggctgcgaaacatgaagagttaccagctcgccaatattagtagtccatcactggtggtggagtgcggtggacaaactgtccaatcatgcgtgatccgcaatttaaggaagaatcccaatttcgatatttgcaccttgttcatggaagttatgttgcctcgagaagagctttactgtccccctatcacagtcaaagtgatcgataacagacagtttggacgtcgccctgtggtgggccagtgcacaatacgatctcttgagagttttctatgcgatccttatagcgccgaaagcccatctccccaggggggtcccgacgacgtgtccctgctaagtcccggtgaggacgtccttattgacatcgacgacaaagagcccttgatccccatccaactcgccgacggcctgagttctttagctccaaccaatacggcctcgcctcctagctctcctcatgaagaggagtttatcgattggtggagtaaatttttcgcgtccatcggtgaacgggaaaagtgtgggagctatctggaaaaggatttcgatacgctcaaagtctatgacacacagctcgagaacgtggaagctttcgagggactttccgacttttgtaacaccttcaaattgtacagagggaagacacaggaggagaccgaagatccatctgtaatcggggaattcaaaggcctttttaagatctaccccctccccgaggaccctgcaatcccaatgccaccacgacaattccaccagctggctgctcaaggtccgcaggagtgtctggtcagaatctatatcgttagggccttcgggctgcaaccaaaagatcccaacggaaaatgcgacccatatattaagatttcaattgggaagaaatcggtcagcgaccaggacaactacattccctgcacactagagccggttttcggcaagatgttcgagctgacctgtaccctacctctggaaaaggacttgaagatcaccttgtacgattacgatttgctgtccaaggatgagaagatcggggaaaccgtcgtggacctagaaaaccgcctgctatccaagttcggggctagatgtggacttcctcagacctactgtgtgtcgggtccaaaccagtggagagaccagctgcgcccttctcagctcttgcacctcttttgtcagcagcacagagtgaaagctcccgtctataggaccgatcgggtgatgtttcaagataaagagtattccattgaggaaattgaggcgggaagaattccgaacccacatttaggaccagtcgaggagcggctggcactccatgtgctgcagcagcagggcctggttccagaacatgtggagagccgcccactctattcaccgctccagccagatattgaacaggggaagctgcagatgtgggtggacttattcccgaaagctcttggcagaccgggtcccccttttaatattacgccaaggagagctaggcgattttttctgcgatgcatcatctggaacactcgcgacgtgattttagacgatctgtccctgacaggggagaaaatgtcagatatctatgtaaaaggatggatgattgggttcgaggagcacaaacagaaaactgacgtccactacaggtctttgggcggtgagggcaattttaactggaggttcatctttcctttcgactacctgcccgcagaacaggtgtgtactatcgccaaaaaggacgcattctggcgccttgataaaactgaatcaaagattcccgcaagggtcgtatttcagatatgggacaacgacaaattcagcttcgatgacttcctcggcagtttgcagctcgatctgaaccgtatgcccaagcctgccaaaactgctaagaagtgttccctggatcagctggacgacgcgtttcacccagagtggtttgtaagtttgttcgaacaaaaaacagtgaaggggtggtggccgtgtgttgcagaggagggagagaagaaaatcctggctggcaagctcgaaatgacactagagatcgtggccgagtccgaacacgaagaaaggcctgctggccagggccgagatgagccgaatatgaaccccaagttggaagatccacgcagaccagatacttctttcttatggttcacctccccctataagaccatgaagttcatcctctggcgcagattcaggtgggctatcatcctctttatcattctgttcatcttgcttctgtttctcgcaatttttatctacgcttttccgaattacgcagccatgaaattggttaagcccttcagttag

SEQ ID NO: 4337 - DNA, 6339 bp, Artificial Sequence
  Description of Artificial Sequence: Synthetic coding sequence
atgctgtgttgtctgctggtcagggcttcgaacctcccttccgctaagaaggaccggaggtccgacccagtggcatctttaacatttcggggagtcaaaaaacgaaccaaggtgataaaaaattcagtcaacccagtttggaatgaaggtttcgagtgggacctcaaaggcattccgcttgatcagggctccgagcttcatgtggtggttaaggaccacgagacaatggggaggaatcggtttctaggcgaggcaaaagtgccattacgagaagtgctcgctaccccaagtttatcagcatcgttcaacgcacctctgctggacaccaagaaacagcccacaggcgcatccctggtcctccaggtgtcttacactcccctcccaggagctgtgcccctgttcccacctccaaccccacttgagccgtcccctactctgccggatttggacgtggtcgccggaggaggacagagcagggcagaaacctggtccctgctgtccgattcaaccatggacactagatatagtggcaagaagtggcctgcacctaccgacactggcggagaagaagacaccgaggaccaaggactaaccggcgatgaggccgagccattcctggatcagtccgggggacctggtgctcctactactcctcgaaaactcccaagccggccaccgcctcactaccccggaatcaaacgcaaacgtagtgcccctacaagtcggaagctgctctctgacaaaccgcaggattttcagatcagagtgcaggtgatcgagggcaggcagttaccgggtgtgaacataaagcctgtagtgaaggtcaccgccgcaggccaaacaaagcggacaaggattcacaaagggaactctccactgtttaacgaaactctgttctttaacttattcgacagccccggagagctctttgatgaacccatttttatcaccgtggttgactcacggtcactgcgaacagacgcactacttggcgagttccgtatggacgtgggaactatttacagggagccaaggcacgcctacttgaggaagtggctcctattaagtgacccggatgacttctctgcgggagcacgaggttacctgaagacctccctctgtgtgttgggtccaggcgatgaggccccactggaacggaaggacccgtcggaggataaagaagacatagagtctaaccttctacggcctacaggagtcgctcttcgtggagcccatttctgtctcaaagtgttccgtgccgaggacctccctcagatggacgacgccgtcatggacaacgtcaagcaaatattcggatttgaaagtaataagaagaaccttgtggatccattcgtggaggtgagttttgccggaaagatgctgtgttcgaagatactcgagaaaacagccaacccacagtggaaccagaatatcactctcccggcaatgtttccttccatgtgtgagaaaatgagaatcagaatcatcgattgggaccgcctgacccataacgatatcgtcgccacaacttacctatcaatgtccaagattagcgctcccggaggagaaattgaggaagagccagctggagcggtgaaaccctctaaagcaagtgacttggatgattacttggggtttttgcctactttcggcccatgctacattaacttgtatggctctccgagagaatttaccggtttcccagatccatataccgagctaaacacaggaaaaggggaaggcgtggcctacagaggcaggcttctgctctccctggagactaaattagtggagcactcagagcagaaagtggaagatctgcccgcagacgatatactgagagttgaaaagtatctcagacgtcggaagtacagtctctttgccgctttttatagcgccactatgcttcaggacgtggacgacgcaattcagttcgaagtctctatcggcaattacgggaacaagttcgacatgacctgtcttcctctggcttctactactcagtattcgagggcggtcttcgacggctgccattattactatttgccttggggcaatgtgaagccggtggttgttctttccagctactgggaggatatctcccatagaatcgaaacacagaatcaactgttgggcattgccgatagactggaagctggattagagcaagttcaccttgctctgaaggctcagtgctctacagaagacgtcgacagcctggtcgcacaattgaccgacgagcttatcgccggttgcagccaacctctgggcgacatccacgagaccccttccgccacacacttggatcagtacctgtaccagctgaggacccaccacctgtctcagattactgaagctgcgctcgcgttaaagctcgggcattcagagctgcctgctgctctcgaacaagccgaggattggcttctgcgacttcgcgcattagctgaggagccacagaattccctgccagacatcgtgatttggatgctccaaggggataaaagggtagcctatcaaagagtaccagcacaccaagtgttgttcagtcggcgaggggctaattactgtgggaaaaattgtgggaagctgcagacaatttttttgaaataccccatggagaaggttcctggagcgagaatgcctgtccagattcgcgttaaattatggttcggcctatccgtggatgagaaagagtttaatcagttcgccgagggcaagctgtccgtcttcgcagagacatatgagaacgagaccaagctggccttggtcggcaattggggtaccacaggcctaacttacccgaagttcagtgatgttacaggaaaaataaagttgcccaaggactcttttcgcccatcggctgggtggacatgggcaggggattggtttgtgtgcccagagaaaactctcctccatgatatggacgctggacacctctcattcgttgaggaagtctttgagaatcagacccgcctgccaggtggccagtggatttatatgtccgacaactacactgacgtcaatggcgagaaggtgctcccaaaggatgatatcgaatgcccactgggctggaagtgggaagatgaggagtggtccaccgatctgaatagagccgttgatgaacagggttgggagtattccattactattcccccagaacgcaaaccaaaacattgggtacctgctgagaaaatgtattatactcatcgaaggcggcgatgggttagactgagacgcagggacctctcacaaatggaggccctgaaaagacaccggcaggccgaggcagagggtgagggctgggagtacgcaagcctgtttggctggaagtttcacttagagtatcgtaagactgatgccttccgccgacgcaggtggcggagaaggatggagcccttagaaaaaactgggcctgcagctgttttcgcgctcgaaggcgctttaggcggtgtcatggacgacaagtctgaagacagtatgagcgtgtctactttgtccttcggcgtgaacagacctactatttcctgcatcttcgactacggaaacaggtaccatctccggtgctacatgtaccaggccagagacctcgctgctatggataaagactccttttcagatccatatgccatcgtgtcctttctgcatcaatcccaaaaaacagtcgtcgttaagaacacccttaaccccacatgggatcagacactgatcttttacgaaattgaaatcttcggggaaccagcaactgttgcagagcagccacctagcatcgttgtagagttgtacgatcatgatacttatggagccgatgaattcatgggtagatgcatatgccagcctagtctggaaagaatgccaaggctggcctggtttccccttacaagaggttcgcaaccttcaggcgagctgttagcttccttcgagctaatccagcgggaaaagcccgctatccatcacattccgggatttgaggtgcaggagactagtcggatcctggacgagagtgaggatactgacctgccatatccaccaccgcaacgagaggcaaatatatatatggtaccacagaatattaaaccggcactgcagcgaacagccattgaaatcctggcttggggcctgcggaacatgaaatcataccagctagcaaacatatctagcccaagtctggtggtggagtgtgggggacagactgtgcagtcatgtgtcattagaaacctgagaaagaatcccaattttgacatctgcacgttattcatggaggtcatgctccctcgggaagagttgtattgtccacccatcactgtgaaggtgattgacaaccggcagtttggcagaaggcctgtggtgggccagtgtaccattagatctcttgaatctttcctctgtgacccttattctgcagaatctcccagcccacaaggaggtccagatgacgtgtcgctgctgtctccaggagaggatgtcctgattgatattgacgataaggagcccctaatacctattcaggaggaggagttcattgactggtggtccaaatttttcgctagcatcggcgagagggagaaatgtgggtcatacctggagaaggactttgacacactgaaggtgtacgacacacagctggagaacgttgaggcctttgaagggctttccgacttttgtaacacgttcaaactatataggggaaagacacaggaggagaccgaagatccttcagtgatcggcgagttcaaaggcctgtttaaaatctacccgctgcctgaagacccggctatcccaatgcctccccgtcagtttcatcagctcgccgctcaaggtccgcaggagtgtttggtaaggatttatattgtgagggctttcggacttcaacccaaagatccgaacggcaagtgcgacccgtacattaaaattagtataggcaaaaagagcgtttctgaccaggacaactacattccttgtacacttgaacccgtctttggtaaaatgttcgagctgacctgtactctgccccttgagaaagatttgaagatcaccttgtacgattatgacctgctgtccaaagatgaaaagattggagagacggtggtagacttggagaaccgcctgctgagcaaatttggcgcaaggtgtggtcttccccaaacatactgcgtgagcgggccaaaccagtggagagaccaactccgcccatcacagttgctgcaccttttttgtcagcaacatcgagtcaaggctcctgtgtacagaaccgaccgtgtcatgtttcaggataaggaatactctattgaggaaatagaagccggtcgtattcctaatccgcacttgggcccagtggaggagagactggctctccacgtgttacagcagcagggtctggtccctgagcatgtcgaatcacgccctctgtatagccccctccagcctgacattgaacagggaaaactccagatgtgggttgacctctttcccaaggctctgggtagacctggccctcctttcaacataacacctcgcagggcgaggaggttcttcctgagatgcatcatttggaacacccgcgatgtcattctcgacgatttaagtcttaccggagaaaagatgagtgacatctatgttaagggctggatgatagggttcgaggaacacaagcagaaaacagacgtacactaccgttctctgggcggagagggcaactttaactggcgctttatcttccccttcgattatcttccagcagagcaggtgtgcacgatcgccaagaaggatgccttctggcgtctcgataagacagagtccaagatccccgcacgcgtggtgttccaaatttgggataacgataagttctcttttgacgacttccttggtagcctgcagttagatctgaaccgtatgcctaaacctgcaaagaccgctaagaagtgctctctagatcaattggacgacgcctttcaccccgagtggttcgtgagcctgttcgaacagaagaccgtcaaagggtggtggccttgtgtagcggaggaaggggaaaagaaaattcttgccggaaagttagagatgactctggagatcgtcgctgagtcagagcacgaggagagacccgcaggacaaggtcgcgacgaacccaatatgaacccaaagctggaagatccacggagaccagatacatcgttcctttggtttacgtcaccctacaagactatgaagtttattctctggcggcgattcagatgggccattatcctatttatcatactgttcatcttactcctgtttctggccatattcatatacgcattcccaaattatgcagcgatgaagctggtgaaacccttctcctaa

SEQ ID NO: 4338 - DNA, 6267 bp, Artificial Sequence
  Description of Artificial Sequence: Synthetic coding sequence
atgctttgttgcctcctcgtccgggcaagcaatctccctagcgcgaaaaaagaccgcaggtctgaccctgtcgcctctctgaccttccgcggagtaaagaagagaaccaaggttattaagaatagcgtcaatcccgtctggaatgaagggtttgagtgggaccttaaaggcataccattggaccagggcagcgaactgcacgtggtggtgaaagatcacgaaacgatgggacgcaacagattcctcggcgaagctaaagtgcccctacgcgaggtgctggcaacgccctctttatcagccagcttcaacgctccgctactggataccaaaaagcaacctacaggtgccagtctcgtgctacaggtcagttacacaccccttccgggtgccgtcccactctttcctccaccgacccctctggagccctcgccaacgctccctgacctggacgtggttgcggatacaggcggagaagaggatacggaggaccagggcctcaccggtgatgaggcagaacctttcttagaccaaagtggagggcctggggcacctaccacccccagaaagttaccctctcggccaccaccacattatcccggaataaaaaggaaacgaagcgctcccacaagtagaaagctcctgagtgataaaccccaggactttcaaatccgcgtgcaggtcattgaagggaggcagctgccaggcgtgaatatcaagcccgttgtgaaagttaccgccgcagggcagacgaaaaggacccggatccacaagggaaatagtcctctttttaacgaaacgctgttctttaatttattcgattctccgggtgagctattcgatgagcccatttttatcaccgtggtggacagcagatccctgcgtaccgatgccctactgggcgagttcaggatggatgttggtacaatttatcgcgaaccacgacatgcctaccttcgaaaatggctcctgctttctgatcccgatgatttctcagccggtgccagaggctatctgaagaccagtctgtgcgtgctggggcctggggatgaagcccctctcgagcgaaaagacccatcagaggataaggaggatatcgagagcaatctgctgcgaccaacaggtgtagctcttcgtggggctcacttctgcctgaaggtcttcagggcggaggatctcccccagatggatgatgctgtcatggataacgtcaagcaaatcttcggattcgagagcaataaaaaaaacttggtcgacccctttgtggaggtttcattcgccggaaaaatgctgtgctccaagattctcgaaaagacagctaacccgcagtggaatcagaacatcaccctccccgcaatgttccctagtatgtgcgaaaagatgcgaatccgaattattgattgggatagacttactcataatgatattgtggccaccacctatctgtctatgtccaaaatatccgcacccggaggagagatagaagtggatgactatctgggattcttaccaactttcggcccttgctatataaatctttacggctcacctagagaatttaccggctttcctgatccatataccgaacttaataccggaaaaggagagggcgtcgcctatcggggaagacttctcctgagcctggaaacaaagctggttgaacactctgaacagaaggttgaggacttgcccgcagatgatatcctgcgcgtggaaaagtatcttaggcggaggaagtattccttgtttgccgctttttattctgccacaatgctgcaggacgtcgatgacgccattcagtttgaggtctccattggaaattacggtaacaaatttgacatgacctgtctgcccctcgcctccactactcaatacagtagagccgtttttgatggctgccattattactatctcccctggggcaacgtgaagccagtcgtggtcctgtcatcctattgggaggatatctcacacagaattgagactcagaaccagttgttgggcatagccgatcgattggaagctgggctggagcaggtccacctggccctgaaagcccaatgttctactgaagacgtggactcgctcgtagcccagctaaccgacgaattaattgcgggatgttctcagccccttggcgacatccatgagacccctagcgcaacacatctggaccaatatctttaccagctgagaactcatcacctttcccagataactgaggccgcactggccttgaagttaggccattccgagctgcccgcagccttagagcaggccgaagactggctgctgaggctacgggcactggctgaagaaccgcagaactcattacctgacattgttatttggatgctgcaaggggacaaaagagtcgcctatcagcgcgtccctgcccatcaggtattattctctaggaggggcgcaaattactgcggtaagaactgcggaaagctccagacgatttttctgaaatacccaatggagaaggtgcctggggcaaggatgcctgtacagattagagtgaaattgtggtttggcctttctgtcgatgagaaagagttcaatcagtttgcagaagggaagttgagcgtgtttgcagaaacttacgaaaacgaaaccaagctggccctggtagggaactggggaacaacaggacttacctacccaaagtttagcgatgtgaccggcaagataaagctgcctaaggacagttttaggccttcagcgggatggacctgggcaggtgattggttcgtatgccccgaaaaaactctccttcacgacatggatgccggtcatctgagcttcgtggaagaggtctttgaaaaccagactcgtttgcccggtggtcagtggatatatatgtccgacaattacaccgatgtgaatggtgagaaagtgctcccaaaggatgatattgagtgccccctggggtggaaatgggaggatgaggaatggagcaccgatctcaatagagccgtggatgagcagggctgggagtacagtattaccatacctcctgagaggaaacccaagcactgggtccccgcagagaaaatgtactacactcacagacggcgacgttgggtgcggttgcgcaggcgagacctctcgcagatggaagctctaaaacggcatagacaggcagaagctgagggtgaaggatgggagtatgctagcttgtttggttggaagtttcacctcgagtaccggaaaaccgacgctttccgcaggagacgttggcgcaggcgcatggaaccattggaaaagaccggaccggctgcggtgtttgcattggaaggtgctctcggaggcgtaatggacgacaaatccgaagactccatgagcgtgtcaaccctgagctttggcgtcaacagacctactataagttgtatcttcgattacggcaatagatatcatttacgctgctacatgtaccaggccagagatctggcggcaatggacaaggattctttcagcgacccctatgcaattgttagttttctgcaccaaagccagaaaacagtggtcgttaaaaacaccctgaatcccacttgggaccaaacattaatcttttacgagattgaaatttttggcgaacccgcaaccgtggccgagcaaccacctagtatcgtcgtggaactgtacgatcatgatacctatggagcagacgaattcatgggcaggtgcatctgtcaaccatccctcgaaaggatgccgagactggcttggttcccacttactcggggaagtcagccgtcaggtgagctgctggccagtttcgagcttatccagcgtgaaaagcctgctatccaccatatccccggttttgaggtgcaggaaaccagtcgcattctggacgaaagtgaggatacagatttgccttacccgcctccccagcgtgaagcaaacatttacatggtgccccagaacatcaaaccagcactccagcggacagccattgagattttggcatggggccttaggaatatgaagagctaccagttggccaatatttcctcccccagcttagtcgtggagtgtgggggtcagaccgttcagagctgcgtgattagaaaccttcgaaagaaccctaatttcgatatttgtaccctgttcatggaggtgatgctcccccgagaagaactgtactgccctcccataactgtcaaagtcattgacaaccgtcaattcgggagacgacctgtcgtggggcaatgcacgatacgctccctggagagttttctctgtgacccctatagcgccgagtcaccctcacctcaggggggtcctgatgacgtgtcactcctcagccccggtgaagacgtgcttatcgacattgacgacaaggagcccctgattccaatacagttggctgacgggctgtcatcactcgcccctactaacaccgcttctcctcctagctcaccacatgaggaggaattcatcgattggtggtctaaattttttgctagtatcggagagcgggaaaaatgtggaagctacctggagaaggactttgacacccttaaggtttatgacacacagctggagaatgtggaggcttttgagggcttaagcgacttctgcaacaccttcaaactttatagaggaaagacccaggaggagactgaggacccatcagtaattggcgaatttaaaggattgttcaaaatataccccttgcctgaagacccagcaatcccgatgccaccacggcagtttcaccaactcgccgctcaggggccacaagaatgtctggttcgtatttacatcgttcgcgcttttggcttgcaacccaaggaccccaatgggaagtgcgatccttacatcaagataagtattgggaagaaatctgtgtccgaccaggataattacattccctgtacactcgagcccgtttttggcaaaatgtttgaactaacctgcacactccctctggagaaagacttaaagattaccctgtatgactatgatctgttaagtaaagacgaaaaaatcggggagacagtcgtagacttggagaatcggctgctgtcaaaattcggcgctcgctgtgggcttccacagacctactgcgtgagtggccctaatcagtggcgcgaccaactgcgaccatctcagctcctgcacctcttctgccagcagcatagagtgaaggccccagtataccgaaccgatcgtgttatgtttcaggataaggagtactctattgaagagattgaagccggtcgcatcccaaacccccacctaggaccagtagaggagcgactggcccttcatgtgctgcagcagcaggggctggtccctgagcatgtggagtctaggcccctgtacagccccttgcaacctgacatcgagcaaggcaagctccaaatgtgggtggacttgttccctaaagctttgggtagacccggtccccctttcaacataacacccaggcgggctcggcgattctttttaaggtgtattatttggaatacccgcgacgttatcctagacgacctgtcgctgactggagaaaaaatgtccgatatttacgtcaagggttggatgatcggcttcgaagagcataaacagaaaaccgatgtgcattatcgcagcctcggcggagaaggtaattttaactggcgcttcatctttccatttgactatctgccagctgagcaggtgtgcacgatcgccaagaaagatgctttctggaggctcgacaagacagagtccaaaattcccgcacgcgtcgtgttccaaatctgggataacgataaattttccttcgatgatttcctgggatcactacaactcgacttaaatagaatgccaaaacctgccaaaaccgcaaagaagtgcagcctggaccagctcgacgatgccttccacccagaatggtttgtctctctgttcgaacagaaaacggtgaaaggctggtggccatgcgtggccgaggagggggaaaaaaaaatccttgctgggaagctcgagatgacgctggaaatcgtggctgagagcgaacatgaggagcggccagccggtcagggcagagatgaaccgaatatgaatcctaaacttgaagatcctcgacgcccagatacctcttttttgtggttcacgagcccttataaaacaatgaagttcatcctctggagacgattccgatgggctattatcctgtttatcatcctgttcattcttctactgttcctggcaatctttatctacgcattcccaaactacgcagccatgaagcttgttaaacccttcagctag

SEQ ID NO: 4339 - DNA, 6294 bp, Artificial Sequence
  Description of Artificial Sequence: Synthetic coding sequence
atgcttcgggtctttatcctatatgccgaaaacgtccacacccctgataccgatatctctgacgcctactgcagtgcggtgttcgccggagtcaagaagcggacaaaagtgatcaagaatagtgttaatcctgtttggaatgagggttttgagtgggatcttaaagggattccactcgatcaaggctcagagctgcatgtggttgtaaaggatcacgaaactatggggcgaaatcggttcctgggagaagccaaggttcctctgcgcgaagtgttagcaacaccctccctgagcgcatccttcaacgcccctctcctagatacaaagaaacagcccaccggcgcttccttagtcttgcaggtttcctatactccactccctggcgcagtgccactcttccccccaccgacacctctggagccatcacctaccttgcctgacctggatgtggtcgccggtggagggcagagccgcgctgagacatggtctctgttgtcagactccactatggataccagatatagcggtaagaagtggcctgctcctacagacaccgggggagaggaggacacagaggatcaagggttaacaggagacgaggccgagccctttctagatcaaagtggcggacccggtgcacccaccacaccaagaaaactgccctccagacctccaccccattatccgggaatcaagcgtaagaggagcgcccctacaagtcgcaagcttctgagcgataagccacaagattttcagattcgggtgcaggtgatcgagggtaggcagctcccaggtgtgaatatcaagcccgtggtcaaagtgacagcagctggccaaactaaaagaaccaggatccacaagggcaattcgccgctcttcaacgaaaccctctttttcaatctctttgactcgccaggggaactgtttgacgaaccaattttcatcactgtggtagactcgagaagcttacgcacggacgctctgcttggtgagttcaggatggatgtgggtaccatctaccgcgagcccagacatgcctatttgcgcaagtggctgcttctctccgatcccgacgattttagcgccggagctcgaggctacttaaagacctctttgtgcgtgttaggacctggcgacgaagctccactcgagaggaaggacccctctgaggataaagaggacattgaatctaacttgctgcgccctaccggagtcgccctcagaggtgcacatttttgtcttaaggtcttccgcgctgaggacttgccacagatggacgacgctgtgatggacaacgtgaagcagatctttggcttcgaaagcaacaaaaaaaatctggtggaccctttcgtagaagtgtccttcgcaggaaagatgttgtgtagcaaaattcttgagaaaaccgcaaaccctcagtggaaccagaatatcaccctgccagctatgtttccctcaatgtgtgaaaagatgcgaatccgcattatcgattgggacaggctgactcataatgatatcgttgcgaccacctatctgtccatgtcaaaaatttcagccccaggcggagaaattgaagtcgacgattacttgggatttctccccactttcgggccttgttatataaacctgtatgggtctccgagagagttcacgggctttccagacccatacaccgagctgaatacagggaaaggtgagggggttgcataccggggacggctccttctcagcctggaaacaaaactcgttgagcactctgaacaaaaagtggaggaccttcctgccgacgatatcttgagagtcgagaaatacctccgtcgtcgcaagtatagcctttttgccgctttttactcagcaaccatgcttcaagatgtggatgatgccattcagtttgaggtgtccataggcaactatggtaataaatttgacatgacttgtctgccgttagcgagcaccacccaatacagccgcgctgttttcgatggctgccactattactatttgccatgggggaacgtcaaacccgtggtggtattaagctcttactgggaggacatcagtcatcggatagagactcagaatcaactcctgggaatcgccgacaggctggaagccggactcgaacaggtccacctcgctctgaaagcccagtgctccacggaggatgtggattcgctggtggcccaactgacggacgaattaattgcaggatgctcccagcccctgggagacatccacgagaccccttccgcgacccacctggaccagtatctgtatcagctgagaacccaccacctttctcaaatcactgaggctgccttggctcttaagctggggcattctgagctccccgctgctttggagcaagccgaggactggcttttacggctccgtgctctcgccgaagagccacagaattcgctgccagatatcgttatctggatgcttcaaggagataaacgcgtggcttaccaacgcgtgcccgctcaccaggtcctgttctcgagacggggagctaactattgtggcaagaactgtggcaagctgcaaaccatctttctgaagtacccaatggagaaggtgcccggagctagaatgccagtccagattagagtcaaattgtggtttgggctgtctgtggacgagaaagaatttaaccaattcgcggagggcaaattaagcgtgttcgctgaaacctatgagaacgagacgaagctagcattagtcgggaactggggtacaacaggcctgacgtacccaaaattctccgacgttactggcaaaataaagctgccgaaggactcatttagaccttcggccggttggacctgggcaggggattggtttgtgtgcccagaaaagacactcctacatgacatggatgcaggccacctgtcttttgtggaggaggtttttgaaaaccagactaggctgcctggtgggcagtggatctacatgagtgataactatactgatgtcaatggcgaaaaggtcctcccgaaggacgacatcgaatgcccgctcgggtggaaatgggaggatgaagagtggtctacagatttgaatagggctgtggacgaacagggttgggagtacagtatcacaattcctcctgaaaggaagccaaaacactgggtgcccgctgagaagatgtattacacacaccgcaggaggaggtgggtgagattgcggcgacgggacttgtcacagatggaggctcttaaacgccaccgccaagcggaagctgagggagagggttgggagtacgcctccctgtttggttggaagttccaccttgaataccggaaaacggatgcgtttcgtcgccgtaggtggcgacgccgaatggaacccctggaaaaaaccggtcctgccgcagtgttcgcgttggagggcgctctcggtggggtgatggatgacaaaagtgaagattccatgtccgtctctacactttccttcggcgtcaaccgcccaactatctcctgtatattcgactacggcaatcgctaccatctgcggtgttatatgtaccaggcccgagatcttgccgcaatggacaaggatagcttctctgacccctatgccattgtgtcattcctccaccagtctcagaaaacagtggtcgttaagaatacattgaatcctacctgggaccagaccttgatcttttatgaaatagaaattttcggggaaccagctaccgttgcggaacaacccccaagtattgtggtggagctgtatgatcatgatacttacggcgctgatgagttcatgggcagatgtatctgccaacctagcttggagcgcatgcctagactggcttggtttcccttaactaggggaagccagccttcaggggaattgctcgcatcattcgaactgatccaaagagagaagcccgctatccatcacataccagggtttgaggtgcaggagacgtcccggatcctcgatgaatccgaggacacagatctcccctaccctccacctcagcgcgaagctaacatctatatggtcccccagaatattaagcccgcacttcagagaactgcaatagagattctggcgtggggtctgaggaatatgaaatcctaccaactggccaacatcagcagcccaagcctggtggtggagtgcggcggacagaccgtgcagtcctgcgtgattagaaatctgcggaagaaccccaattttgacatatgtaccctgttcatggaagtgatgctcccccgtgaggagctttattgtccgcctatcacagtgaaagtcattgataacaggcagtttggcaggcgcccagtcgttggacaatgtacaatccgcagccttgagtcattcctgtgcgacccatatagcgcagaaagcccttccccccagggcggacccgatgatgtgtcactgctatccccgggagaagacgtgctgatcgatatcgacgataaggagcccctgatacccatacaggaggaggaatttattgactggtggagtaaattcttcgcctctatcggcgagagggagaagtgtggcagttacctcgagaaggattttgacaccctgaaggtgtacgacacacaattggagaacgtcgaggcgtttgaagggctgtcagacttttgcaatacctttaaattataccgtgggaagactcaagaagaaaccgaggatcccagcgtgatcggcgaattcaagggactctttaagatctatcctctgcccgaagatcctgctatccctatgcctccccgtcaatttcaccagctggccgctcagggaccccaagagtgcctggttaggatctacattgtgcgcgcatttggcttacagcctaaagaccccaatgggaaatgtgacccatacatcaaaattagtatcggaaaaaaaagtgtgtccgatcaagacaactacattccctgtaccctggaacccgtatttgggaagatgttcgagctcacctgtactctcccactcgaaaaagacctaaagattactctctacgattacgacctgttgagcaaggatgaaaagatcggcgaaacggtggtggacttagagaaccggctgctcagcaaatttggagcccgatgtggattgccacagacttactgcgtgagcggaccaaatcaatggcgggatcagctgaggccaagtcaactcctccacttattctgccaacaacaccgagttaaggccccagtctacaggactgatcgagtgatgttccaagacaaggaatatagcattgaagagatagaggctgggaggatccccaacccccatctgggaccagttgaggaaaggctggcattacacgtgctccagcagcagggtctggtccctgagcacgtcgagagccgtcccttatatagtccactgcagccagatatagaacaagggaaacttcagatgtgggtggacttattccctaaagccctgggccgacccggaccaccgttcaacataacaccgaggcgcgctagacggttcttcctgcgctgtataatctggaacaccagagacgtgattctagacgacctttctctgactggggagaagatgagtgatatttacgtgaaggggtggatgatcggtttcgaagagcacaaacagaagaccgatgttcactataggagtctcggtggcgaaggaaactttaactggcgctttattttcccttttgactacctgcctgcagaacaggtatgcaccattgccaagaaagacgctttttggaggctcgataagactgagagtaaaatcccagcacgagtggtctttcagatttgggataatgacaaatttagcttcgacgacttcctcgggtccctgcaacttgatttgaacaggatgcctaagccagccaagaccgcaaagaaatgcagtctcgaccaattagatgacgctttccatcccgaatggttcgtgtccctcttcgaacagaagaccgtcaaaggctggtggccttgcgttgccgaagagggcgagaaaaagatactcgcagggaaactggagatgacccttgagattgtagcagagtctgagcacgaggaaagacctgcaggtcagggacgagatgagcctaatatgaatccaaagctagaggaccccagacgtcccgacaccagcttcctgtggtttacctcaccttataaaaccatgaagtttatactgtggcgcagattccggtgggcaataattctcttcattatcctctttatactcttgttatttctcgcaatcttcatatacgcctttcccaactatgccgcaatgaaactggtaaagccgttcagctaa

SEQ ID NO: 4340 - DNA, 6360 bp, Artificial Sequence
  Description of Artificial Sequence: Synthetic coding sequence
atgttatgctgcctgctcgtgagggcgtccaatttgccatccgccaaaaaggatagacggagcgacccagtggcatctctgacttttagaggagtcaaaaaacggactaaggtgatcaaaaacagtgtaaaccctgtttggaatgaagggtttgagtgggatttgaaaggaattccgctggatcagggctcagagctccacgtggtggtgaaagaccatgagaccatgggtcgaaatcgcttcctgggcgaggccaaggtgcctcttagggaagtgttagctactccaagcttaagcgcttctttcaacgcgccactgctcgatacaaagaaacagcccacgggcgcatccctagttcttcaggtgagctacacacccctgccaggtgccgtgcccctcttcccccctcccacaccactggagccttcacctaccctgccagatctggacgttgtggcagggggtggtcaatcacgcgctgagacttggtctcttttatcagactcaaccatggataccagatactctggtaagaaatggcctgctcctacggataccgggggtgaagaggatactgaagatcagggactgaccggcgatgaggcggagccctttctggatcagagcggagggccaggggcaccaacgactcccagaaaactgccaagccgaccccctcctcactaccccggaatcaaaaggaagcgatctgctccaacaagccgtaaactcctatccgacaagccccaggacttccaaattcgtgtgcaggtcattgagggaagacaactgcctggggttaacatcaaacccgtggtgaaggttaccgcagctgggcagaccaagagaactcgtattcacaagggaaattcgccactgtttaacgaaaccctctttttcaacctgttcgactcccccggagagttgttcgacgagccgatcttcataacagtggtggactcccggtcccttcggaccgatgccttactgggggagtttcgcatggatgtgggcacaatctatcgtgagcctaggcacgcctacttacgcaagtggctgttgctgtccgacccagatgacttttctgctggcgcacgcggatatctgaaaacatctctctgcgtcctgggcccaggagacgaggcccctctggaacggaaggatccctctgaggataaagaagacatcgagtctaatctactgaggccgacaggagttgcgttgagaggggctcatttttgcctgaaagtgttcagagccgaagatctcccacagatggatgacgccgtgatggataatgtcaaacagattttcggcttcgagagcaataagaaaaatttagtggatccgttcgtagaggtgtcattcgccggaaagatgctgtgctccaagattctcgaaaaaacagctaatccccagtggaatcagaacataacacttcccgctatgttccccagcatgtgcgagaagatgcgaataaggataatcgactgggatcgtctgacccataatgatatcgtggcgactacatatctgtcgatgtctaagatcagcgcacccggtggggaaattgaggtggatgactacttaggattcctgcccacctttggcccatgttacatcaacctctacggttccccaagagaattcacagggttccctgatccgtatacagagttgaacaccggcaaaggcgagggcgtagcctaccggggtagactcctgttgtctctcgaaacaaagctcgtcgagcacagcgagcagaaagtagaggatctaccagcagatgacattcttcgagtggagaaatatctcaggcgaaggaaatacagtctgttcgctgccttttatagcgccaccatgctgcaggatgtggacgacgccatccaatttgaggtttcaataggtaactacgggaataagttcgatatgacatgtctccccctagcttcgaccactcagtattcccgcgcagtttttgatgggtgccattattattacctgccctggggcaatgtgaaacccgtggtggtgctcagtagttactgggaagacatatcacacagaatagagacgcagaatcaactgctagggatagctgacaggcttgaagccggacttgagcaggttcacctggcactaaaggcacagtgctctaccgaagacgtcgacagcctagtggcacagcttacggatgagctgatagccggttgttctcagccgctgggtgacatccatgaaaccccctcagccacgcatctggaccaatatctgtatcaactgagaacccatcacttaagtcaaattaccgaagccgcactggccctcaagctgggacatagtgaacttcctgccgctctggaacaggctgaggactggctgctccgcctgcgggctcttgctgaagagccacagaactccttgccagacatcgtcatttggatgctacagggagataagcgcgtggcctaccagcgcgtgccagcccaccaggtgctcttcagcaggaggggagctaattactgcggcaagaactgtggaaagctccagactatctttctgaagtatcctatggaaaaagtcccaggcgctaggatgcccgtgcaaatcagggtgaaattgtggtttgggctcagtgtggatgaaaaagagtttaatcagttcgctgagggaaaactctctgtgtttgcagagacctacgaaaatgagactaaattagccctggtggggaattggggtaccacaggccttacatatcccaagttcagtgatgtcacaggcaagatcaaattgcctaaggactcattcagaccctcagccggttggacatgggcgggagactggttcgtctgccctgagaaaaccctgctgcacgatatggatgctggacatctgagttttgtggaggaggtgttcgaaaaccagaccaggctccccggtgggcagtggatttatatgagcgacaattatacggacgttaacggcgagaaggtgctgccaaaggacgacatcgagtgcccactaggatggaagtgggaggatgaggagtggagtactgatctcaaccgggcagtcgacgagcagggatgggaatacagcatcacgatccctccagaaagaaaacctaagcactgggtgccagcagagaaaatgtactacactcatcggcgtagacggtgggtgaggttacgaagacgcgatcttagtcagatggaggcactgaaacggcacagacaggctgaggccgagggggaagggtgggaatacgcctctctctttggctggaagttccatctggagtaccggaagactgatgctttccggagaagacggtggcggaggcggatggagcctctggaaaagacaggtccagctgcggtctttgccctcgaaggggcactcggcggagtcatggacgataagtcagaggattcaatgtcagtatccaccctctcctttggtgtgaacaggcccaccatcagttgcatattcgattacggcaatagatatcacctccgttgttacatgtaccaagccagagatctggcagcaatggataaggacagtttctcagatccttacgctattgtttcattcctccatcagtcccaaaagaccgtcgtagttaagaacactctgaatcccacttgggaccagactttaattttttatgaaatcgagatatttggcgagccagcaacggtcgcggaacaaccacccagtatagtcgttgagctgtatgatcacgacacatatggcgctgacgagttcatgggaaggtgcatctgccaacccagtctcgaacgaatgcccaggctggcatggtttcctctaacgcgcggatcacagccttctggtgaactcctggcctccttcgagctgattcagcgtgaaaagccagcgattcatcacattcccggttttgaagtgcaggagaccagcagaatccttgatgaatctgaggatacagatctcccttatcccccaccccagcgcgaggccaacatttacatggtaccacaaaacataaaacccgcactccagcggaccgctatcgagatattggcgtggggcctgcggaacatgaaatcctaccagcttgccaatatctcatcacctagcttggtggtggagtgcggcggtcagacagtacagtcgtgtgtgatccgcaatctgaggaaaaacccaaattttgatatttgcacgttatttatggaggtcatgctgcctcgagaggaactgtattgccccccaatcactgtgaaagtaatcgataacagacagttcggacggagaccagtggtgggccagtgtaccattcggtcactggagagcttcctgtgcgacccatacagtgcagagtcgccgtctcctcagggcggacccgacgacgtttccctgctctcaccgggagaggatgtactgattgacatcgatgataaggagccactgattcctatacaactagccgatggcctttcatcactagcacctactaatactgccagcccccctagttcgcctcacgaagaggagttcatcgattggtggtccaagtttttcgcttctatcggtgagagagaaaaatgtgggtcctacttagaaaaggacttcgacactttgaaggtgtacgatacccaattggaaaacgtggaagcgtttgagggattgtccgacttctgtaatacatttaaactctacaggggcaagacccaagaagaaaccgaggatccttcagtgatcggtgagttcaaaggtctgttcaagatctatcctctccctgaagatccagccatccctatgcctcccagacagttccatcagctggctgcacaggggccacaggaatgtctcgtaagaatttatattgtgagagccttcggactccagcctaaggacccaaacggtaagtgtgatccatatattaaaatatcgataggtaaaaagagcgtctccgaccaggacaactacatcccatgcactctggaacccgtgttcggtaaaatgtttgaattaacctgcacactgcccttagaaaaggacctaaagatcacactgtatgattacgacctgctgtctaaagacgagaagattggagagactgttgtggatctcgaaaaccgcctcctcagcaagttcggggcaagatgcggccttcctcagacctattgcgtctcaggccctaaccaatggcgtgatcagctgaggccaagccaactcctgcatctattttgccagcagcacagggtgaaggccccagtctaccgaacagacagggtgatgtttcaggacaaagagtattccattgaggagatcgaagcagggaggattcccaacccccacctcggaccggtggaggagcgcctcgcattgcatgttctccagcagcagggattggtccccgaacatgtcgaatctcggccattatattctccactccaacctgatatcgaacaggggaaacttcaaatgtgggtcgacctgtttcctaaagctttggggcgtcctggtcctccctttaatatcacacctcgtcgggcaaggcggtttttcctgcgatgcatcatctggaatacccgtgacgtcatccttgacgacttgtccctaacaggcgagaaaatgagcgatatttacgtgaagggttggatgattggatttgaggagcataagcagaagactgacgtgcattatagatcacttgggggagagggcaattttaactggcggttcatcttcccctttgactacctccccgctgagcaggtgtgtaccattgcaaaaaaagacgcgttttggcgcctggacaaaaccgagtccaagatccccgctagggttgtcttccagatctgggataatgataagttcagcttcgacgactttctgggcagccttcagctcgacctaaaccgaatgcccaaaccagccaagaccgccaagaaatgtagccttgatcagctcgatgacgcctttcacccagagtggtttgtatctcttttcgagcaaaaaaccgtcaaggggtggtggccatgtgttgcagaagagggtgagaaaaagatcctggccggaaagctcgaaatgacacttgaaattgtcgccgaatccgagcacgaggagagacctgccggtcagggcagagatgagcctaacatgaatcctaagctagaagaccctcggagacctgatacttctttcctgtggtttacttccccctacaaaacaatgaagtttatcttgtggcggaggtttcgctgggcgattattctctttatcattctctttatcttgctcctcttcttagcgatttttatctatgctttccctaattacgcagcaatgaaattagtcaagcctttttcatag

SEQ ID NO: 4341 - DNA, 6297 bp, Artificial Sequence
  Description of Artificial Sequence: Synthetic coding sequence
atgctgtgttgcctgctcgtacgcgcatcaaacctcccgtcagctaagaaagaccgccgatccgatcctgtggcgagtctcacctttagaggcgttaagaaaaggactaaggtcattaagaacagcgtcaaccctgtgtggaacgaggggttcgaatgggacctcaagggaattccactggatcagggctccgagttgcacgtggtcgtgaaggaccatgagactatgggcaggaaccggtttctgggagaggccaaagtgcctctgagggaggtcttagccacacccagtctttctgcctcctttaatgccccattgttagatacgaagaaacagccaaccggcgcttctttggtgctccaggtcagctacacaccgctcccgggagccgtgcctctttttccccctcccactccgttggaaccatccccaacgctcccagatctggacgtggtcgcaggcggaggtcagtctcgcgctgaaacatggtcacttctgtcagactcgaccatggatactcggtatagcggcaagaaatggccagctcctactgacaccgggggagaggaggacacggaagaccaaggcctgaccggtgatgaggcagaaccctttctggaccagtccggtggcccaggtgctcctaccacgcctcgtaaactgccgagccgcccaccacctcactaccccggaatcaagagaaaacggtctgcacctacatcacgcaagctgctgtcggataaacctcaggactttcaaatccgagtacaagtaatcgaagggcgacagctccccggagtcaacattaagcccgtcgtgaaagtaacagccgcaggccagacaaaacgcacccgtatacataagggtaattctccgctgttcaacgaaaccctgttttttaatctttttgacagcccaggcgagctcttcgacgagccgatcttcattacagttgtggattctagatcattgagaaccgacgcccttctgggcgagttccggatggacgtgggcacaatctacagggagccaaggcatgcctatttacgcaaatggcttttgctctctgaccccgacgatttcagtgctggggctagaggctatttgaaaaccagtctgtgcgtgctggggcctggtgacgaagctccactggaaaggaaagacccctccgaagataaggaggacatcgagagcaaccttctgcgccctaccggagtggcgctgagaggcgctcacttttgtctgaaggttttcagggccgaagacttaccccagatggatgacgcagtgatggacaacgtgaaacagatttttgggtttgagagcaacaaaaagaatctagttgacccctttgtcgaggtgagctttgcaggcaagatgttatgtagcaaaatcctcgaaaagaccgcaaaccctcaatggaaccagaacatcacactccctgccatgtttcctagcatgtgcgagaagatgcgtatccgcataatcgattgggatcgccttacccataacgacattgttgccaccacttaccttagcatgagcaaaatttctgcgccaggtggggagatcgaagtggatgactaccttgggtttctgcccacttttgggccatgctatatcaatttatatggatccccgagggagttcactgggtttcctgatccatacacagagctgaataccggcaagggggagggggttgcctatcgtggccgtctgcttctgagtctggagactaagctggtggaacattccgagcaaaaggtggaggatctacctgcagacgatatcctccgtgtggagaagtaccttcgcagacgcaaatatagtcttttcgcggctttctactccgcaactatgcttcaagatgtggatgacgcaatccaatttgaggtgagtatcggcaattatggcaacaaatttgatatgacctgtcttcccctggcttcaaccacgcagtacagcagagccgtcttcgatgggtgtcactattactacctcccctggggaaatgtgaagcctgtggtggtgttgtcgtcttactgggaggacattagccaccgcatcgagacacagaaccagctgctgggcattgcagacaggctggaggcaggcctcgaacaggtacacttagcactgaaggcccaatgttcaaccgaggatgtagacagtttggtggcccagctgaccgacgaactgatcgcaggttgcagccagccattaggagacatccatgagaccccgtctgcaacgcacctcgaccagtatttgtaccagttaaggactcaccatctttcacagataacagaagcggctctagcgctcaagctgggtcacagcgagctgcccgcagcccttgagcaggctgaggactggcttcttcggctgcgggctctggcggaggagccccagaattctctgcccgacatcgtgatttggatgcttcaaggagataagcgcgtggcctaccagagggtgccggcacatcaggtccttttcagtcgacggggagccaactactgcggaaagaattgtgggaaactgcagactattttcctcaagtatcccatggaaaaagtccccggagcacggatgcctgttcagatccgcgtcaaactgtggttcggtctgagtgtggacgagaaggagtttaaccagtttgccgaggggaagttgtccgtatttgcagagacttatgaaaatgagactaagctggccttggtgggtaattggggcacaaccgggctcacttatccgaaatttagcgacgtgaccggaaaaattaaattgccaaaggattcatttagaccctcagccggatggacctgggcgggagattggtttgtgtgcccagagaaaactttgctgcatgatatggatgccggacacctgtcctttgtggaggaggtctttgagaaccagactaggctaccaggaggccagtggatttacatgtccgataactataccgatgttaacggcgaaaaggtcttacccaaggacgacatagagtgccctctgggatggaaatgggaagacgaagaatggtctacagacctcaatcgcgcagtggatgagcagggctgggagtacagcattaccatccctccagagagaaaaccgaagcactgggtgccagcagagaagatgtattacacacaccgacgacggcgttgggtgagactgaggaggcgggatctcagtcagatggaggcgttaaaacgacatcgccaggcagaggcggagggcgaagggtgggagtacgctagcctgtttgggtggaaatttcacttggagtacagaaagacggacgctttccggcgacggaggtggcgcaggcgaatggagccactagagaaaaccgggccagcagcagtctttgctctcgaaggagcgttgggcggagttatggacgacaagtctgaggatagcatgagtgtttcaactctgtcattcggcgtcaacaggccaaccattagttgtatttttgactatgggaatcggtaccaccttcgctgttacatgtatcaggctagagacctagcagccatggacaaggactcattctccgatccctacgctattgtgtctttcctccatcagtcccagaagactgtggtcgtgaaaaatacacttaatcctacatgggaccagacactcatcttttacgagattgaaatttttggggagcctgcaacagtcgccgaacaaccaccctctattgtcgttgaactatacgatcacgatacatacggagccgacgagtttatggggaggtgcatttgccaaccctcgcttgagagaatgccccgtcttgcatggtttcctttgactagaggatctcagccaagtggcgaattacttgcatcatttgagctgattcaacgcgagaaacccgctatccatcacatccctggcttcgaagtgcaggaaacttcccggatcctcgacgaatcagaagacactgacttaccttatcctccccctcagcgcgaagctaacatctatatggtgccccagaacataaaacctgctttgcagcgaacggcgatcgaaattctggcttggggtctgaggaatatgaaatcctatcagctcgctaacatttcttctccttccttggtcgtggaatgcggagggcaaacagtccagtcctgtgttatccgaaacctgcgaaagaaccccaattttgatatttgtaccctcttcatggaggtaatgctgcccagggaggagctctattgcccaccaattacggttaaagtcatcgacaaccgacaattcgggagacgcccagtggtgggtcagtgcacgattcgaagcttggagagttttctgtgtgacccctactcagccgagagtccttctcctcaggggggtcccgacgatgtaagcttattaagccccggagaagacgtcctgatcgatatcgatgataaggagccactgatccccattcaggaagaagagttcattgactggtggtctaaattttttgcctctattggagaacgagagaagtgcgggagttatctcgagaaagacttcgatacacttaaagtgtatgacacccagctcgagaatgtggaggcgttcgagggcctgtctgatttctgcaatacattcaaattatacagaggcaagacgcaggaggagactgaagacccatccgtaatcggagaatttaaagggctcttcaagatatatcccctgcccgaagaccctgccatcccaatgccccctcgccagttccaccaactggccgctcaggggccacaggaatgtttggtaagaatctacattgtccgggcatttggtctgcaacctaaggaccctaatggcaaatgcgatccgtacatcaagatctcgatcggcaaaaaatctgttagtgaccaagataattacatcccctgtactctggagcccgtcttcggcaagatgttcgagttgacttgcacactccccctggagaaagacctgaagattacgttatacgattatgatttgctgagtaaggacgagaagataggcgagaccgtggtcgacttagagaacaggcttctgtctaaattcggcgcaaggtgtggactcccgcaaacctattgcgtatcaggacccaaccagtggcgggatcagctgcggcctagccagctgcttcatttattctgtcagcagcaccgtgtgaaagccccagtatatcggactgaccgagtgatgttccaggacaaagaatacagtatcgaggagatcgaggcaggcaggatccctaatccccacctcggccctgttgaagagagactcgcacttcatgtactgcagcagcagggcttggtgcccgaacacgttgaatcccgccctctctactcccctcttcagcctgacatagaacaggggaagcttcagatgtgggtggacctgttccctaaggcactggggcgacctggcccaccgttcaacatcacaccaaggagagcgaggcgcttctttcttcgatgcataatctggaacacccgcgatgtaatcttagacgatctgtctcttacgggggaaaaaatgtccgatatctacgtcaaaggatggatgataggattcgaggagcacaagcaaaagaccgacgtgcattaccgttctctagggggagagggtaattttaactggcgatttatttttcccttcgattatctccccgctgagcaggtttgcaccatcgccaagaaggatgcattttggagactagacaagacagaatcaaagatccccgctcgtgtggtcttccagatctgggacaatgataaatttagcttcgatgactttctggggtctttgcagttggacttgaacagaatgccgaagcccgctaagacggcaaagaagtgcagcctcgaccagttggatgacgccttccatcccgagtggtttgtatcgctgttcgagcagaagaccgtgaagggctggtggccatgtgtagccgaggagggcgagaagaagattttagccggaaagttagagatgacccttgaaattgtggctgagtccgaacacgaggagaggcccgcaggacagggcagggatgaacctaatatgaatcccaaactggaggaccctcgccgacctgatacatctttcctgtggtttaccagtccatacaagaccatgaagtttatcctctggaggcgcttcaggtgggccatcattttgtttattatcctttttatcttgctgctttttttagcgatttttatatacgcatttccgaattacgccgctatgaaacttgtgaagcctttctcctac

SEQ ID NO: 4342 - DNA, 6335 bp, Artificial Sequence
  Description of Artificial Sequence: Synthetic coding sequence
atgctgagggtctttatactgtacgctgagaacgtgcatacccctgacaccgatattagcgatgcttattgttcagcagtctttgcaggcgttaaaaagcggactaaggttattaagaacagtgtcaacccggtttggaatgagggctttgaatgggatttaaagggtatcccgttggaccaaggcagcgagcttcacgtggtggtcaaggaccatgagaccatgggaaggaacaggttcctgggagaagcgaaagtgccccttcgggaagtgctggcaacaccctcactgagcgcatcgtttaatgcacccctgttggataccaagaaacagcccaccggggcatcattagtcctgcaggtttcatatacacccctgcctggcgctgttccacttttcccaccccctactcctttagagccatcacctaccctgccagaccttgacgtcgtggctggcggaggccagagtcgggcagagacatggtccctgttgtccgactccactatggacactaggtattccggcaagaagtggcctgcgccaaccgataccggcggagaggaagacaccgaagatcagggcctcacaggcgatgaggccgagccatttctggatcagagtggagggcctggggctcctacaacaccacgcaaactcccgagtaggccgccaccacactatccgggaatcaaacggaaaaggtccgcccctacctccaggaagcttctgtctgacaagcctcaggactttcaaattcgtgtgcaggtaatcgaagggcgacagcttcctggagtgaacattaagccggtcgttaaggttactgctgcgggacagacaaaacggaccagaatacacaagggtaattctccgctttttaacgaaaccttgtttttcaacctgttcgacagcccaggcgagctctttgacgagcccatcttcattaccgtcgtcgactcacggtcactgcgtaccgacgcccttttaggagagttccgaatggatgtgggcaccatctaccgggaaccgaggcacgcataccttcgaaaatggcttctgctcagcgatccggatgacttttctgctggggcacggggatacctcaagacctctctctgtgttctcggccctggcgatgaagccccattggagaggaaggatccttccgaagataaagaagacattgagtcaaacctgcttcggcctacaggtgtggcccttcgaggcgctcatttctgcctaaaagtcttcagggctgaggacctgccgcagatggatgacgcggtgatggataacgtaaagcagattttcgggttcgaatcaaataaaaagaacttggtggaccccttcgtcgaagtctcatttgctggcaaaatgttgtgctcaaaaattctggagaagacagcaaacccccagtggaatcaaaatatcacattaccagcaatgtttccctctatgtgcgagaagatgcggatacgtatcatcgactgggatcgactcactcataacgatattgtggcaacgacctatctgtctatgtccaagattagtgctccaggtggcgagatagaagaagagccagctggagctgtaaagccatcgaaggccagcgacctcgatgactaccttgggttcttaccgaccttcggaccatgttatatcaacctgtacggcagcccacgggaattcaccggttttccagacccctatacggagctcaataccggaaagggtgagggcgtagcctaccgcggacggttattactatcccttgagacaaagcttgttgaacactcagagcaaaaggtggaggatcttcccgctgacgatatactaagggtggaaaagtacctgagacggcgtaaatactctctcttcgcagctttttattcggctaccatgctgcaggacgtggatgatgctatccaatttgaggtctcaattggaaactatggaaacaaattcgatatgacatgtctccctttggccagcactacacagtacagccgtgctgtcttcgacgggtgccattactattacctgccctgggggaacgtgaagcccgtagttgtactgtccagctattgggaagatataagccacaggatcgagacgcagaaccagctgctgggaatcgccgatcggctagaggccggtctcgagcaagttcacctcgcactcaaggcacaatgctcgaccgaggacgtcgacagcttagtggcacaactgaccgacgaactgatcgctggatgtagccagcctttgggcgatatccatgaaactccctccgccactcacctggaccagtacctgtaccagcttcggacgcaccaccttagccagattaccgaagctgctctggccctcaaactaggacactcggagcttcctgcagcactagaacaggcagaggactggctcttgaggctccgggcactagctgaggaaccacagaattctctgccggacatcgtaatttggatgctccagggtgataaaagagttgcttaccagagggttcccgctcatcaagttctgtttagccgcagaggggcaaactactgcggcaaaaattgcggaaaacttcaaacaatctttttgaaatacccgatggaaaaagttccgggagcccgtatgcccgttcagattagagtcaagctgtggttcggtttatccgtggacgaaaaagagtttaaccagttcgccgaaggcaagctatctgtctttgctgaaacatatgaaaatgaaaccaagctggctcttgtgggtaactgggggactactggcctgacatatccaaagttttctgacgtgaccggcaagatcaagctgccaaaggacagctttcggccatctgccggttggacctgggccggtgattggttcgtgtgtcctgaaaagacgctgctccatgacatggatgcaggacacctgtctttcgtggaggaggtatttgagaaccagactagactgccagggggacagtggatctatatgagtgataattacactgatgtcaatggggaaaaggttctcccaaaggatgacatcgagtgtccattggggtggaagtgggaggatgaggagtggtctacagacctgaacagggcggtcgatgaacaaggttgggagtatagcattacaatccctcccgaaagaaagcctaaacactgggtgccagcagaaaaaatgtactatacacataggcgcaggcggtgggttcggctccgaaggcgcgacctgagccaaatggaggccttgaagagacaccgccaggctgaagccgaaggagaaggctgggagtacgcgtcactcttcggatggaagtttcacctggagtataggaaaaccgatgcgtttcgcaggagaagatggcgtaggcgaatggagcccttggagaagacagggcctgcagccgtctttgccctcgaaggggcactgggtggagtgatggatgacaaaagcgaggatagtatgtctgtgtccacactgtcctttggcgtgaatcggccaactataagctgtatctttgactatgggaaccgttatcatctcagatgttacatgtaccaggctcgcgatcttgcagcgatggataaggatagcttttcagacccgtatgccattgtctcgtttcttcaccagagccagaaaacagtagttgtaaagaacaccctcaatccaacctgggaccagactttaattttctatgaaattgagatcttcggggaaccagcaaccgttgcagagcagccccctagtattgtggtcgagttgtatgaccatgatacttatggggctgacgaatttatggggcgatgtatctgtcagccctcactagaacgaatgccgcgattagcctggttccccctaactcggggatctcagccttccggtgagttgctggcctcgtttgagcttatccaaagggagaagccggcaatccaccacattcctggattcgaggtccaagagacatcgcggattctggacgagtctgaggacacggacctgccctaccccccaccccagagagaggccaacatttacatggttcctcagaatatcaaacccgcactccagcgaaccgctatagagatcctggcatggggactgcgcaacatgaagagctaccagctggccaatataagtagcccttccctcgtggtagaatgcgggggacagacagtgcagtcctgcgttataagaaacctgagaaaaaatccaaacttcgacatatgcacgctcttcatggaggtcatgctgcccagggaagaattatactgcccccctatcaccgttaaggtcatagataaccgtcagttcgggagaagaccagtggtaggtcagtgcacaatccgctctctggaaagcttcctgtgcgacccttactctgcggagtccccgtcaccacaggggggacctgacgacgtctctctgctgagtcccggtgaggacgtcctgattgatatagacgataaagagcctctgattccaatccaagaagaagagttcattgactggtggtccaagttttttgcctctattggcgagcgggaaaagtgtggtagttacctcgaaaaagacttcgatactctcaaggtatacgatacccagctggagaatgtggaggcttttgaagggctctcagatttttgtaacaccttcaaactctatcgcggaaagacacaggaagagacagaggacccctccgtgataggcgaatttaagggcctgttcaaaatctacccacttccagaggatccagccattcctatgccgccaaggcagtttcaccagttggcagctcaggggcctcaagaatgcttggtgcgaatttatattgtgcgcgcatttggactgcagccaaaagatccaaacggcaagtgtgacccttatatcaagatcagcatcggtaagaagtccgtctccgaccaggataactacatcccttgtactctggagccagtcttcgggaaaatgtttgaactgacatgcaccttgcccctggagaaggacctcaagataacactttatgactatgatttgctaagcaaagacgagaaaataggagagaccgtggtagatcttgaaaacaggctcttatctaaatttggagctaggtgtggacttccccaaacctactgcgtctcaggaccaaaccagtggcgggaccagctgaggcccagtcaactgttgcaccttttctgccagcagcatagagtcaaggccccagtctatagaacagatcgggtcatgttccaggacaaagagtactctattgaggaaatcgaagcaggaagaatccccaacccccaccttggcccagtggaagaaaggctggccttgcacgtcctgcagcagcagggcctggtgcccgaacacgtggagagcagaccgttatacagccccctacagcctgacattgagcagggcaaacttcagatgtgggtggacctctttcccaaggccctgggccgtcccggacctccattcaacataacacccagaagagccagacggttcttccttcggtgcattatttggaacactagggatgtaatcctcgatgatcttagcctgactggggaaaaaatgtctgatatttacgttaagggatggatgatcggatttgaagagcataagcaaaaaaccgacgtgcattacaggtccctcgggggagagggcaactttaactggagatttatatttccttttgactacctaccagccgagcaggtctgtacgatcgcaaaaaaggatgccttctggcgccttgataagacagaatcgaagatccctgccagagtggtctttcagatatgggataatgataagttctcctttgatgacttcctcgggtctctgcagcttgacctgaatcggatgcctaagcccgcaaagaccgccaaaaagtgcagtcttgaccaactcgatgacgcctttcaccccgagtggttcgtctccttgtttgagcagaaaactgtcaaaggatggtggccctgtgtggctgaggagggcgagaagaagatcctggcgggaaagctggagatgacactggaaattgtggctgaatccgaacacgaggagcgccctgccggacagggccgtgacgaacctaatatgaatcctaaacttgaagaccccaggcgcccagacactagttttctctggtttactagcccttacaagactatgaagttcattctatggcgacggtttaggtgggccatcattttgttcatcatcctcttcatcctcttgctgtttcttgctatctttatctatgctttcccgaactacgctgccatgaaattagtgaaaccttttagtta

SEQ ID NO: 4343 - DNA, 6305 bp, Artificial Sequence
  Description of Artificial Sequence: Synthetic coding sequence
atgttgcgtgtattcatactctatgctgagaatgtccatacccccgacacagacatttctgatgcttactgctccgcggtgtttgctggggttaagaaacgcacaaaggtgatcaagaactccgtgaatcctgtatggaatgagggctttgaatgggatcttaaagggatccccctggatcaggggtctgagcttcacgtggtcgtgaaagaccacgaaacaatgggcagaaatcggtttctgggcgaagccaaagtcccccttcgcgaggttctggctaccccatctctgtcggctagcttcaacgctccattgctcgatacaaagaaacagccaaccggagctagcctggtactccaggtgtcctatacgcctttacctggggctgtgccattatttccacctcctacgcccttagagccgagcccaaccctacccgacctggatgtggtggcagataccggaggcgaggaagataccgaagaccagggactgaccggagatgaagccgaaccctttctggaccagagcggagggccaggggctcccacaactccccgtaagctcccatcccgccctccccctcactatcccggtataaagaggaagcgttcggctccaaccagtcggaagctcctgagtgataagcctcaggatttccagattagagtgcaggttatcgaagggaggcagctgccaggcgtgaatatcaagccggtggttaaggttactgcagccggtcagactaaaagaacacgtattcacaaaggcaatagtccacttttcaacgaaacactttttttcaacctctttgattcccctggtgagctgtttgacgaaccgattttcatcacggtggtggatagtcgcagcctgcggacagatgccttgctgggcgagtttagaatggatgttgggacaatatatagggagcccagacacgcttaccttcggaagtggctcctgctgagcgacccagacgacttttctgcaggagccaggggatacttgaaaacatccttgtgtgtcctgggtccaggcgatgaggcccctctcgaacgaaaggatcctagcgaagataaagaagacatcgaatcgaatttactgagacccacaggagttgcactgcgcggtgcccacttctgtctgaaggtgttccgggctgaagatttaccccagatggatgatgccgtcatggataacgtcaaacaaatcttcggctttgaaagcaacaaaaaaaatcttgtggacccttttgtagaggtcagttttgcaggaaaaatgctgtgctctaagattttagaaaagaccgccaacccccagtggaaccagaatatcacactacctgccatgtttccatctatgtgtgagaagatgagaattcggattatcgattgggataggctcacccataacgatattgtggccaccacatacctgtccatgagcaaaatctcggcgcctgggggagagatcgaggaagaacccgcaggagcggtgaagccctcaaaagctagcgacctggacgactacctgggttttctacccacgttcggaccttgttacatcaacctgtacggttcacctagagaatttaccgggtttccagatccgtacactgagctgaacaccggaaagggagaaggtgtagcttacagaggcaggctgctgctgtcgttggagaccaaattggttgagcattctgagcagaaagtggaggatcttcccgctgatgacattctacgggtagagaagtacttgagacgtagaaagtactcactgtttgctgctttttacagcgcaactatgcttcaagatgtagacgatgccatacagtttgaggtgtccattggaaattacggcaataagtttgatatgacatgtttgcctctggcgagcactacacaatacagtagagcagtctttgacggatgtcactactattatctgccgtggggaaatgtcaaacctgtggttgtcttgtcctcttattgggaggatataagccatagaattgagactcaaaaccaactcctgggtattgctgaccgccttgaggcgggtttagaacaggtccacctggccttaaaggctcagtgtagtacagaagacgtggattcgttggtagcacagctgacagatgaactgatagcaggatgctcacagccactgggggacatccacgagacccctagcgcaacacatctagaccagtatctgtaccagctgcgtacccatcatctgtcccagataactgaagctgcactagccctgaagctgggacattcggaacttccggcagcccttgaacaggctgaagattggttgcttcgactgcgggctctggccgaagaaccccaaaattccctgcccgatattgtgatttggatgctccagggagacaaacgtgtcgcttatcagcgagtgccagcgcaccaggtattattttcccggaggggcgctaattactgcggcaaaaattgcggcaaactccagaccattttcctgaagtaccccatggaaaaagtcccaggggctagaatgcctgtgcagattagagtgaaactgtggttcggtttaagcgtagatgaaaaggagttcaaccaattcgcggaaggcaaactctcagtgtttgcagaaacctacgagaatgaaacaaaactggccctggtgggcaactgggggacaaccggcctaacataccctaagttctcagacgtgactggcaagattaagttaccaaaagactctttccgcccaagcgcaggctggacctgggcaggcgactggttcgtgtgcccggaaaaaacactactgcacgacatggacgcaggccatctgtcattcgtcgaggaggtgttcgagaaccaaacaagactgcctggcggtcagtggatctatatgtccgacaactacacagacgtcaacggagagaaggtgctcccgaaggacgacattgagtgtcctctaggatggaagtgggaggacgaggaatggtcgaccgacctgaatcgcgcagtggacgagcaaggctgggagtatagtattacaattcctccagagagaaaaccgaagcactgggtccctgccgagaaaatgtactacacacacagaagacgtcgctgggtacgactcagacggagagacctcagtcagatggaggccttaaaaagacaccggcaggccgaggcagaaggcgaagggtgggagtacgcgagcttatttggctggaaatttcacctggagtaccgcaagaccgacgcattcaggaggcggagatggaggagaagaatggagcccttagaaaagacaggccctgctgccgtgttcgccttagaaggcgctctgggaggggtgatggatgataaatcagaggacagtatgtctgtatcaactctgtcttttggcgtgaataggccaaccataagctgcatatttgactacggtaatcgatatcatctcaggtgctatatgtatcaagccagagatctggccgcaatggacaaagacagcttttctgacccttatgccattgtttccttcctccaccagtctcagaagactgtcgtggtgaagaacactctcaaccccacttgggatcaaacccttatcttctacgagattgagatatttggcgagccagctactgtcgccgagcagcctcctagcattgtggtggagctatatgatcacgatacttatggagcagatgagttcatgggcaggtgtatctgtcaacccagcttggagcgcatgccaagattggcctggttcccactgacccggggaagtcagcccagtggtgaattattggcttctttcgagctcatccaaagagaaaagcctgccattcaccatatccccggtttcgaagtccaggagactagtcgcattttggacgaatccgaagacactgacctgccttaccccccacctcagcgcgaggccaatatttacatggtccctcagaacattaagcctgccttacagcgaacggctattgagatccttgcatgggggctcagaaacatgaaaagttaccaattagctaatatatctagcccatcactggtggtcgaatgtggcggacaaaccgtgcaaagctgtgtaatacggaatctgcgtaagaaccctaactttgacatttgcactctgtttatggaggtaatgctcccccgagaggaactgtattgtccaccgattacagtgaaagtgatcgataaccggcagtttggacggcgacccgtggtgggtcaatgcactattaggagcttagagtcgttcctatgcgatccctacagtgcagaatccccgtccccacagggcggacccgacgatgtgagtctattgagtccaggcgaggacgttttaatcgatattgacgacaaggaacccctgattcccatccagctcgcagacggcctgagctctctggcacccaccaataccgcttcgcccccttcctcacctcacgaggaagagttcattgactggtggtccaaattttttgcgagtattggcgagagagaaaaatgtggcagttacctggagaaggatttcgacacgctcaaagtgtacgacacacaacttgagaatgtggaagcctttgaaggactttcagacttttgtaatactttcaagctgtatcgtggcaagacccaggaggaaaccgaagaccccagcgtaataggggaatttaaaggactcttcaagatatacccactgcccgaggatccagccatccccatgcccccacgccagtttcaccaacttgcagctcaaggtccacaggagtgtttagtccgcatctatattgtccgcgcatttgggctgcaaccaaaagacccaaatggcaagtgcgacccctacataaagatctccattggaaagaaatctgtctccgatcaggacaactatatcccttgtaccttggagcccgtgttcggtaagatgtttgagttgacatgcacacttccactagagaaagacttgaagattacactgtacgactatgaccttctcagtaaagatgagaaaataggcgaaacggtggttgatctcgaaaaccgccttctgtccaagttcggcgctcgttgtggactcccccaaacatactgtgtgtcaggtcccaaccaatggcgagatcaactcagaccctctcaattgttgcatttgttctgccagcagcatagagtgaaggcgccagtgtaccgcactgaccgcgtcatgttccaagacaaagagtactcaatcgaagagattgaggccggaaggattccaaacccccacctgggcccagtggaggaacgtctggcccttcacgtgctgcagcagcaagggctagtgcctgagcatgtagagagccggcctctgtacagccctctgcagccagatattgaacagggaaaattacagatgtgggtcgatttatttccaaaagctctggggcgtcccggtcccccttttaacataacgcctcgtagggcgaggaggttcttcctacgttgtatcatatggaacacccgcgatgtaatactggatgatctttctctgactggcgagaagatgtcagatatctatgtaaagggatggatgattggatttgaggaacataaacaaaagactgatgtgcattacagatcactgggcggtgagggcaatttcaattggaggttcatctttccgttcgattacctccccgcagagcaggtgtgcacaattgcaaaaaaggatgctttctggcggctggataaaactgagagcaaaatccctgctagggtggtcttccaaatttgggacaacgacaagttttcatttgacgattttctcgggtccctccaactcgacttaaacaggatgccaaaaccagcaaaaactgccaaaaaatgcagtcttgaccagctggatgacgctttccacccagagtggtttgtatcactattcgaacagaaaacagtcaagggctggtggccttgtgtggccgaggagggcgagaaaaagatcctggccggtaaattggaaatgactctcgaaatcgtggcagaaagcgagcatgaagagcgtccagctggacaaggcagagatgagcccaatatgaaccccaaactggaggacccacgccgtcctgacacctcgtttctctggttcacatctccctataaaactatgaagttcatcttatggcgaagatttaggtgggcgatcattctcttcatcatactctttatcctgcttctgtttctcgcgatctttatatatgcctttcctaattatgcagccatgaaactggtaaagccttttagtta

SEQ ID NO: 4344 - DNA, 447 bp, Artificial Sequence
  Description of Artificial Sequence: Synthetic coding sequence
atggggtatccagaagtggagcgtcgggagttgctcccagcagcagcaccgagggagcggggtagccagggctgcggatgcggcggtgccccagctcgggcaggggagggaaacagctgcctgctgttcctcggattttttggactatcacttgccctccatctgctgacactatgttgctatctggagctcagatccgagctgcgcagagagcgaggcgcagaatccaggctgggagggtcaggcacaccaggtacgagcggaacactatccagtttgggcggactggatcccgactctcctatcaccagccatttaggacagccttcccccaagcagcagccccttgaaccaggggaggccgcacttcatagcgactcccaagacggacaccaggacttcgactatatcatctcctttagttacgggctacaaggcttctgttag

SEQ ID NO: 4345 - DNA, 1176 bp, Artificial Sequence
  Description of Artificial Sequence: Synthetic coding sequence
atggggtatccagaggtcgaaaggcgggagctgttacctgccgctgctcccagggagagaggttcccagggatgtgggtgcggcggagcaccagccagagccggtgagggcaactcgtgcttgcttttcctggggttcttcggattgtccctggccctgcatttactcaccctgtgctgctaccttgaactcagatcagagcttcgcagggagcggggagcagagtccagattgggcggttccggaaccccgggaactagcgggaccctcagctcattagggggacttgaccctgatagccccattacgtcccatttagggcagcccagtcctaagcagcagccgctagagcccggtgaagcagccctccacagcgactctcaggacggacaccagatggctttgttgaactttttcttcccggacgaaaaaccttattcggaggaggagtcgcgacgcgtgcgtcggaacaaacgcagtaagagcaacgagggagcagacgggccagtgaagaataagaaaaaaggcaagaaagctgggccacctggacccaacgggccacccggaccacccggacctccaggaccccaggggcctccaggcattcccggaattcccggaattccgggtaccaccgtaatggggccaccaggccctcccggaccccctgggccacagggccctccaggcctgcaggggccaagcggggctgccgacaaagctgggactcgggaaaatcaaccggcagtcgtgcacctgcagggacagggtagcgcaatccaagtcaagaacgacctttctgggggtgtgctcaatgactggagtcggattactatgaatcccaaagtattcaaactgcacccgaggtccggagaactggaagtactggtggatgggacttattttatctatagtcaggtggaagtttattacattaactttacagacttcgcgtcctatgaggtggtcgtcgacgagaagccctttctacagtgcactagatctattgagaccggcaagacaaactacaacacctgttacacagccggtgtgtgcctgctgaaagctcgacaaaagatcgccgtcaagatggtgcacgccgatataagtatcaacatgtctaagcacacaacctttttcggagccattagactcggcgaagcccctgcttcctag

SEQ ID NO: 4346 - DNA, 1170 bp, Artificial Sequence
  Description of Artificial Sequence: Synthetic coding sequence
atgggttacccagaggtggagcgaagagagctcctgcctgcagccgctcccagggagcgcggttcccaagggtgcggctgcggtggagcgccagcccgtgcaggcgagggcaactcatgtctgttgtttctcggctttttcggcctgagtctggcattgcatcttctgacgctgtgctgttacttggagctccgctctgaactcagacgcgaacgcggagcagaaagcagactgggaggtagcggcacgccgggaacctccgggacccttagctccctgggaggacttgaccccgactccccaatcacttcccacctgggtcagccttcccccaaacagcagcccctcgaacccggagaggctgccctccatagcgattcacaggacgggcatcagatggctctgctgaactttttctttcctgacgagaagccatacagcgaggaagagtcacgcagggtgcgccgaaataagcgatctaagtccaatgaaggcgcagacgggcctgtcaaaaacaagaaaaaagggaagaaagccggtccgccaggccctaatgggcctcctgggcctccgggtccccctggaccccaagggccacctgggataccaggtatcccaggcataccaggcacaaccgttatgggcccaccgggtcccccaggtcctcctggaccacaggggcctccagggttacaaggaccttcgggcgctgccgataaggccggaactcgcgaaaatcagcccgctgtcgttcatctgcagggacagggatccgctatccaagttaaaaatgatctgtcgggcggtgtgcttaacgactggtcccgcatcacaatgaaccctaaagtgttcaagttacaccctaggtccggcgagctcgaagtacttgtagatggaacctatttcatctacagtcaggtgtattacataaacttcacagattttgctagctatgaggtggtcgtggatgagaaaccgttcctgcagtgtaccagatctattgagacagggaagacgaactacaacacctgttacaccgcaggagtatgtctcctgaaagcaagacagaagattgccgtgaaaatggtgcatgccgacatctccataaacatgagtaaacacactaccttctttggggctattcgcctcggcgaagccccagcgagttag

SEQ ID NO: 4347 - DNA, 408 bp, Artificial Sequence
  Description of Artificial Sequence: Synthetic coding sequence
atgggctaccctgaagtcgaacgaagagaactcctgcccgctgcagcccctcgagaacgcggatcccagggttgtggatgcggtggcgctcctgcaagggctggggagggaaattcttgcctgctgttcttgggtttcttcgggctctccttggctctccatttgctgaccctgtgttgctatcttgagctgcgttcagagctaaggagggagcggggtgcagagtctcgcctgggtggcagcggcactccagggacttccggtacgttgtctagcctgggagggttggatcctgactctcctatcacgtcgcatctgggacagccgtctccgaaacagcaaccgttggagccaggggaggcagccctacacagtgatagccaggacggccaccaaggccaccaatag

SEQ ID NO: 4348 - DNA, 1161 bp, Artificial Sequence
  Description of Artificial Sequence: Synthetic coding sequence
atgggatatccagaagttgagagaagagagctcttacccgcagctgccccaagagagagaggaagccaggggtgtgggtgcgggggagcgcctgcacgggcaggagaaggcaattcctgtctcctgttcctgggtttcttcgggctgtcccttgccctgcacctgctgaccttatgctgttacctcgaactccggtctgaacttaggagggagcggggagcagagagtaggctgggcggttccggcacgcccggtactagcggtaccctctctagccttgggggtctagatcccgactctcccatcacctcccatctgggacaaccgagcccaaaacaacagcctctcgagcctggcgaggccgctctccattccgactctcaggatggacaccagatggcactgctaaatttctttttccctgacgagaagccatattcagaggaagaatccaggagagttcggcgaaataaacggagtaagtctaatgagggggctgacggtccagtgaagaacaaaaagaagggcaagaaggccggaccacccggtcctaatggaccccctggccctcccggacctcctgggcctcagggcccaccaggcattcccggaattcccggtattcctggaacaacggtcatgggccctcctgggcctcccggtccaccagggccacagggcccacctgggctgcaaggacctagtggagctgccgataaggcgggaacccgagaaaaccaaccggcagtggtgcatctgcaggggcagggatctgctattcaagtaaaaaatgggggtgttctcaatgactggagtaggatcacaatgaatcctaaggtatttaaattacacccacgctcaggtgaactggaagtgttagttgatggtacttactttatctacagccaggtgtactacatcaactttacggactttgcctcctacgaggttgtggtcgacgaaaagccctttctacagtgtacaaggagcatcgaaacaggcaagacaaactataacacctgttataccgctggagtgtgtcttctgaaggcacgtcagaaaatcgccgttaagatggtccatgcagatatttcaatcaacatgtcaaagcacactacattctttggcgcaatcaggctgggcgaagccccagctagttag

SEQ ID NO: 4349 - DNA, 447 bp, Artificial Sequence
  Description of Artificial Sequence: Synthetic coding sequence
atgggatatcctgaggtagagcggagggaattactgccggctgccgcaccccgtgagcgtggctctcaaggttgcggatgtggtggtgccccagcccgagccggagagggaaattcgtgtctgctttttctgggcttctttggcctcagccttgcacttcaccttctgacactttgctgctatctggagttaaggtctgagcttcgtcgggagcgcggtgccgaaagccgactaggtggcagcggcactcctggcacctccggcaccttgtcttctcttgggggtttggatcctgattcaccaattacaagccacttgggccagccctcccccaaacagcagccattagaacccggtgaggcagcgcttcactcggatagtcaagatggacaccaagacttcgactatataatttctttctcctatggcctccagggcttctgttag

SEQ ID NO: 4350 - DNA, 3429 bp, Artificial Sequence
  Description of Artificial Sequence: Synthetic coding sequence
atgctggtactgagatgccgattgggcacaagcttccctaaactggacaacctagtccccaaaggtaagatgaaaatcctcctggtgttcctcggcctccttggtaattcggtggcaatgcctatgcacatgcctcgcatgcctggcttctcttcaaagagcgaagagatgatgagatataaccagttcaatttcatgaatgggccacacatggcccacttgggacctttttttgggaatggactgccccaacaattccctcagtaccaaatgcctatgtggcctcaacccccaccaaacacatggcatcctagaaaatcctccgccccaaagcgtcacaataaaaccgatcagacacaagaaactcagaagccaaaccagacccagagcaaaaagccaccccaaaagcgaccgctgaaacaaccctctcacaaccaaccgcagccggaggaggaagcacagcctccccaagcattcccaccctttgggaatggactgttcccttaccagcagccaccgtggcagataccacagcggctgcctcctccaggttatggcagaccacctattagtaatgaagagggtgggaacccgtacttcggttacttcggatatcacggcttcggtggtaggccaccttactattcagaggagatgtttgagcaagactttgagaaaccaaaagaggaggaccctccaaaggccgagagcccagggacagagcccacagcaaacagcactgttaccgagaccaactcgacccaacccaacccaaaaggttcgcaggggggaaatgacacgtcgcccacaggtaatagtactcccggtctaaatactggcaacaatcccccagctcagaacggtattggcccactcccagctgtcaacgccagcggacaggggggtccagggagccagatcccttggcggccatctcaacctaacataagagagaatcacccttatcctaacattcggaacttcccatccggacgtcagtggtattttactggtacagtgatgggccacaggcagaatcggccattttaccgcaaccagcaggtgcagcgcggacccagatggaattttttcgcatgggagaggaagcaagtggccaggccaggaaatcctgtgtaccataaagcgtacccccctacctcacggggtaactatcccaactacgcgggaaacccagctaatctgcggagaaaaccacagggtcccaataagcacccagtgggcaccaccgtcgccccacttggcccaaaacccggacccgtggtgcgaaatgaaaagatccagaatcccaaggaaaaaccgcttggcccaaaggaacagatcatcgtgccaaccaagaatcccacgtccccctggcggaactctcagcagtatgaggttaataagtctaactacaagctgccacatagtgaaggctacatgcccgtgcccaactttaattctgtggatcagcacgaaaatagttattaccctagaggagacagccgaaaagtgcctaattctgacgggcaaacccagagccagaacctacccaagggtatcgtcctggggtcccggagaatgccctatgaaagtgaaactaaccagtccgagctgaaacattcttcttatcaaccggctgtatacccagaagagattcccagcccggctaaagagcattttccagcgggtagaaacacatgggaccaccaggagatctccccacctttcaaagaagatcctgggaggcaagaggaacatctgccccacccctcacacggcagtcgaggctcggttttttatccagagtataatccctatgatccccgagagaatagcccatacttgcgaggtaacacctgggacgagcgggatgattcccccaacaccatgggacagaaagagagtccactctatcccattaacacaccggatcaaaaggagattgtcccgtataacgaggaggatcctgtggaccccactggcgatgaggtttttccaggccaaaataggtggggagaagagttgtcctttaagggcggtccgacagttagacactacgagggggaacagtacacctcaaatcagcccaaagagtacctcccctattcactggacaaccctagtaaaccccgagaagatttttactattcagaattctatccctggtcccctgatgaaaattttccctcatacaacactgcctctactatgccgccacccatcgagtctcgcggttactacgttaataatgcagccggacctgaggagagcacactatttcctagtcgaaattcttgggaccaccgtatccaagcacaggggcagagagaacggagaccctatttcaaccgcaatatctgggaccaggccacccatttacagaaggccccagctagacctcctgatcaaaaaggcaaccagccgtactacagcaacactcctgcagggctgcagaagaaccccatctggcacgaaggcgaaaacctgaactacggcatgcaaattactagaatgaacagcccagagcgcgagcacagttcattccctaatttcattccccctagctacccttctggccagaaggaagcacacctgtttcacttgtctcaacgcggttcttgctgtgcaggttctagcaccgggcctaaggataaccctttggctctccaagattatacgccgtcctacggactcgcacccggagagaatcaggatacctctcctttgtacaccgacggcagtcataccaagcagacgcgggatatcatctctccaacgagcattctgcctgggcaacggaactcctccgagaaacgggagtctcagaatccttttcgggacgatgtgagcacactgcgcagaaacacaccctgttctattaagaaccaattaggacagaaagaaattatgccattccctgaggcatcttcactgcaatctaagaacactccgtgtctcaaaaacgatctcggcggagacggcaataatatcctagagcaggtgttcgaagacaaccagctgaacgagaggacagtggatttaacacccgaacagctcgtcatagggacacccgatgagggcagcaacccagaagggatacagtcacaggtgcaggagaacgagtccgagcgacagcagcagaggccatctaatatcctccatttgccctgttttggatctaaactcgccaagcaccacagcagcacaactggaacaccaagctcagatggtcggcagagcccgttcgacggtgacagcattacccccactgagaatcctaataccctggttgagcttgcgaccgaagagcagttcaagagcatcaacgtggatcctcttgatgccgatgagcatagcccgtttgaatttctgcagcgcggtaccaacgtacaggaccaagtacaggactgtctcctgcttcaggcttag

SEQ ID NO: 4351 - DNA, 582 bp, Artificial Sequence
  Description of Artificial Sequence: Synthetic coding sequence
atgggcgtccacgaatgcccggcttggctgtggttgctgctgagcctgctgagcttacctctggggctgccagtgttgggcgcaccacccaggcttatctgcgactcgagggttctcgaaagatacttacttgaggccaaggaggctgagaacattactactgggtgcgccgagcactgctctctcaatgaaaacattactgtgcctgataccaaagtgaacttctatgcctggaaacgcatggaggtcggccagcaggcagtcgaggtgtggcaaggtctggcactactctcggaggccgtactgagaggacaggctctgctcgtgaatagttctcagccttgggaacccctgcagctgcacgtggacaaagccgtatccgggctacggagtttgacaaccttactgagagctctgggcgcacaaaaggaggcgatttcccctccagacgccgcttctgcggctcctttgaggacaattacagccgatacattccgaaagctgtttagagtgtattctaactttctgagaggcaaactcaagctgtataccggggaggcctgtaggactggtgatcgatag

SEQ ID NO: 4352 - DNA, 192 bp, Artificial Sequence
  Description of Artificial Sequence: Synthetic coding sequence
atgccgtcatccgtgtcctgggggatcctgctgctggctgggctctgttgcttggtgcctgtgtctcttgctcatggagagggaacattcacttccgatctgtctaagcagatggaggaagaagctgtgcgtctgtttatcgagtggctcaagaatggcggaccgtcgagcggggcaccccctccctcttag

SEQ ID NO: 4353 - DNA, 1050 bp, Artificial Sequence
  Description of Artificial Sequence: Synthetic coding sequence
atggaggcagtgaaagccgaagcctgggagggtgccgcagtcgcccaagatctcctggccctcgggtatgggggagtgcccggagccgctagcagaggagcttcctgcccagattttagagggttgtgtgtgcgcctggccgctgaattggccacactgggcgcactggagcaacagagagaggccggtgccgaggtgctcagcgctggtgatggaccaggggcagaggaggattttctgaggcagttagggagcctcttacgtgaactgcactgtcctgatcgagctctgtgtggaggcgatggagctgccgctttgcgtgaaccaggagctggcctcaggctgcttagattcctgtgctccgagctacaggccacccgacttctctgtctccgatccctcctagatccctctcctagaccaccgttgggagagggtgtcgtggaaggtgccggaatggtgcaagagctggatctgacacttcaggccttggggctgcccaggcccgctccagggaccccggctagtcaactcctgcaggaattgcatgcaaaaatatctgaattgcaaccgtctttacctcccggttcattgcagcccctcttatcatgttccctcgatgcaccaaggtgggaggctttggaatccctgtcacaaagtctcagagatcagtataggtgtcgcagatgtctgctgctcaaacggctggatctgacaaccagcgctttccactggagcgatcgagccgaggcccagggcgaagcaatgcgggcagtgctgatccccatccgggaagttttgaccccagaatcagatatatccatagctcacgtgttagcagcccgtgcggatctcagctgtttggttccagccacaagtgtggcagtcagacggggtacatgctgtgcgatcaacaaagttttgatgggcaacgtgccagatcggggaggaaggcccaacgagctcgagcctccaatgcccacatggcggtctcgacgtgaagatggaggccctcaatgttgggggcgaaagaaaaaaaaaaagaagtag

SEQ ID NO: 4354 - DNA, 804 bp, Artificial Sequence
  Description of Artificial Sequence: Synthetic coding sequence
atggaggccgttaaggctgaggcatgggaaggtgccgctgtcgcacaagacctgctggccctgggctacggaggcgtcccaggcgcagcttcgaggggtgcgagctgcccggattttcgtgggttgtgtgttagattagcagccgagctggccacgttgggcgcacttgagcagcagcgcgaggccggtgctgaggttttatccgctggcgatgggcctggtgcagaggaggactttctgcgacagctggggtcactgctacgggaactgcattgcccagaccgagccctgtgcggaggggacggtgcggctgccctgagagagccgggagccggtctccgcctgctacgttttctgtgtagcgagctgcaggcgactagactcctgtgtctcagatcactgttggatccctctcctcgaccacccctcggggagggggtggtggagggggctggcatggtccaggagctggaccttacactgcaggcccttgggttgccaaggcctgcacctggaacccccgcttctcagctgctccaggagctgcatgcaaaggaagcgctagagtccctcagccaaagtctgcgtgatcagtacaggtgtagacgatgtctactgttgaaacgacttgatctgaccactagcgcatttcattggagtgatagggccgaggtgctgatgggcaatgtgccagaccggggtgggagacccaacgaactagaacccccaatgcccacatggcggtctcgcagggaagatggaggaccacagtgctgggggaggaagaagaagaaaaagaagtag

SEQ ID NO: 4355 - DNA, 2601 bp, Artificial Sequence
  Description of Artificial Sequence: Synthetic coding sequence
atgttttccatgaggatagtgtgcttggtactgagcgtcgtgggcacagcctggacggcagattcaggggaaggcgattttctggcagaaggcggtggagtgcggggaccccgagttgttgagaggcatcagagtgcctgcaaagatagcgattggcctttctgctctgacgaggactggaattataaatgcccttccggctgtagaatgaagggactcattgacgaggtcaaccaggatttcactaacagaattaacaagctgaaaaacagcctctttgaatatcagaagaataacaaggacagccattcactcacaaccaatattatggagattctgcggggtgacttctcttccgctaacaaccgtgacaacacctacaatagagttagcgaggacctgcggtcccgtatcgaggtgttgaaacgtaaggtcattgagaaggtgcagcacatccagctgttacagaagaacgtccgcgctcagcttgtcgacatgaaacgcttggaagtggacattgacattaagatacgcagctgtaggggaagttgctctcgggcattagcccgagaggtggatctgaaggactatgaagatcagcaaaaacaattagaacaagtcattgcaaaggatctcctcccgtcccgcgacagacagcacttgcctctcatcaagatgaaacctgttccagaccttgtgccagggaattttaaatctcagctgcagaaagttcctcccgagtggaaggcattgactgatatgccacagatgcgtatggagctggaacgacccggaggcaacgagattacacgtggcggaagcacctcttacgggacaggaagcgagactgagtctccacgcaatccctcatctgccggaagctggaattcagggtcaagcggccctggaagtacagggaatcggaacccgggaagctcaggtaccggcggaaccgcaacttggaaacccggttcatctggcccagggtccaccggcagttggaactcaggttcttctggaaccggatcaaccggaaatcagaaccctggctccccacggccaggctctactggtacctggaatccaggatccagcgagcggggaagcgctgggcattggacaagcgagtcttcagtgtctgggtccacaggacagtggcactctgaatccggatcgttccggcctgatagccccggatctgggaacgccaggccaaacaatcctgattgggggacctttgaagaggtgtcaggaaacgtttcaccaggaaccaggcgcgaataccatacagaaaaattagtcacgtcaaagggagacaaggagttacgcacaggcaaagagaaggttacttcgggaagcaccacaaccacacgtagatcgtgttcaaagaccgtgacaaaaaccgtgatcggaccggatggccataaggaggtaactaaggaggtagtgacctccgaggatggttcagactgcccggaagctatggatctggggactttgagcggaataggtacattagatgggtttagacaccggcatcctgatgaagcagctttcttcgacacagcctcaaccggcaagactttcccaggatttttttctccaatgctgggtgaatttgtctctgagactgaaagtcgaggatcggaaagcgggatctttaccaatactaaggagtcatcttcccatcacccaggaattgcagaattccccagccgcggaaagagcagttcctactccaaacaatttaccagcagcacctcgtataaccgcggagactccacctttgagagcaaaagctataaaatggctgacgaggcaggatccgaggcagatcacgaagggactcactccactaaaagaggacatgccaagtcaagaccagtgagggattgcgatgacgtgcttcagacccatccctcaggaactcagtctggtatttttaacatcaaactcccaggatcctcgaagatcttctccgtgtactgtgatcaggagacctcactcggaggttggctattaattcagcagcgcatggatggatccctcaactttaatcgcacctggcaagactataagagaggcttcggaagcctgaatgacgagggagagggagaattctggctcggcaatgactacctgcaccttctgacacaaagagggagcgtgttgagggttgagcttgaggactgggccggtaacgaagcatatgcagaatatcacttccgggtcggcagcgaggctgagggatacgccctgcaggtatcttcgtacgaaggaacagcgggtgatgcactcatcgagggcagcgtggaagagggggcagaatacaccagccataacaatatgcagttcagcactttcgaccgagatgccgaccaatgggaggaaaactgtgccgaggtatacggtggcggatggtggtacaacaattgccaagctgccaacctcaatgggatctattatcctggaggttcttacgacccccgaaataattcaccttacgagatcgagaatggagtcgtgtgggtgtccttccgtggcgctgactactctctccgggcagtacggatgaagatcagacccctcgtgacacaatag

SEQ ID NO: 4356 - DNA, 1935 bp, Artificial Sequence
  Description of Artificial Sequence: Synthetic coding sequence
atgttcagtatgcgcatcgtttgtttagtgttgtctgttgttggtacagcctggacggctgattcgggagagggcgactttctggccgaaggaggcggagtccggggaccaagggtcgttgaaagacaccaatccgcttgcaaagacagtgattggccgttctgctctgacgaggattggaactacaagtgtccaagtggttgcaggatgaagggactgatcgatgaagtgaatcaagacttcacaaacagaatcaacaaattaaagaacagcctcttcgagtaccagaagaacaacaaggattcccattccctgacgaccaatatcatggagatcctcaggggagacttctctagtgccaataacagggataacacgtacaatagagtgagcgaagacctccggtcccgaatcgaggtcctgaaacggaaggtgattgaaaaggtccagcatattcagttgctgcagaaaaacgtgcgcgctcaacttgttgatatgaagaggttggaggtggacattgacatcaaaatccgaagctgcagaggatcttgctcccgcgctctggcgagggaagttgacctcaaagactatgaagaccaacaaaaacagctggaacaagtaatcgccaaggatctccttccctcacgagatcggcaacacttacctctgattaagatgaagccggtgcctgacctcgtgccgggtaatttcaaatcccagctacagaaggtgcctcccgagtggaaggctctcaccgacatgcctcagatgcggatggaattggagcgacctgggggtaatgaaataacacgcggtggctccacatcatatgggaccgggtcagaaaccgaatccccgcgaaatccttctagcgctggttcttggaattccggcagttcaggacccggaagtactggcaaccggaatcccggtagctccggtacaggcggaacagcgacctggaaaccaggatcatccgggccaggaagcactggctcttggaacagcggatcaagtgggacgggcagcactggaaatcagaacccgggttcaccacgacccggtagtacaggcacgtggaaccctgggtcttcggagcggggtagcgcaggacactggactagtgagagttctgtgagcggttccactggccagtggcattccgaatcaggatccttcaggcctgacagcccagggtccggaaacgcaagacctaacaaccctgactgggggaccttcgaagaagtgagcggcaacgtgtcccctggtacacggcgagaatatcatacggagaagctcgtgactagcaagggggataaggaacttagaacaggcaaggagaaagtaacaagcgggagcaccacaacaacaagacgctcttgcagtaagacagtcaccaagactgtgattgggcctgatggccataaagaagtgaccaaggaagttgtgactagcgaggacggctcggattgcccagaagccatggaccttgggacactgagcggcattgggactctggatggatttaggcatcggcatcctgatgaagctgcattttttgatactgccagcacggggaaaacattcccgggattcttcagtcctatgctaggagagttcgtgagtgaaactgaatcacggggatccgaatcgggtatctttacaaataccaaggagtccagttctcaccaccccggaatcgcggaattcccaagtcggggaaagtctagtagttacagcaagcagttcacgagcagcacctcctacaatcgaggcgactctactttcgagtctaagtcctacaaaatggctgacgaagccggaagtgaggcagaccacgaggggacccactccaccaagcggggacatgcaaaaagtagacctgttaggggcatacacactagcccactgggaaagccatcactctccccgtag

SEQ ID NO: 4357 - DNA, 870 bp, Artificial Sequence
  Description of Artificial Sequence: Synthetic coding sequence
atgttcagtatgcgtatagtgtgtctggtgctctcagttgtgggcaccgcctggacggctgatagtggagagggcgatttccttgctgaaggaggtggcgtccgcggacccagggtggtcgaacgccaccagtctgcctgtaaggattcagattggcccttttgttctgatgaggactggaactataaatgtccctcgggctgcagaatgaaggggctgattgatgaggtgaatcaggactttactaaccgaataaataagctaaaaaatagcctatttgagtaccagaagaacaacaaagactcccactccttaacaaccaatattatggaaatattaagaggcgacttctcgagtgctaacaatagagataacacttataatagagtgagtgaggatctacgatcgcggatcgaggttttgaagcgcaaggtgatcgagaaggtccaacacatccagctgctccagaagaacgtgagagcccaacttgtcgatatgaaacgcctggaagtggatattgacatcaagatcagaagctgccggggttcttgctccagggctctcgcaagggaagtggatttaaaagattatgaagatcagcagaaacagctagaacaggtgatcgctaaagacttgctgcctgttgtgaatctgcaggtaactgccaataacctattagtggctcgagtcactacagaggagaccccgcacctgaaagctcgggcaataaaatggcaaatgcgtcctgaggtgaaaccgataatgaaggagcacattgccccacgggaagctatgctgaacttggctttgtctgaggtttcgacgcttctgttgtgggggtctctgccttgtcccccacggctgtcttag

SEQ ID NO: 4358 - DNA, 1476 bp, Artificial Sequence
  Description of Artificial Sequence: Synthetic coding sequence
atgaagaggatggtatcctggtccttccacaagctgaagacaatgaagcatctccttttgttactattatgtgtgtttctcgttaagtctcagggggttaacgacaacgaggagggattcttcagcgcaagaggacacaggccactggataaaaaacgagaagaggccccatctcttcgcccagccccaccgcctataagcgggggaggctaccgagccagaccggcaaaagccgctgcgacccaaaagaaagtagagcgaaaagcccctgacgcagggggatgcctgcatgcggacccggacctgggcgtgttgtgccctaccggttgccaactgcaggaagctctgctgcaacaggaacggcctattcgaaactcggtggacgaactgaataacaacgtggaggctgtctctcagaccagctctagctccttccaatatatgtacctgctcaaggatttatggcagaagagacagaaacaggtgaaggataatgagaacgtcgtgaacgagtactctagcgaactggaaaaacatcaactgtatattgacgagactgtcaactcgaacatcccaaccaatctcagggttctgcgctctattttggaaaacttgcgcagcaagatccagaagctggaaagtgacgtgtccgcccagatggaatactgcagaactccctgcacagtgagctgtaacatacccgtggtcagtggcaaagagtgcgaagagattatccggaagggtggagagaccagcgagatgtatctgattcagcccgatagtagtgttaaaccatatcgcgtctattgcgacatgaataccgaaaatggcggttggacggttatccagaaccgtcaggatggttctgtagatttcgggaggaaatgggacccgtataagcaggggtttgggaatgttgccacaaataccgatgggaaaaattactgtgggctgccaggggagtactggttgggcaatgataaaatttctcagttaactaggatggggcctactgaacttctgattgagatggaggattggaagggggataaagtgaaggcccactatgggggattcaccgtgcagaacgaagcaaataagtaccaaatatctgtaaacaagtacagggggaccgcaggcaatgcacttatggacggcgcaagtcagctcatgggcgagaacaggactatgaccattcataatggaatgttcttctcaacttacgatcgggataatgatggttggctgacttctgatccccgaaaacaatgctccaaggaggacgggggtggctggtggtataatagatgccatgcagctaaccccaacggacggtactattggggtggtcagtacacctgggacatggctaaacatggaaccgacgacggcgtagtgtggatgaattggaagggaagctggtattccatgcggaaaatgagtatgaaaatccgacccttttttccacagcagtag

SEQ ID NO: 4359 - DNA, 1425 bp, Artificial Sequence
  Description of Artificial Sequence: Synthetic coding sequence
atgaaacggatggtgagctggagcttccacaagctgaagaccatgaagcatctccttctgctactgctttgcgtatttctggtcaaaagccagggagtgaatgacaatgaagagggcttcttcagcgcgagagggcaccgcccattagacaaaaaaagagaggaggcacgaccagctaaagccgctgctacccagaagaaggttgagcggaaagcccctgatgcgggaggctgcctccatgccgatccagacctcggagtgctgtgcccaaccggctgtcaactacaagaagctctgctacagcaggaaaggcctatcaggaattccgtcgatgagctcaataataacgtggaagccgtcagccagacgtcatccagctcattccagtacatgtacctgctgaaggacctctggcaaaaacggcagaagcaggtcaaggacaatgaaaatgtcgtgaacgagtatagttcagagttagagaagcatcagctttacattgatgaaacagtgaattcaaacatcccaactaacctgagagttctcagaagcattttggaaaatctccggagcaaaatccagaagctggagtctgacgtgagcgcccagatggagtattgcagaacgccgtgtacagttagctgtaacatcccagtggtgagcggcaaggagtgcgaagagataatacggaaaggtggagagacgtctgagatgtacctcattcaaccggacagctcggtcaaaccttatagagtgtactgtgacatgaataccgaaaacggcggatggactgtgatccagaatcggcaggacggtagcgtggacttcggtcgtaagtgggatccctataaacagggattcggaaatgtggccacaaataccgatgggaagaattattgcgggctgcctggtgaatattggttgggtaacgataagatctcgcagctgacacggatgggcccaaccgaactgctgatcgaaatggaggactggaaaggcgacaaagtaaaagcccactatggcggattcaccgttcaaaatgaggccaacaaatatcagatatctgtgaataagtaccgcggtaccgccggtaacgctctgatggacggcgctagccagctgatgggcgaaaatcgtacaatgacaattcataacgggatgtttttctccacgtacgaccgcgacaatgacggatggctgacatcagacccacgtaagcagtgctcaaaggaagacggcggagggtggtggtataaccggtgtcatgcggcaaatcccaacggaaggtactattggggcggacaatatacctgggacatggcaaagcatggcactgatgacggtgtggtatggatgaattggaagggctcatggtactctatgaggaagatgagtatgaagatccgtccattcttccctcagcagtag

SEQ ID NO: 4360 - DNA, 1362 bp, Artificial Sequence
  Description of Artificial Sequence: Synthetic coding sequence
atgtcctggagtctgcacccacggaatctgattctgtacttttacgccctgcttttcctgtcatctacctgtgtggcctacgtggccactcgggataattgctgtatcctagatgaaagatttggcagttattgtcccacaacctgtgggatcgccgacttcctatctacataccaaactaaagtcgataaagatctccagtctctggaggatatcctgcaccaggtggagaacaaaacttccgaagtcaagcaactcatcaaagcaattcagttaacctacaaccctgatgaatcatcaaagcccaacatgattgacgccgcaaccctcaagtctcggaagatgcttgaagagatcatgaagtacgaagcatccattcttacacacgattcttccatccgatatttgcaagagatctacaactccaacaatcagaagatcgtgaacctgaaggagaaggtggctcagctggaggcgcagtgtcaagagccctgcaaggataccgtgcagatacacgacattactggcaaggattgccaggacatcgccaacaagggggcaaaacagtctggcctctatttcatcaagcctctgaaggcaaatcagcagttcttggtgtactgtgagatcgatgggtcgggcaatggctggaccgttttccagaagcggctggacggctcagtggatttcaagaagaattggatccagtacaaggaagggttcgggcacctgagccccaccggcaccaccgaattttggctcggcaatgaaaagatccatttgattagcacacagagcgcaataccctacgccctgagggtggaactggaggattggaatgggagaacttctacagcagactatgctatgttcaaagttggacccgaagctgataagtataggcttacttatgcctacttcgctggaggtgatgcaggagacgctttcgatgggttcgatttcggggacgatccaagcgataagttcttcacctctcataacggaatgcagttctccacttgggataacgacaacgacaaattcgagggcaattgcgccgagcaggatggctctggatggtggatgaacaaatgtcacgcaggccacctgaacggagtctactatcagggtggcacctactctaaggcgagtaccccaaacggatacgataacggcatcatatgggctacctggaagacacgatggtatagcatgaagaagaccaccatgaaaattattccttttaaccggttgactattggcgaaggacagcaacaccacctcggcggagctaagcaggtacgccctgaacacccagccgagacagaatacgattccctctatcctgaagacgatctctag

SEQ ID NO: 4361 - DNA, 1314 bp, Artificial Sequence
  Description of Artificial Sequence: Synthetic coding sequence
atgtcgtggagcctgcaccctcggaacctgatcctgtatttttatgcactgctgtttcttagttccacatgtgtggcttatgtcgccacccgagataactgctgcatcttagacgaacggtttggcagctattgtcccaccacatgtggaatcgcggacttcctctccacgtaccagacaaaggtcgacaaagatctccagtcattggaagacatactacatcaagttgaaaataagacgagtgaagtgaaacaattaattaaggccattcagctgacttacaacccagatgagtctagtaagcccaatatgatagacgcggctaccctgaagtcaaggaaaatgctagaggaaatcatgaagtacgaggcttcgatactaactcacgattcaagtatccggtatctgcaagagatttacaactcaaataatcagaaaattgtgaatctcaaggaaaaggttgctcagctggaggcacagtgccaggaaccgtgtaaagacaccgtacagatccacgacattacgggaaaagactgccaggatatcgcgaacaagggcgcaaagcaaagcgggctgtactttattaaaccacttaaggcaaatcagcaattcctggtgtattgcgaaatcgacggatcaggcaatgggtggacagtatttcagaagcggctggacggaagtgtggatttcaaaaaaaactggattcagtataaagaaggctttggacatctgagcccaacaggcaccactgagttttggctgggcaatgaaaagatccatctgatctcgacacagagcgctattccatatgccctgcgcgttgaactggaggactggaacggacgaactagtacggcagactatgccatgttcaaggttggccctgaggctgacaaatacaggcttacctacgcgtatttcgcgggtggagacgcaggcgacgcgtttgatggattcgatttcggcgatgaccccagtgacaaattcttcacgagccataatggaatgcaatttagtacttgggacaacgataacgacaagtttgaggggaactgtgcagaacaggacggcagtggctggtggatgaacaagtgtcacgccggtcaccttaatggggtatactatcagggcggaacctacagcaaggctagtacacctaatgggtatgataacgggataatctgggccacatggaagacaagatggtacagtatgaaaaaaactacaatgaaaataataccctttaatcgcctaaccatcggagagggacagcaacatcatctgggaggagccaagcaggccggagatgtctag

SEQ ID NO: 4362 - DNA, 2892 bp, Artificial Sequence
  Description of Artificial Sequence: Synthetic coding sequence
atgttgagcggcgaacgcaaggaaggaggaagccctcgatttgggaagctgcacctgccggtgggtctctggattaacagcccgaggaagcagctggctaaactcggacgtcgctggccgtctgccgcttccgtgaagtcatcttcgagtgacacgggctccaggagtagcgagcctctgccacctcctccacctcacgtggagttgcgacgcgtgggcgcagtgaaagccgcaggaggcgctagtgggagccgtgcgaaaagaatctcacagttgtttaggggctcaggaaccggcacaaccggaagttccggcgcagggggacccggtaccccgggtggcgcacagcggtgggcaagcgagaagaagcttccagagctcgccgctggcgtggccccagaaccacctttggccacacgggctacagctcccccaggcgtcctcaaaattttcggtgcaggattggccagcggcgctaactacaagtctgtcttggcaacggccaggagtacagctcgcgagcttgtggctgaggcactcgaaaggtacggcctcgccggtagcccaggaggcggtccaggcgagtccagctgcgttgacgcatttgctctgtgcgacgccttgggcagaccagctgccgctggagtggggagtggtgagtggagggcggaacatctacgcgtgctgggtgattccgagcggccactgctggtccaggagctgtggcgggctcgcccaggctgggcaaggcgttttgaactcaggggcagagaggaagctagaaggcttgaacaggaggcgtttggagctgcagatagtgaaggaactggcgctccatcgtggcgaccacagaaaaatagatcccgggcagcgtctggaggtgcagcccttgcttcccccggaccgggaactggctctggtgctcctgctggatccgggggtaaagagagaagcgaaaacctgagcctccgcagatccgtctcggagctgagccttcagggacgacgcaggagacagcaggaaagacggcagcaggctctgagtatggccccaggcgcagctgacgcccagatcgggaccgccgatcccggagatttcgatcagctgactcagtgtctcatccaggccccttcgaaccgcccatactttcttcttctacagggttatcaagatgcacaagatttcgttgtgtatgtcatgacaagggagcagcacgtcttcgggcgtggtggaaacagctctggacggggtggctctccagccccatatgtagacacatttctcaacgccccagacatccttcctcggcactgtaccgtgagagccggacccgaacacccggcaatggtacggccaagtaggggtgcccctgttacacacaacggctgtctgcttcttcgagaggcagagctccatccaggcgatttacttggccttggcgagcacttcttattcatgtataaagatcccagaactgggggatctggacctgccagacctccctggttgcccgcacggcctggagctactcctcccggtcccggatgggcattcagttgtcggctgtgtgggagggggctacaggagcggggtgaagcccttgctgcctacctggacggccgtgaaccagttcttaggtttcgcccacgggaggaggaggctctgctgggtgagatcgtgcgggcagccgctgctggatctggcgatctacctcccctcggccctgcaactctcttggccctgtgcgtccagcacagcgcacgagaacttgaactagggcatcttcctcgtctcctcggccgacttgccagactgattaaagaggctgtatgggagaaaattaaggagataggtgatcgtcaaccagaaaaccatcctgaaggcgtgccggaggtgcccttaacccctgaagcagttagtgtcgagctcaggccacttatgctgtggatggccaatactaccgagctgctgagctttgttcaggaaaaagtgttagagatggaaaaggaagctgatcaagaagacccacagctgtgcaatgacttggagctctgtgatgaagctatggccctgcttgatgaagtcattatgtgcaccttccagcaaagcgtgtattacttaacaaagactctgtactcaacattgcctgcactgctggacagcaatcccttcacggctggggctgaactccctggcccaggtgccgagctgggggcaatgccacctggcctcaggcccaccctgggtgtgtttcaggcagcgctcgaattaacaagccagtgcgagctgcatcctgatctggtgagccaaactttcggctacctgtttttctttagcaacgcttcgcttctgaatagtttaatggagaggggacagggtcggccattctatcagtggtcaagagccgtacaaattcgtaccaacctggatttggtgttggattggcttcagggcgcaggactgggagacattgcgactgagtttttcaggaagctgagtatggccgtgaatcttctttgtgtccccagaacttcattattgaaggcctcttggtcttcactccgaaccgaccatccaacactcacacccgcacagctacaccatttactgagtcactaccagctgggacctggacgtggcccacctgccgcatgggatcccccaccggctgaacgggaagccgttgacacaggggacatttttgagtcattttcctcccatccgccactgattttgcccctgggtagtagtagacttcgactcactgggccagttactgatgatgccttgcacagagaactgcgaaggctgaggcggctgctgtgggatctggagcagcaggagctgccggcaaactatcgccacggaccgcctgttgccacctcaccatag

SEQ ID NO: 4363 - DNA, 630 bp, Artificial Sequence
  Description of Artificial Sequence: Synthetic coding sequence
atggactctgacgaaaccggattcgagcacagcggactatgggtctctgtgctggcgggtcttctgctgggagcttgtcaggcccatccaatcccagattcctcacccctgctgcagtttggcggacaggtacgccagcgctatttgtatacggatgacgctcagcagactgaagcccatctggaaattagagaagacggaaccgtaggtggcgctgcagatcagagccccgaatctctgttgcaactgaaagcactgaagcctggcgtgattcagattctgggggtgaagacctctagatttctgtgtcaaaggcccgatggtgctttgtatggatctctgcatttcgacccggaggcctgtagtttccgcgagctgctcctggaagacggctataatgtttatcagagtgaagctcatggtctgccgctccaccttcccggtaacaaaagtccacatcgcgacccagcccctcgaggacccgctagattcctgcctcttcctggcctaccccctgccttgcccgaacctccaggaattctggcccctcagcccccagacgttggaagtagtgatccactgtccatggtcggtcccagtcagggacgctctccatcctacgcttcctag

SEQ ID NO: 4364 - DNA, 321 bp, Artificial Sequence
  Description of Artificial Sequence: Synthetic coding sequence
atgttacgattcatccaggaggttaacactaccacccgttcctgtgccctgtgggatttggaagaagataccgagtacattgttcacgtgcaggctattagtatccagggccaatcacctgcttcagaaccagtgctgttcaagacccctcgagaggccgaaaaaatggcttccaagaacaaggacgaggtaacaatgaaggaaatgggcagaaatcagcaattaaggactggtgaggtgttaatcattgtggtggttctgttcatgtgggcaggggttattgctctattctgccggcagtacgacataattgaggcatag

SEQ ID NO: 4365 - DNA, 414 bp, Artificial Sequence
  Description of Artificial Sequence: Synthetic coding sequence
atgcttagatttattcaggaggtcaacacaaccacaagatcttgtgcactctgggatctggaagaagacacagaatatatagtccacgtgcaggccatatctatccaggggcagtcgccagcaagtgaaccggtgctgtttaaaaccccccgtgaggccgaaaagatggcttccaaaaacaaagacgaagtgactatgaaggagatgggtaggaaccagcagttgcgaacaggggaggtgctgatcatcgtggtagtcctatttatgtgggcaggcgtgatcgccctgttctgcaggcagtacgatattatcaaagataatgaacctaacaacaacaaggaaaagaccaaatctgccagcgagacaagcacccccgagcatcaagggggtggcctgctgcggagcaagatttag

SEQ ID NO: 4366 - DNA, 390 bp, Artificial Sequence
  Description of Artificial Sequence: Synthetic coding sequence
atgaaaaccttgcagtttttctttctgttctgttgctggaaggcaatctgttgtaactcttgtgagctcaccaacattactatcgccatcgagaaggaggagtgtcgattttgtatcagcatcaataccacatggtgcgcgggttactgctatacccgggaccttgtctataaagatcccgctcgacccaagattcagaaaacatgtactttcaaggagttggtatatgaaacagtgagggtgcccggttgtgcacaccatgccgacagcttatatacctatccggtagccacacagtgtcattgtggaaagtgtgactccgattctactgattgcactgttagggggctgggtccaagttactgctctttcggcgaaatgaaagagtag

SEQ ID NO: 4367 - DNA, 390 bp, Artificial Sequence
  Description of Artificial Sequence: Synthetic coding sequence
atgaaaacacttcaattctttttcctgttctgttgctggaaagccatatgctgcaacagctgcgagctgaccaacatcactattgcaattgagaaagaggaatgcaggttctgtatatccattaatactacctggtgcgccggatactgttacacacgtgacctggtgtacaaagatcccgcaagacccaagattcagaaaacatgtacgttcaaggagctggtctatgaaacagtcagagtccctgggtgtgcccaccacgccgactctctctacacctacccagtggccactcaatgtcattgcggcaagtgcgatagtgatagcacagattgcacagtacggggtttggggccttcttactgcagctttggtgaaatgaaggagtag

SEQ ID NO: 4368 - DNA, 390 bp, Artificial Sequence
  Description of Artificial Sequence: Synthetic coding sequence
atgaagacattgcaattcttctttctcttctgctgttggaaggcgatctgctgcaatagctgtgaactgacaaatattactattgcaatcgagaaagaagaatgtcggttctgcatatccatcaacaccacctggtgtgcgggatactgctatacccgtgacctggtgtacaaggatccagctcggccaaagatccagaaaacttgcacattcaaggaactggtgtatgagaccgtgcgggtccccggttgtgctcatcacgccgatagtctttatacctaccctgttgccacacaatgccactgtggaaaatgcgacagcgatagtaccgattgcactgttagaggcctgggaccaagttattgtagcttcggcgaaatgaaagagtag

SEQ ID NO: 4369 - DNA, 1260 bp, Artificial Sequence
  Description of Artificial Sequence: Synthetic coding sequence
atgagttttattcccgtggctgaagacagtgactttcccatccataatctgccctatggcgttttctccacgcgaggagatcccagacctcgtatcggcgtcgccattggcgaccagatccttgatttgagcatcattaaacacttgttcaccggaccggtgctgagtaagcaccaagacgtgttcaaccagcctactcttaatagctttatgggactcggccaggctgcctggaaggaggctcgcgtatttctgcagaatctgctcagtgtgagccaggctcggctcagagatgataccgagctgcgaaaatgcgcctttataagccaggcctctgccaccatgcaccttcccgcaacgatcggggattatactgatttctactcctctaggcagcatgcaactaacgtcggtatcatgttcagagacaaggagaatgccttgatgccaaactggctgcacctgcccgttggctatcacggccgagcctccagcgtagtcgtatcagggacccccatcaggcgcccaatgggacaaatgaagcccgatgatagtaagcctcctgtgtatggcgcatgtaagctgctggacatggaacttgaaatggcattcttcgtgggccctggtaaccggctgggggagcctatccccatttctaaggcccatgaacacatatttggcatggtgttgatgaatgactggagtgccagggacatccagaaatgggagtatgtgcctttgggtccctttctgggaaagagcttcggaaccaccgtaagcccttgggtggttccaatggacgctctcatgccattcgcagtgcctaaccccaagcaggatcctaggcctctgccctacctgtgccatgacgaaccctacaccttcgatatcaacctttcagttaacctgaagggagaagggatgagtcaagccgctaccatctgtaagtctaactttaaatacatgtactggaccatgctccagcaactgacgcatcacagtgtgaatgggtgcaatctcaggcctggcgatctactcgcctcaggaaccatttctggacctgagcctgagaacttcggctcaatgttggaactcagttggaaaggaacgaaacccattgatcttggcaacggacagactcggaagttcctgctcgacggggatgaggtgattatcaccgggtattgccaaggcgatggctatcggattggttttgggcaatgtgccggtaaagtgctgcccgcactgctaccttcttag

SEQ ID NO: 4370 - DNA, 1260 bp, Artificial Sequence
  Description of Artificial Sequence: Synthetic coding sequence
atgagtttcatccccgtcgccgaggattctgattttccaatccataatctgccgtacggggtattttcaaccagaggcgacccccgtccacgaattggcgttgcaatcggagatcagattctcgacttatccattatcaagcacctgttcaccggcccagttctgtctaaacaccaagacgtcttcaatcagcccacactcaattcctttatggggctgggccaggctgcttggaaagaggcccgagtgtttctgcaaaatctgctaagcgtgagccaggccagactgcgagacgacactgagctgagaaaatgtgcatttattagtcaagcgagcgctacgatgcacctccccgcaaccattggggactatactgacttctactcgtctaggcaacacgccaccaacgttgggattatgttccgtgacaaagaaaatgcccttatgcctaattggctccacctgccagtgggatatcatggcagagcatcaagcgttgtggtatcaggaactcctatcagacggcctatgggccagatgaaaccagacgactctaaaccgccagtttacggtgcttgtaaattgctcgatatggagttagagatggctttcttcgtagggccaggcaacagacttggagagcctatccctatcagtaaagcccatgaacatatctttggtatggtgttgatgaatgactggtcagcccgagacattcagaagtgggaatacgtgcctcttggcccattccttggcaagagttttgggactaccgtgagcccttgggttgtgcccatggacgctctgatgccgtttgctgtgcccaaccctaagcaggacccacgccctctaccctatctgtgccatgacgaaccatacacttttgacattaacctgtcagtcaatttgaagggagaaggcatgagtcaagcagcaacaatttgtaagagtaatttcaagtacatgtactggaccatgctccagcagctcacccatcattctgtgaatgggtgcaaccttcgcccaggcgatctgctcgctagcggaacaattagcgggcctgagcctgaaaacttcggctccatgctcgagcttagctggaaggggactaagcccatcgacttaggcaacgggcaaacccgcaagtttctgcttgatggggatgaagtgattattacgggttactgccaaggcgacgggtataggatcggattcgggcaatgtgccggaaaggtgctacctgctttactcccatcatag

SEQ ID NO: 4371 - DNA, 1260 bp, Artificial Sequence
  Description of Artificial Sequence: Synthetic coding sequence
atgtccttcatacctgtcgcagaggacagcgactttcccatccacaatcttccttacggagtcttctctaccaggggagacccaagaccccgaattggcgtcgccataggagaccagatcttagacttgagcatcatcaagcacttatttactggtccagttctttccaaacatcaggacgtctttaaccaaccaactcttaacagcttcatgggactgggtcaagccgcatggaaggaagcacgggtcttcttacagaacctactgtctgttagccaagctcggctcagggacgacactgaattgaggaagtgcgcattcataagtcaggcctcggctactatgcacctccctgcaaccattggggactacactgacttctattcctctaggcaacacgccacaaatgtgggaatcatgttcagagacaaggaaaacgccctgatgcctaattggcttcacctgcctgtgggttatcatggcagggcatccagcgtggtggtcagtggtaccccgattagacggccaatggggcagatgaagcccgatgacagcaagcccccagtatatggagcatgtaaactgctggatatggaacttgaaatggccttttttgtgggtccgggaaacaggttaggcgaacctatacccattagtaaggctcatgaacatatcttcgggatggtgctgatgaatgactggtcggccagggatattcagaaatgggagtatgtaccgctcgggcctttccttggaaaatcattcggaacaacagtctccccttgggtcgtccccatggatgccctgatgccgtttgccgtccccaatcctaaacaggatccgaggcctctaccttacttatgtcatgacgaaccatacacgttcgacatcaatctgagtgtgaacttgaagggcgaagggatgtcccaggccgcaaccatctgcaagtcaaactttaagtacatgtactggaccatgctacagcagctcacccaccactccgtcaatggctgtaacctgagaccaggggacttgctggcgagcggcacaatcagcggccctgagcccgagaatttcggttccatgctagagctgtcctggaaaggaactaaacccatcgacctgggcaacggccagacacgaaaattcctgctcgacggggatgaggttattataactgggtattgtcagggcgacggctaccggataggctttggacaatgcgctggcaaggtcctgccagcccttctgccttcatag

SEQ ID NO: 4372 - DNA, 759 bp, Artificial Sequence
  Description of Artificial Sequence: Synthetic coding sequence
atggaggcgatgtggctgctgtgcgttgctctcgcggtgctcgcctggggatttctctgggtctgggacagctcagagcgcatgaagtcacgcgagcagggagggaggttaggtgctgagagcagaacattgctagtcatcgcacaccctgatgatgaagctatgtttttcgccccaactgtgctcggcttagctagactgcgacactgggtttatctgctctgcttttccgctggcaactactacaatcaaggagagaccagaaaaaaagaactgctgcaatcttgtgacgtgttgggaatccctctatcttctgtcatgatcattgacaaccgggactttcccgatgacccaggaatgcagtgggacacagagcacgtggcgcgagtgctgctgcagcacattgaagtgaatggtatcaacctggtggtcacatttgacgctggaggcgtgagcggccacagcaaccatattgcactttacgcggctgtgcgggcactccactccgagggaaaactcccgaagggctgctcagtgctaactctccaatcggtaaacgtactaaggaagtacatctcactcctagatctccctctgagcctcctgcacactcaggacgtgctctttgtccttaactctaaggaagttgcccaggcaaaaaaggctatgtcctgtcacaggagccagctgttgtggttccgcagattgtatatcatcttttccaggtatatgcggatcaactccctgtcgtttctctag

SEQ ID NO: 4373 - DNA, 1203 bp, Artificial Sequence
  Description of Artificial Sequence: Synthetic coding sequence
atggcagccctccgtcaacctcaagtagccgaactactcgctgaggcaaggcgggcattccgcgaagagttcggcgctgagcctgagttggctgtgtctgcccctgggcgagtcaatttgataggagaacacaccgactacaatcagggccttgtccttcccatgcgggatcgactcttcccaaccctggaaggccgaaagagggggtctggccgtgagagagtgaggggacggcttctcgcgcaggctcgccctcttggagccggagctcccaggcttcagccagggtccatgttcccactgaattgcgaggcactgtgcgcaacgcagaaggggacgcttcgggcaagcggacacagaggggcaccgacagcagacctgggagagcgcagtttactggcccagcccgtccaatttacggaggaggagactggaggcgctttcagacctatctgtagcctaggctcggctcaggcctcctcccctccatgtccaacagcgcaaggcagggtgcaagacggtttggtgtccctgctcaccaccagcgagggggctgatgagccccagagactgcagttcccattacccacagctcagcggtctttggaacccggaactcccaggtgggccaactacgttaagggggtaatccaatactacccagccgcaccactgcctggcttttccgctgttgtggtatcatccgtccctctcgggggaggtttaagttcatcggcaagcctggaagtcgccacttacacatttttgcagcagctttgtccagactcaggtacaatcgctgcgagagcccaagtgtgccagcaagcggaacactccttcgctgggatgccctgcggtatcatggatcagtttatatctctgatggggcaaaaggggcatgctctcctcattgactgccggagtctggaaacatcattagtgccgcttagcgatcctaaactcgctgtgcttatcacaaactccaacgttcgtcatagcctggcctccagcgagtacccagtgagaagacgtcagtgtgaagaggtagctcgtgcccttggcaaggagtcgctccgggaagtgcagttagaggaactggaggcagctagggaccttgtgtcaaaagaaggctttaggcgggctcgtcacgtagtgggcgagatccgccgtactgccgatggcgctaaggtcctctgtttgtag

SEQ ID NO: 4374 - DNA, 1269 bp, Artificial Sequence
  Description of Artificial Sequence: Synthetic coding sequence
atgtgtgccccaccacgcggtgccccaccagagcacccggctcctactggcctgtgtaggtcctcttgtgccgagctgcaagccagagtcatggccgctcttcggcagccccaggttgctgaactgcttgccgaagccaggcgggcttttagagaagaattcggcgctgagccggagttggctgtttcagcccctggtcgtgtaaatctgattggagagcatacagattataaccagggattggtactccctatggccctagaattgatgacagtcttggtggggtctcccagaaaggacgggctggtgagtctcctcacaacaagcgaaggagcagacgaaccacaacggctccagtttccattgcctaccgctcagaggtctctggagcctgggactccacgctgggctaactacgtcaaaggcgtaattcagtattatccagctgctccactacctggtttttccgcagtggtcgtgtcctcagttcctcttggcggtggtctttcttctagcgcttcactggaagtcgcgacctacacatttttgcagcagctgtgcccagacagtgggaccatcgctgcacgcgctcaagtctgtcagcaggctgaacactcatttgcaggaatgccttgtggaatcatggaccagtttatttcgctcatgggccaaaaaggccacgcccttctcattgattgtcgaagcctcgaaacgagtttggttccgctctctgatccaaagttggccgtgttaatcaccaacagtaatgttaggcacagcctggctagttcagagtatcctgtacgcagacgacagtgtgaggaagtggcccgagcactcggaaaggaatcccttcgcgaggtgcagctggaagagttggaggcagctagagacctggtctctaaagaaggcttccgacgtgccaggcacgtggttggtgagatccggaggactgctcaggccgcagccgctttacggcgtggagattacagagcatttggtcgactgatggtggagtcccacagatccctgcgcgacgactatgaagtgtcctgccccgaacttgaccagttagtggaggccgcactggctgtccccggagtctacgggtcccgtatgacaggagggggattcggcggttgcaccgtgactctcctggaggcttctgctgcaccccatgctatgcgacatattcaggaacactacgggggaactgccacattctatctgagtcaggccgcagatggtgccaaggtgctgtgcctgtag

SEQ ID NO: 4375 - DNA, 1179 bp, Artificial Sequence
  Description of Artificial Sequence: Synthetic coding sequence
atggctgctctcagacagccacaggttgcggagctcctggcagaggctcggcgtgccttccgggaagagttcggggcagagcctgaactagcggtgagcgctcccggaagagtgaacctgatcggagaacatactgattacaatcaaggcctagtgctgccgatggcacttgagctgatgaccgttttggtgggcagccctagaaaagatggacttgtttcactgttgaccacatccgaaggcgctgatgagccccaacgcctgcaatttccccttcctacagctcagaggagtctggagcctgggaccccacgctgggcaaattacgtgaaaggagtgatccagtattaccccgctgctccacttcctgggttcagtgcggtggttgtatcaagtgtgccactaggcggtggcctgtccagctctgcctcattagaagtggctacctataccttcttacagcagttatgccccgatagtggcacaatcgcggctcgggcacaggtgtgccagcaggctgagcactccttcgccggtatgccctgcggcatcatggaccagttcattagtttgatgggacagaaaggacatgcactgttgatcgattgccgatcactggagacctccctcgtcccactgtccgaccccaagcttgcagtgcttataaccaactccaatgttcggcacagtttggctagtagtgagtatcccgtccgaagacgtcagtgtgaagaggtggcgagagccctcggcaaagaatcactgagggaggtgcagctcgaagagctcgaggctgctcgggacctggtcagtaaggaaggctttcgcagggctcgacatgttgtcggtgagatccggaggacagcacaagctgcagccgcactcagacgaggcgactacagggccttcggcaggctgatggtggagtcccatcggagccttcgcgacgattatgaggtcagctgccccgaactcgaccaactagtcgaggctgcattagcagtacctggggtgtacggctctaggatgactggcggaggatttggtggatgtacagtgacactcttggaagccagcgctgcacctcacgccatgcgccacatccaggagcactacggaggcactgccacattctacctcagtcaggccgcagatggcgcaaaagtgctctgtctgtag

SEQ ID NO: 4376 - DNA, 1569 bp, Artificial Sequence
  Description of Artificial Sequence: Synthetic coding sequence
atggcagcagtggtggctgctacgcggtggtggcaactgctgctagtgctgtcggccgctgggatgggggctagcggcgctcctcagccacctaatatcctgttactgctaatggacgacatgggatggggtgatctcggagtgtatggggaaccgagcagggaaacccctaacctcgacagaatggcagctgagggcctgttattccctaatttctatagcgccaatcctctctgcagtccctcaagggccgcattactgaccggacgtctgcctatccgtaacgggttttataccacgaatgcccatgccaggaacgcatatactccccaggagatcgtggggggaatacccgacagtgagcagctgttaccagagcttctgaagaaagcgggttacgtgtccaagatcgtcgggaaatggcatctgggtcacagaccccagtttcatccactgaagcatggatttgacgaatggtttgggtcaccaaattgccattttggcccttacgacaataaagcccgtcctaacatacccgtgtaccgggactgggagatggtcggtaggtactatgaagaatttcctattaaccttaagactggggaggccaacttgacacagatttatctgcaagaggcactcgatttcattaagaggcaagctaggcatcacccattcttcctgtactgggctgtggacgcaactcatgcacccgtctacgctagcaagcccttcctaggtacttcacagagaggaaggtatggcgatgcagtgagggaaatcgatgacagtattggaaagattttggaacttctgcaagatctgcatgtggcagacaacactttcgtgtttttcacatccgacaacggcgcagctttgatctccgctcccgagcagggcggtagcaacgggccttttctgtgcggaaaacagactactttcgagggcggaatgcgcgagcctgcgttagcatggtggcccggtcacgtgaccgcaggccaggtatcccaccagctgggctctatcatggaccttttcaccacgtccctggctctggctggactgactcccccaagcgatagggccattgacggtctcaacttgctgccaacacttttgcagggcagactgatggatcggcctatcttctactataggggtgatacattgatggccgctactctgggtcaacacaaggcacatttttggacatggactaattcgtgggaaaattttagacaagggattgatttttgtcccggacagaatgtctcaggagtcactacccataatctggaagatcacaccaaattgccactgatatttcatctcggccgagatcccggagagcgattcccactgtcatttgcttctgcggagtaccaggaggcactgtcaagaatcaccagcgtcgtgcagcagcaccaggaggctctggttccggcacaaccgcaacttaatgtttgtaattgggcagtcatgaactgggctccccctggctgtgagaagctcgggaaatgtctgacgccacccgaatctatacctaagaagtgcctatggagtcattag

SEQ ID NO: 4377 - DNA, 261 bp, Artificial Sequence
  Description of Artificial Sequence: Synthetic coding sequence
atggctgcagtggtggccgcaactcgctggtggcagctcctgctggtgctgagcgccgcaggcatgggggctagcggagcaccacaaccacccaacattctgctgctgctaatggatgaccggggtcgccattgtagccaggatggttatcccagcgctatggcctctaccccacctacgcccatgccggaaacgcctactcacaggagaagactttgggctgcctcacaaacaagaagttccagttgccggtcattttag

SEQ ID NO: 4378 - DNA, 1344 bp, Artificial Sequence
  Description of Artificial Sequence: Synthetic coding sequence
atggccgctgtcgtagcagcaacgagatggtggcagctcctgctggtgctgtccgccgctgggatgggggctagcggcgctcccggacagcgagcgtacacccctcaagaaattgtcggtggcatacctgacagcgagcagcttctaccagagttactcaagaaggccggatacgttagcaaaattgtaggaaaatggcacctcggtcatcgcccacagttccatcctctgaagcatggctttgacgaatggttcggctcaccaaactgtcatttcggcccatacgacaataaggccaggcccaatattcctgtgtaccgtgattgggagatggtcggccgttactatgaggaattccccattaacttaaaaaccggagaagccaatttaacacagatttacctccaggaagcactcgacttcatcaaaaggcaggctcggcatcacccattttttctgtactgggccgttgacgctactcatgcccctgtgtatgccagcaaaccatttctcggaacctcccaaaggggccgttatggagatgcggtgcgggagattgacgattctattggaaaaatattggaactgcttcaggacctgcacgtggccgataatactttcgtgtttttcacctcagataatggcgctgcccttatttccgctcccgaacagggcggttcaaatggcccattcctttgtgggaaacagactacttttgagggcggtatgagggagccagcattagcttggtggcctggtcatgtgacagccggtcaggttagtcaccagcttggctccatcatggatcttttcactacttctctggctctggccggacttacaccaccctccgacagggccattgacggtctgaatctgttacctacactgcttcagggaaggttaatggataggcccattttctattataggggagacaccctgatggcagctacgctgggtcaacacaaagctcatttctggacctggaccaacagttgggagaatttcaggcaggggattgatttttgcccgggtcaaaacgtgagcggtgttacaacacacaatctggaggaccacaccaagcttcctcttatcttccatttgggcagagatccaggggagcgcttccctctgtccttcgcaagcgccgaatatcaggaagccctgtctaggatcaccagcgtagtgcagcaacatcaggaggcgcttgtgcctgcacaacctcagctgaacgtttgcaattgggcagtgatgaattgggcacctcctggttgcgagaaactcggaaagtgtctgacgccgcctgagtctatccccaaaaaatgcctctggtctcactag

SEQ ID NO: 4379 - DNA, 1140 bp, Artificial Sequence
  Description of Artificial Sequence: Synthetic coding sequence
atgagcaggtccggcaccgacccccagcagaggcaacaagcttctgaggctgatgccgcagccgctacattccgagccaacgatcaccagcatatccgttataatccccttcaagatgaatgggttctggtatcagctcaccggatgaagcggccttggcagggccaagtcgagcctcagctcctcaaaacagtgcctcgtcacgacccccttaatcccctttgccccggagcgatacgggctaatggggaagtaaatcctcagtatgactccacatttcttttcgataatgattttcccgcacttcagcctgacgccccttcaccaggaccatccgaccatcctctgtttcaagccaagagtgctcggggtgtgtgtaaggttatgtgcttccatccttggtctgacgtgaccctccccttgatgtctgtgccagaaataagagcagtagtcgacgcctgggctagtgtgacggaagaacttggtgcacagtatccttgggttcagatttttgaaaataaaggcgcaatgatggggtgtagcaatccacacccccactgtcaggtttgggcctctagtttcctgcctgacatcgcccagagagaggagcgaagtcagcaggcctacaagtcgcaacacggtgaaccactccttatggaatatagtcgccaggagctgctcaggaaggagcgcctggtccttactagtgaacactggctggtcctcgtgccattttgggcaacatggccgtaccaaacgctgctgctgccaagacgccatgtgaggcgcctacctgaactcacacctgcagagcgggatgatctcgccagcatcatgaagaaattgctgaccaaatacgataacctttttgagacaagcttcccatattcaatgggttggcacggtgcccctactggaagcgaggcaggagccaattggaaccactggcagctgcatgctcactactatcctccactgttgaggtcagctactgtcagaaagttcatggtggggtacgaaatgctcgctcaggcccaaagggacctgacccctgagcaggcagccgagaggttgagggcattaccggaggttcactaccatttaggccagaaggaccgtgaaactgccactatcgcttag

SEQ ID NO: 4380 - DNA, 813 bp, Artificial Sequence
  Description of Artificial Sequence: Synthetic coding sequence
atgacactctcaactctttgcgtactggggccaagtgaacccaccgagtcaaaggtaatgtgctttcatccgtggtctgacgtgactctccctctgatgagcgttccagagatccgagctgttgttgacgcgtgggcttcagtcaccgaagagctcggcgcacagtatccctgggtccagatattcgagaacaaaggtgccatgatgggatgttctaacccccacccgcattgccaagtgtgggcctctagtttcttaccggacatcgcccagcgggaagaaagatctcagcaggcatacaagagtcagcatggagagcctctgttaatggagtactcaagacaagagttactcaggaaagaaagactcgtactgacttcagaacattggctagtgttggtgcccttctgggctacctggccctatcagactctactcctgcccagaagacacgtgcgacgacttcccgagttgacacctgctgaacgcgacgatctcgccagcatcatgaaaaaactgctgacaaagtacgataatctgttcgaaacaagctttccctactccatgggttggcacggggctcccactgggtccgaggctggagccaattggaaccattggcaattacatgctcactattaccccccactgctgcggagcgcaaccgtacgaaagttcatggtgggatacgagatgctggcacaagcgcaacgggatcttacccccgaacaagcagctgagcgtctcagagccttgccggaggtccactaccacctcgggcaaaaggaccgcgagacggcaaccattgcttag

SEQ ID NO: 4381 - DNA, 255 bp, Artificial Sequence
  Description of Artificial Sequence: Synthetic coding sequence
atgagcaggagcggaaccgatccccagcagagacagcaggcttcagaagcagacgctgctgcggcaacattcagggccaatgaccaccaacacattcgctataaccccttgcaggacgagtgggtgcttgtgtcagcgcacaggatgaagcggccatggcagggacaggtggagccccagcttctcaagacagtcccaaggcacgatccgctcaaccccctctgtcccggtgctatcagggccaacggagagtag

SEQ ID NO: 4382 - DNA, 2229 bp, Artificial Sequence
  Description of Artificial Sequence: Synthetic coding sequence
atgagccctcagaaacgagtgaagaatgtccaagctcagaaccgcacatcccagggcagtagttccttccagaccaccctttctgcctggaaagtcaagcaggatccctcgaatagcaagaatatcagtaaacacggccagaacaaccccgttggagactacgaacatgcagatgatcaggcagaggaggatgcgctacaaatggcagtgggatatttcgaaaaaggcccaatcaaagcttcgcaaaataaggacaaaacactcgaaaaacacttgaaaaccgtcgaaaatgtagcctggaagaatggattggcttccgaagagatcgatatcttgctgaacattgccctctccggcaagtttggaaatgccgttaacacccgcatactcaagtgcatgatccccgctacagtgatttccgaggattcggtggtgaaagccgtttcatggctgtgcgttggcaagtgttcaggtagcacgaaggtactgttctatagatggttagtggcaatgtttgattttattgacaggaaggaacagatcaacctcctttatggcttctttttcgctagtctgcaggacgacgcactgtgcccttacgtgtgccatctactgtatttactgacaaagaaagagaacgtcaaacccttcagagtccggaaactcctcgatctacaagctaaaatggggatgcagccccatctccaggcactgctgagtttatataaatttttcgcaccggctttgatctcggtctcccttccagtgcgaaagaagatttacttcaaaaactctgagaatctctggaagaccgcacttcttgccgtaaaacaaagaaaccgtggcccatctcccgaaccactgaaacttatgctgggtcccgcaaatgtgcgacctctcaaaaggaaatggaactcgctcagcgtcatcccagtcctaaacagttcatcgtacacaaaggaatgcggaaagaaggaaatgtcacttagcgattgcctcaaccgcagtgggtcgtttccactggagcagctgcagagttttccgcagctgttacaaaatattcattgtctcgagctccctagccagatgggtagcgtgctgaataattctctgcttctgcattacattaactgcgtgagagacgaaccagtgttactgcggttctactactggctgtctcaaacacttcaagaagagtgcatttggtacaaagtgaataactatgaacacggtaaggaattcaccaatttcctagacaccataatccgtgcagagtgctttctgcaggaaggcttttacagttgcgaagctttcttgtacaagtcattacccttgtgggacggcctttgttgcaggagccagttcctccagctggtcagttggatacccttttcttctttctccgaggtgaagcccctgctcttcgaccacttagcacagctcttcttcacttccactatctacttcaagtgttccgtgttacagtctcttaaagaattgctgcaaaattggctcttatggctgagcatggatatccacatgaagcccgtgaccaattctcccttggagaccacacttggtgggagtatgaactctgtgtccaaattgatccattacgtgggttggctaagcaccacagcaatgagacttgagtcaaacaatacttttctgctgcactttatattggatttctacgagaaagtgtgcgacatctacattaactataatctcccgctggtagtgttgttccccccaggaattttctactctgccctgctatctctagatacttccatactaaatcaattatgtttcatcatgcaccgctacaggaagaacctcactgctgccaaaaaaaacgaattagtgcagaagacaaagtctgagttcaacttctctagcaagacctatcaagaatttaatcactaccttacttctatggtcggatgtctttggacaagtaagcccttcggtaaaggcatttacatcgacccagaaattctcgaaaagacaggagtggccgaatacaagaactccctaaatgttgtccaccatccatccttcttgagctatgcagtatcgtttctgcttcaggggaaaaagtggtcctggtaccttgactacttgtttagccaagggctacaggggttgaagctgttcattaggagctccgttcatcactcctccattccacgtgctgagggtatcaactgcaataaccaatactag

SEQ ID NO: 4383 - DNA, 636 bp, Artificial Sequence
  Description of Artificial Sequence: Synthetic coding sequence
atgaagttgtgggatgtagtggccgtgtgtctagtcttattgcacactgccagcgcattccctcttcccgcagggaagcggccacctgaagcccctgcggaggatcggtccttgggacgacgcagggcgcctttcgccttgtcgtcagattctaatatgcccgaagactacccagaccagttcgatgacgtcatggatttcatccaagcaaccatcaagcgcctgaagcgttcccctgacaaacaaatggctgtgctcccaaggcgggagcgtaatcgtcaggctgccgcagctaaccccgaaaacagtagggggaagggaagaagaggccaaagaggaaagaaccgcggatgtgtactgactgcaattcacctcaacgtgaccgatctggggttgggatatgagacaaaggaggagttaatctttagatactgctcaggttcgtgtgatgctgctgagactacttacgataaaatcttgaagaatctgagtcggaaccgcagattagtaagcgataaagtgggccaggcgtgttgccggcctattgcatttgacgatgacctgtccttcttggacgataacctcgtctaccacatcctgcgcaaacacagcgctaagagatgtggctgtatctag

SEQ ID NO: 4384 - DNA, 558 bp, Artificial Sequence
  Description of Artificial Sequence: Synthetic coding sequence
atgaaactttgggacgtggtcgcagtctgtttagtgcttctccatacagcatctgcgttcccactgcctgcagccaatatgcccgaggattatcctgaccagtttgacgatgtaatggactttattcaggccaccatcaagcgtctgaagcgaagtcctgataaacagatggcagtcctacctcgtagagagcgcaatagacaggctgcggctgccaatcccgagaactctaggggaaaaggcaggcggggacagcgaggaaaaaaccggggatgtgtgcttaccgccatccacctgaacgtaactgatcttggactggggtatgagacaaaagaggagctgatttttaggtactgctctgggtcgtgcgatgccgctgaaacaacctatgacaagatcctaaagaacttatcccgtaaccgcagactcgtaagtgacaaggtgggccaggcttgttgtcggccaatcgccttcgatgacgacctgagtttcctcgacgacaacctggtgtaccacattctgagaaaacacagcgctaagagatgcgggtgcatttag

SEQ ID NO: 4385 - DNA, 687 bp, Artificial Sequence
  Description of Artificial Sequence: Synthetic coding sequence
atgcaaagtcttcccaactcgaatggcgctgctgctgggcgagactttaagatgaaactgtgggacgtggtggcagtttgcctggtgctgctccatactgcgagcgcctttcccctcccagccggaaagagaccaccggaagccccagctgaggatcgatccttggggcgtcgccgtgcgccatttgcgctgtcttcagattctaacatgcccgaggactaccccgaccagttcgatgacgtcatggattttatacaggccactatcaaacggctgaagcgttctccagataaacagatggccgttctccctaggcgcgagcgaaacagacaggcagcagcagccaatccggagaactcaaggggcaagggcaggcgcggacagcgtggaaaaaaccgcggatgtgttttaaccgccatccacttgaacgttaccgaccttggcttggggtatgagacaaaggaggagcttattttccggtactgttccgggtcttgcgacgccgcagaaaccacgtatgacaagattttgaagaacctcagccgcaatagaagactggtgagcgataaggtggggcaggcctgttgcaggcccattgcattcgacgacgacctcagctttctggacgataatctggtataccatattcttaggaagcattccgcaaaaagatgtggctgtatttag

SEQ ID NO: 4386 - DNA, 186 bp, Artificial Sequence
  Description of Artificial Sequence: Synthetic coding sequence
atgaaactttgggacgtcgtcgcggtgtgcctggttctgttgcacaccgcttccgcctttcccctgcctgccgcaaacatgcccgaggactatcctgaccaattcgacgatgtaatggatttcatacaggccactatcaaacgtcttaagcggagccccgacaagcagatggcagtcctaccctag

SEQ ID NO: 4387 - DNA, 186 bp, Artificial Sequence
  Description of Artificial Sequence: Synthetic coding sequence
atgaaactttgggacgtggtcgccgtgtgtctggtgctgttacatactgcttctgctttcccgctgccggctgctaacatgcccgaggattaccccgaccaattcgacgatgtgatggattttatacaggcaaccattaaaagactgaagcggtcccccgacaagcagatggctgtgctcccctag

SEQ ID NO: 4388 - DNA, 558 bp, Artificial Sequence
  Description of Artificial Sequence: Synthetic coding sequence
atgaagctatgggatgtcgtcgccgtgtgtctcgtgctgctccacactgcgagcgctttccctcttcccgcagcaaacatgccagaggactaccccgatcagttcgatgacgtgatggacttcatccaggccacaatcaaaagactcaagcgctcaccagacaaacagatggccgtcctgccgcgacgggagaggaataggcaggcagctgctgctaacccagagaactccagaggtaaggggagacgtggccagaggggtaagaatagagggtgtgtgctgactgcaatccacttgaacgtgacggatttgggcctgggctatgaaactaaggaagagctcatttttagatactgtagtggatcctgcgatgctgcagagactacgtacgacaaaattttgaaaaacctctctcgtaacagacggcttgtttctgataaggtcggtcaggcttgctgtcgacccattgctttcgatgacgatctctcattcttggatgacaatctcgtctaccatatcctgcggaaacatagcgccaaaaggtgtggctgcatctag

SEQ ID NO: 4389 - DNA, 609 bp, Artificial Sequence
  Description of Artificial Sequence: Synthetic coding sequence
atgcaatccttgccaaactccaatggcgctgccgctggacgagacttcaaaatgaagctgtgggacgtagttgccgtctgcctggtcctgctgcatacggcctcggcatttcccctgcccgctgccaacatgcctgaagactatcctgatcagttcgatgacgttatggacttcattcaagctacaattaaaagattgaagagatcccccgacaaacagatggccgtgctgcccagacgcgagcgaaaccggcaggccgcagccgcaaaccccgagaatagtaggggtaagggacgacggggtcagagaggtaagaaccgtggctgtgttctgaccgcaatacatttgaatgtgactgatctgggactaggctatgagactaaagaagagttgatcttccggtattgtagcggttcttgtgatgccgctgagaccacttacgacaagatcttgaaaaatctttcacggaaccgaagacttgtcagcgacaaggtgggacaggcgtgctgccgcccaatagcttttgacgatgatctgtcttttctagatgataacctagtttatcatatactccgcaagcattctgcgaagcgttgtggatgtatctag

SEQ ID NO: 4390 - DNA, 543 bp, Artificial Sequence
  Description of Artificial Sequence: Synthetic coding sequence
atgaaatcaatttacttcgtggccggtctttttgtgatgttggttcagggaagttggcagagaagcctccaagacaccgaggagaagagcaggtcctttagtgcatctcaggctgatccactgtccgaccctgaccaaatgaacgaagacaagaggcactctcagggtaccttcactagtgattactctaagtacttagactctcgccgagcgcaggatttcgtgcagtggttaatgaacactaagagaaatcgaaacaatatcgctaaacggcatgacgagttcgagcgccacgccgaagggacgtttacttcagacgtttccagctacttggagggacaggccgctaaggagttcatcgcgtggctggtcaaagggcgaggtagaagggacttccccgaagaggtggcgattgttgaagagcttggcaggcgtcatgcagatggctccttcagcgatgaaatgaacaccatcctggataatttggctgcacgagactttatcaactggctgatccagacaaaaatcaccgatcgaaagtag

SEQ ID NO: 4391 - DNA, 543 bp, Artificial Sequence
  Description of Artificial Sequence: Synthetic coding sequence
atgaagtcgatttacttcgtggccggtctcttcgtgatgcttgtccagggttcctggcagagatcgctgcaggacaccgaagagaaatctcggtctttttctgcttctcaagccgaccccctgtccgaccctgatcaaatgaacgaagataagaggcactctcagggcacttttactagtgattactctaaatacctggatagcaggagggcccaggattttgtccaatggctgatgaacaccaaaaggaacagaaacaatatcgcaaaaagacatgatgaattcgaaaggcacgcagagggcacattcacctccgacgtaagctcttacctggagggccaagccgcaaaggaattcatcgcctggcttgtgaagggcaggggaagacgcgactttccagaggaggtggcaattgtagaggaactgggtaggaggcacgctgatggatctttctccgacgaaatgaacacaatccttgacaatctagcagcgagggattttattaactggctgattcaaacaaaaattactgatcggaagtag

SEQ ID NO: 4392 - DNA, 2262 bp, Artificial Sequence
  Description of Artificial Sequence: Synthetic coding sequence
cgcgcacctgatcggagaggctctccaaggcttgcatccaccagactaggcgctcttaggctgcggccaagccgacgcgtgcccgctcgtgcgccagctcccgcacaagcccctctgccacttggacctaggttactggggttgcggaggaacatggctgcacccatgacccctgctgcacggcctgaagattatgaggctgcactgaatgcagccttagccgatgtccccgagctagcccgtctcttagagattgatccctacctgaagccctatgctgtggacttccagagacgttacaagcagttcagccaaatcctgaaaaacattggcgagaatgagggaggtattgacaagtttagcaggggctacgagtccttcggagtgcatcggtgtgccgacggaggcctgtactgcaaagaatgggcgccaggagccgagggcgtattcttaaccggggacttcaatggctggaaccccttctcatacccctacaagaagctagactacggcaaatgggagctgtatataccccctaaacagaataagtctgtgttagtgccacatggcagcaagctgaaagtggttatcacgtccaagagtggcgaaatcttgtaccgcataagtccttgggcgaagtacgtggtcagggagggggacaacgtgaattatgattggattcactgggatcccgaacactcgtatgaattcaagcatagtcggccaaagaagccacgtagtttacggatttatgaatcccacgtcgggatttcttctcatgaggggaaggtggccagctataagcacttcacatgcaacgtgcttccacgaatcaaaggacttgggtacaactgtatccagttaatggcgattatggagcacgcatactatgcttcattcggatatcagatcacctcattcttcgctgcgtcctcccggtatggcactcctgaagagctccaggagctagtcgatactgctcactcaatgggcatcattgtgctgttggacgtggtgcatagccacgcttctaaaaattcggctgatgggctcaatatgtttgatggaactgatagctgttatttccattccggcccaagagggactcatgatctgtgggatagccgacttttcgcttattcttcttgggaaatcttacgatttctgctgagcaatattagatggtggttggaggaatacaggtttgatggctttcggtttgacggagtgacttccatgctgtatcaccatcacggcgtgggccaagggttcagcggtgactatagcgaatatttcggactccaagtggatgaagacgcccttacttacctgatgctggccaaccatctggtgcataccctgtgtcccgatagcatcacgatagcggaggacgtgtctggtatgcctgccctatgcagcccgatctcacagggtggaggaggctttgactaccgcctcgctatggctattcctgataaatggatccaactgctaaaagagtttaaggacgaggattggaatatgggcgacatcgtctatacactgacgaaccgcaggtatctcgaaaagtgcatcgcctatgccgaaagccacgatcaagccctggtcggggataagagcctggcattttggctcatggacgctgaaatgtacacaaacatgtcagttctgactccgtttaccccagttatcgaccggggtattcaactccacaaaatgatcaggttgatcactcacgggctaggaggggaaggatatctgaactttatgggtaatgaatttgggcatcctgaatggctagacttcccacgcaaaggcaataacgaatcctatcactacgcccgtagacagtttcatctaacagatgatgaccttctgcgctacaaattcctcaataacttcgaccgagatatgaaccggctggaagagaggtatggttggctcgcggctccccaagcgtacgtgtcagaaaaacacgaaggcaacaagatcattgctttcgagcgggctgggcttctttttatattcaatttccatcccagcaaaagttataccgactaccgcgtgggcactgctctccccggaaaatttaagatcgtgctggattccgacgcggctgaatacgggggacaccaacgcctcgaccattccaccgacttcttcagcgaggcctttgaacataacggaagaccctatagcctgctggtgtacataccatcacgggttgcactcatcctccaaaacgtggacctgcccaattag

SEQ ID NO: 4393 - DNA, 2109 bp, Artificial Sequence
  Description of Artificial Sequence: Synthetic coding sequence
atggcagctccaatgacccctgccgctcgacccgaagattatgaggccgctctcaatgcagctttggctgacgtacctgaattggcccgattgctcgaaatagatccatatctgaaaccttacgccgtggactttcaacggagatataagcaattcagtcagatcctcaaaaatattggggagaatgaggggggtatagacaaattcagccgtgggtacgagagcttcggcgtccacagatgcgctgacggtgggttatattgcaaggagtgggcgccaggcgctgaaggcgtgtttttaaccggggacttcaacggatggaatccattcagttacccctacaaaaaactggactacgggaagtgggagctgtatattccgccaaagcagaataagtccgttctcgtccctcacggtagtaagctgaaagtggtcatcacttctaagagcggcgaaatcctctaccgaattagcccctgggccaagtacgttgtaagggagggcgacaacgtgaattacgactggattcactgggacccagaacactcctacgaattcaagcattcgcgccctaagaagccacggagtcttcggatttatgagagccacgtcgggatctccagtcacgaggggaaagtggcaagttacaagcattttacttgcaatgtgttacctcgcattaagggcctcggctataattgcatacagttgatggctatcatggagcatgcctactacgcttctttcggttaccagattacgagtttttttgctgcgagcagcagatatggcaccccagaagagctccaggaactggtagatacagctcactctatgggcattatcgtgctcttggatgttgtgcactcccacgcctctaagaacagcgcagacgggcttaatatgtttgacggtacagactcctgctatttccacagtggccctaggggtacccatgatctgtgggattctagactgttcgcctattcttcatgggagatccttagatttctcctcagtaatattcgctggtggctcgaagagtataggtttgacggattccgcttcgacggcgtgacctccatgttgtatcatcaccacggcgtcggacagggcttttcaggggattactctgaatactttggcctgcaggtggacgaagacgccctcacttatttgatgctggcaaatcacctggtgcacaccctgtgccccgattctattaccatcgccgaagatgttagcggaatgcccgcactctgctcccctatcagccaaggcggtgggggtttcgactacaggttggctatggctatcccggataagtggatccagctgctcaaagaattcaaagatgaggactggaacatgggggacatcgtctataccttgacaaatcgcaggtacctcgaaaaatgcatcgcgtacgccgaaagccacgaccaggccctggtcggcgacaaatccctcgccttttggttaatggatgcagagatgtacaccaacatgtccgtcctgacccccttcacaccagtgattgacagagggattcagctgcacaagatgatccggcttatcacccatggattgggtggggaagggtatttaaactttatgggaaatgaatttggccacccagaatggctagacttccctagaaagggaaacaatgagagttaccactacgcacggcgtcagttccatctgaccgatgatgatctcttgcgatacaaatttctcaataatttcgatcgcgacatgaatcggcttgaggagagatatggttggctcgcagcacctcaagcatatgtgtcagagaagcacgagggtaataagatcattgccttcgagagggccggactgcttttcattttcaactttcatccttcgaaaagctataccgactacagagtcggaactgcgctgccaggcaaatttaagatcgttttggactctgacgctgcggaatacggcggacatcaacgcttagaccacagcaccgattttttcagcgaggcgtttgagcacaacggcaggccctacagcttgctggtatacataccatcccgcgtggctctgatcctgcaaaatgtagacttaccaaactag

SEQ ID NO: 4394 - DNA, 1398 bp, Artificial Sequence
  Description of Artificial Sequence: Synthetic coding sequence
atggctatcatggagcacgcatattatgccagtttcggatatcagatcacaagcttctttgcggcaagcagccggtacggaacacctgaagaactgcaggagttagttgacaccgctcattcaatgggcatcatcgtgctcctggatgtagtccattcccacgcttctaaaaactccgcagatggtcttaatatgtttgacgggacagattcctgctactttcatagcggccctagggggacccatgacctctgggactctcgcttatttgcttactcatcctgggagattttacgattcctgctctcaaacatccgctggtggctggaggaatacagattcgacggatttcgtttcgacggggtgacaagtatgttgtaccatcaccacggagtaggccagggattttctggcgattattcagagtacttcggccttcaagtggacgaggatgctctgacataccttatgctggccaatcacctggtccataccttatgccccgactctattacgatcgcggaagacgtatcgggtatgcccgcactctgctcacccatttcgcaaggcggtgggggatttgattatagactggccatggcaatacccgacaagtggatccagttgctcaaggaattcaaggacgaagactggaacatgggagatattgtttataccctaacaaaccgaaggtatttagagaagtgtatagcatacgccgaaagtcacgatcaggcactggtgggagataagtctcttgccttctggcttatggacgccgaaatgtacaccaatatgtccgtccttacgcctttcactcctgtaatagatcgcggtattcagctccataagatgattaggttgatcactcatggattgggtggggaggggtatctgaattttatgggaaatgagtttggtcatcccgagtggctggacttcccaaggaagggtaacaatgaatcatatcactacgctcggaggcaatttcacctgacagacgatgacttgttgaggtacaagttccttaataatttcgatagagatatgaatcgcttggaggaaaggtacggctggctggccgcaccccaggcctacgtttctgaaaagcatgagggcaataaaatcatcgcatttgaacgcgctggactgctgtttatctttaatttccacccttccaaaagttacactgactaccgcgtggggacagccctacctggcaaattcaagattgttcttgattcagatgccgctgagtatggcggtcaccaacgcctggaccatagcaccgacttcttctcagaggcattcgagcataatgggaggccctattctctgcttgtttacatccccagcagggtcgcacttattcttcaaaacgtcgatctgccaaattag

SEQ ID NO: 4395 - DNA, 1074 bp, Artificial Sequence
  Description of Artificial Sequence: Synthetic coding sequence
atggaggagggcatgaacgtgctccacgactttggtatccagagcacccattacctgcaggtgaattaccaggattctcaggactggtttatcctggtctctgttatagccgacctgagaaacgcgttctacgtgctgtttcccatttggttccatctccaggaagcagtgggaattaagcttttgtgggttgcagtgattggagactggctgaatctggtgtttaagtggatcttattcggccagcgcccatactggtgggtgctggacacagactactacagcaacacatcagtgcccctgattaaacaattccctgtgacttgtgagaccgggcctggcagtccatcaggccacgcaatggggaccgccggagtctattacgtcatggttacaagcacattgtcaatttttcaggggaagataaaaccgacataccgcttcaggtgcctgaatgtgatcctatggctcggattctgggccgtgcagctgaacgtatgcctctcacgtatctatcttgctgctcactttcctcaccaggtagtggccggagtgctctctggtatcgctgtagccgagacctttagccatattcatagcatttacaatgcttcccttaagaagtacttccttatcactttctttctcttcagctttgctatcggattttatctgctgttgaaaggcttgggggtggatctattgtggacactcgaaaaggcccaacgatggtgcgaacagccagagtgggtgcacatagacacaacaccatttgcatccttactaaagaatctgggcacactcttcggcctaggactagccctgaatagttcgatgtaccgcgaatcatgcaaggggaaattgagcaagtggctcccatttcgcctcagctcgattgtggcaagtttagttctgctgcacgtgtttgatagcctcaagcccccttctcaggtagagctcgtattctacgtcttgtctttttgcaaatcagcagtggtgcctctggccagcgtatctgttattccatattgtcttgcccaggtcctggggcagccgcataagaagagcctctag

SEQ ID NO: 4396 - DNA, 2859 bp, Artificial Sequence
  Description of Artificial Sequence: Synthetic coding sequence
atgggcgtcagacaccctccttgctcacacaggctgctcgccgtttgtgcgctcgtgtcacttgctaccgcggcactactaggacacatcctcctgcacgactttttgctggttccgagggaactgtcaggatctagccccgtgctggaggaaacccatccagcccatcagcagggcgctagccgtccaggccctagggacgcccaggcgcatcctgggcgtcctagagctgtccctacacagtgtgacgtgccgccaaactccagatttgactgcgccccagacaaagccatcacgcaggaacagtgcgaagcccgtggctgctgctacattcctgcaaagcagggtctgcagggcgcacaaatgggacagccctggtgcttcttcccacccagctatccatcttataaactggagaatttatccagtagtgaaatggggtacactgcgactctcaccagaactacaccaaccttctttccaaaagatattctgacactgaggctggacgttatgatggagacagaaaatcgccttcacttcacgataaaggacccagctaacagacggtacgaggttcctcttgagacccctcatgtccatagtcgcgctccttcacctctgtatagcgtcgagttctccgaggagccatttggagtgatcgtgcgaaggcagctggatggtagggtgctgctgaatactacagtggctcctttattctttgcagatcagttcctgcagctctccactagtttgccaagtcagtacatcacgggcctagcggagcacttaagcccattgatgctttctacgtcatggacccgaatcactctgtggaacagagacctggcccctaccccaggagctaacctgtacggtagccaccctttctacctcgccttagaggatgggggttccgcccatggagtctttctgctgaactccaacgcaatggatgtggtgctgcaacctagccccgctctgagctggagatccaccgggggaatcctggacgtatacatttttttagggcctgaacccaaaagtgtcgtgcaacagtatctagacgtggttggctaccctttcatgcccccttactgggggttgggattccacctctgccgatggggctactctagtactgcaatcacccgtcaggtcgtagaaaatatgacgagggcccattttcccctcgatgtgcagtggaatgacctggactatatggacagcagaagagacttcacctttaacaaggacgggtttagggatttcccagctatggttcaagagcttcaccaagggggacgtagatatatgatgatcgtggaccccgcaattagcagctctggccctgccggaagctacagaccttatgatgaagggctacgcagaggcgtgttcattactaacgaaaccggacagccactgattggcaaagtgtggcccggttctactgcctttccagatttcactaaccccactgccctggcctggtgggaggacatggttgcagagttccacgatcaggtgccattcgacggaatgtggatcgatatgaatgagccatcaaattttatccgtggcagcgaagacggctgtcctaataatgagctggagaatcctccttacgtgccaggtgtggtcgggggtactctccaggctgcaacaatctgtgcctcttctcaccagttcctgtctactcactacaaccttcataatctctatggtttaaccgaggctatcgctagtcaccgcgcacttgtgaaggccaggggaacccgccctttcgtcatttccaggtctacattcgccggacacggacgatacgcagggcactggaccggggacgtctggtcgtcttgggaacagctggccagctcagtgcctgagatcctgcaatttaacctgctcggcgtgcccttagttggcgctgatgtctgcggctttctcgggaataccagcgaagagttatgtgtccgttggacccagttgggcgctttctaccctttcatgcgaaaccataattctctcctgtccctgccacaagaaccatactccttctcagagccagctcagcaggcgatgcggaaggcgctgaccctgaggtacgcattactcccgcacctgtatacactgtttcaccaggctcacgtggccggagaaacagtggcacgccctctttttctggagttccctaaggactctagcacctggaccgtcgaccaccagcttctctggggggaggcacttcttataactcccgtgctacaggccggaaaagctgaagtgaccggctacttcccactcggcacctggtatgatctgcaaaccgtacccgtcgaggctctggggagcctaccaccgcctccggctgctcccagggagccagccattcacagcgagggtcagtgggtcacactgcctgcgccattggacacaatcaacgtgcaccttagggcaggttatattatccccttgcaaggacctggcctgacaacaacagaatcgagacagcagcccatggccctcgctgtagccctgacaaaagggggagaagcacgcggtgaacttttctgggatgatggcgaaagtttggaggtgctggaacggggtgcctacacacaggttatcttcctggccaggaacaacaccatcgtcaacgaactcgttcgggttacaagtgaaggggcaggcctgcagttgcaaaaagtcactgtgcttggggtcgccacagcccctcagcaggtgttatccaatggcgtgccagtgagcaacttcacatactcccctgacactaaagtgttagacatttgcgtttccctgctaatgggtgaacagtttcttgttagttggtgctag

SEQ ID NO: 4397 - DNA, 2859 bp, Artificial Sequence
  Description of Artificial Sequence: Synthetic coding sequence
atgggggttcggcacccaccatgtagccaccgattacttgccgtttgcgcactggtatcactggccaccgccgctttactgggtcacattttacttcacgattttttactggtccccagagagctctcagggagtagtcccgtattagaggaaactcatcccgcacaccagcagggagctagtcgcccaggccctcgggacgcgcaggcacatcctggtcggcctcgtgcagttccgactcaatgtgacgtgccgccaaatagtaggtttgactgtgccccagacaaagcaatcacccaagagcagtgcgaggccagagggtgttgctatatcccagctaagcaaggattgcaaggggctcagatgggccagccctggtgcttctttcccccaagctatccaagctataagctagagaacctgagttcatccgagatgggctacacagccacacttactagaaccacccctacttttttccctaaggacatcttgacccttaggttagatgtaatgatggaaaccgaaaacaggctccattttaccatcaaagatcccgcaaaccgccgatacgaagtgcctctcgagacaccacacgtccatagcagagccccttctcctttgtattctgtagagttctcagaggaaccattcggcgtcatcgtgcgcagacagctagatggaagggtattgctaaacaccaccgtagcacccctgttcttcgcggaccagttcctccagcttagcaccagcttgccctctcagtatattaccgggctggcagagcatttatctccgctgatgctgagtacctcttggactcggatcaccctatggaatcgcgacttagcacctacccctggagccaatctgtacgggtcccatccattctatcttgccctggaggacggcggatcagctcacggcgtgtttttactcaattcaaacgcgatggatgtcgtactgcagcctagccccgcactatcatggaggtccaccggcggaatccttgatgtatatatctttcttggacccgagcccaagtctgtggtgcagcaatatctggacgtggtgggatacccctttatgcctccatactgggggcttggcttccacctttgccggtggggctacagctctaccgcaattacacgccaagtcgtagagaatatgactagggcccatttcccattggatgtccagtggaacgacctggactacatggatagccgtcgggacttcacgtttaacaaagacggcttccgggattttcctgctatggtccaggaactgcaccagggcggacgcaggtacatgatgattgtggatcccgcaattagctcatccggtccagccggaagctatcgaccatacgatgagggcctgcgacgcggagtgttcatcacaaatgagacaggccaaccgttaattgggaaggtgtggccaggctccacagcattccccgacttcacaaaccccaccgccctggcttggtgggaagacatggtcgcagagttccatgaccaggtcccctttgatggtatgtggatcgacatgaacgaacctagcaatttcatccgcggtagtgaggacggctgccctaataatgagttggaaaacccgccatatgtccccggtgtggtggggggaactctgcaggctgcaactatctgtgcctcttcccatcagtttttaagcacccattacaacctgcataacctttacgggttgacagaggctatcgcttctcacagggccctggtgaaagcacgaggaaccagaccattcgtgatttctagatccacatttgctggacacgggaggtatgccggtcattggacaggcgacgtgtggtctagttgggagcagctggcgagttctgtgcctgagatattgcagtttaacttgctcggcgtacccctagtgggcgctgatgtgtgcgggtttctcggcaacacgagcgaggagctgtgtgtccgctggactcaactgggtgccttctacccttttatgcgcaatcacaactccctcctttccctgcctcaggagccatacagtttttctgagcccgcacagcaggccatgcgaaaagccctgaccttgaggtatgcccttcttccccacctctacaccctcttccatcaagcgcacgtggcaggcgaaacagttgcaagacctctgtttctagagtttcccaaagattcatctacctggaccgtagaccaccaactgctgtggggggaggcccttcttataacgcccgtattgcaggccggtaaagccgaagtcacgggctacttccctctgggcacttggtatgatctccaaacagttcccgtggaggcccttggtagtctgccaccgcctcctgctgcgcctcgagaaccagcgattcactcagagggccagtgggttacattaccagccccactcgataccattaacgtgcacctgcgggctggatatattatccctctccaaggccctgggcttaccaccaccgagagccgccagcagccaatggcgctggcggtcgccctgaccaagggaggcgaagctagaggcgagctgttctgggatgatggcgagtctttggaagttctagaacggggtgcctacacgcaggtgatctttctcgccaggaacaacactatagtaaacgaactcgtgcgggtcacctccgagggagcaggtctccagctccaaaaagtcacagtgctgggagtagcgaccgctccccagcaggtgctttccaatggtgtccctgtctccaacttcacgtattcgccagacaccaaggtgcttgacatttgcgttagcctcctgatgggtgagcagtttttagtttcttggtgttag

SEQ ID NO: 4398 - DNA, 1611 bp, Artificial Sequence
  Description of Artificial Sequence: Synthetic coding sequence
atggaattctcgtcaccctctcgggaagaatgccccaaacctctctctcgcgtatcgatcatggctggcagtttgacaggcctactgttgctgcaagcagtgagttgggcgtctggcgcacggccttgcattcccaagagcttcggctactctagtgtggtgtgtgtgtgtaacgctacgtattgcgattcattcgaccccccaactttccccgctctggggacgttctcaaggtacgaatccacgagaagcggacgcaggatggagctgtccatgggcccaatccaggcaaaccatacaggcactggcctgctgcttacgctccagccagagcaaaagtttcagaaggtaaaagggtttggtggggctatgacagacgccgcagccctcaatatcctggccttgtccccaccggctcaaaatctgttgctcaagagctacttcagtgaggaagggattggatacaatattattagagtaccgatggcatcatgtgacttttctatcagaacctacacttacgcggacactcctgacgactttcagctccataatttctcactgcccgaggaggacacgaaactaaaaatccctctcatccaccgcgctttacagctggcccagcgtccagtgtccttgctggccagcccgtggacatctcccacttggctgaagactaacggtgcggtcaatgggaagggctctctgaagggccagccaggggatatttatcatcaaacatgggcgcgatactttgttaagttcctggatgcttatgccgagcacaaacttcagttttgggcagtgacggcggagaacgagccctcagccggactgttgagcggataccctttccagtgtctcgggtttactccagagcatcagagagatttcatcgcccgagatctgggaccgaccctggcgaactcaacccatcataacgtgcgtctgctcatgctagatgatcaaaggttactattgccacactgggcaaaggtagttttgacagaccccgaagccgctaaatacgtgcatgggattgctgtgcattggtatctggattttctcgcacctgcaaaggccacactgggagaaacacatcgtctgtttcctaatacgatgctgtttgccagtgaagcatgcgtcggctctaagttctgggagcagagcgtgaggctgggctcttgggacagaggaatgcaatattcacacagcataatcacaaacctgctgtatcacgttgtggggtggaccgattggaatttggctctcaacccagagggagggcctaattgggtgcggaactttgtcgactcccctatcattgttgatattacaaaggacacattctacaaacagccaatgttttaccatctcggccacttcagcaagttcatccccgaggggtcccaacgcgttggcctcgtcgccagtcagaagaacgatcttgatgccgttgctctcatgcaccccgatggcagtgccgtagtggtggtcttgaatagaagctctaaagacgttccacttacaatcaaggatcctgcagtgggcttcctggaaaccatcagccccggatacagcattcacacctatttgtggcgacggcagtag

SEQ ID NO: 4399 - DNA, 1611 bp, Artificial Sequence
  Description of Artificial Sequence: Synthetic coding sequence
atggaattttcctcaccttcgcgggaggagtgccccaaacctctgtctagggtatcgatcatggctggtagtctaaccggacttttgctgctgcaggcagtcagttgggccagtggagctcgtccatgtattcccaaatcctttggctacagctctgtcgtttgcgtgtgcaatgccacttactgcgacagttttgaccctcccaccttccccgctctgggtacgttctcaagatacgagagcacccgtagtgggagaaggatggagctgtccatgggtcccatccaggctaatcacacagggactgggctgctgttgacacttcaaccagaacaaaagttccagaaggtaaaaggattcggtggcgcaatgactgacgccgcagctctgaacattctggcgctttctcctcccgctcaaaatctgcttctcaaatcctatttcagcgaagagggcatagggtataatattatccgggtacctatggcctcgtgcgacttttccataaggacttacacatatgccgatacccccgacgactttcaactgcacaatttcagtttgccggaagaagataccaaacttaaaatccccctcatccacagggcacttcagctggcccaacgacctgtgtctctgttggcttcgccctggacatctcccacctggcttaagactaatggcgctgtcaacggcaaaggatcacttaagggacagccaggcgatatctatcaccagacctgggccaggtatttcgtcaaatttctcgatgcctacgctgaacacaaactgcagttctgggccgtcacagccgaaaatgagcctagcgccggtctgctatctggctatccttttcaatgtttagggtttaccccagaacaccaaagggactttatagcgagggacttaggccctactctggctaattcaactcaccataacgtgcggctgttgatgcttgacgaccaaaggcttctgttaccgcactgggctaaagtggtcctaaccgaccctgaggccgctaagtatgtgcacgggattgctgtacattggtatctcgattttctcgctccagctaaagccacattgggtgagacccaccgactctttccaaacactatgctgttcgcctctgaggcctgtgtcgggagcaagttctgggaacagagtgtgaggctcggatcctgggacagggggatgcaatacagtcatagtatcattaccaatctgctctatcatgtcgtggggtggaccgactggaaccttgcactcaacccagaaggcggtccaaattgggttaggaactttgtggatagccccatcattgtggatatcaccaaagataccttttataaacagccgatgttttatcacttgggccatttctcaaagttcataccagagggctcacaacgggtgggccttgtcgcttcacagaagaatgatctagacgccgtcgctttgatgcatcccgacggcagtgctgttgtcgtagtactcaataggagcagtaaggatgtgccattgacaatcaaggatcctgccgttggtttcctcgagaccatctcgcccggatattcaatccacacatacctttggcgacgacagtag

SEQ ID NO: 4400 - DNA, 1566 bp, Artificial Sequence
  Description of Artificial Sequence: Synthetic coding sequence
atggagttttcaagcccttcgagggaggaatgtcctaagcccctgtcccgggttagcataatggccggttcactgacaggcctcctcctgctgcaagcggtgtcttgggccagtggcgcaaggccatgtattcctaaatcttttgggtacagttctgtagtttgtgtatgcaatgcgacatactgtgatagtttcgaccctccgacatttccagcccttggaacatttagcaggtacgagtctactaggagtggccgtcgcatggagttgagcatgggacctatccaagccaaccatacaggcactggtttactactgactctgcagcccgacgccgctgccttaaacatcttggccctgagtccacccgcacagaaccttctcctcaagtcttacttcagtgaagagggaatcggctataatatcatccgcgtgcccatggcaagctgcgatttttctatcagaacttatacttatgcagatacccccgatgacttccagctacacaactttagtctgcccgaagaggatacgaagctgaaaatcccgctgatccatcgggctctgcagctggcccaacgccctgtttccctcctggcatctccgtggacatcccctacatggttgaaaacgaatggagccgtgaatggaaagggctcacttaaaggccagcccggtgacatatatcatcagacctgggctcgttattttgtcaagttcctggacgcgtacgccgagcacaaattacagttttgggctgttacagctgagaacgagccgtccgcagggctgctaagcggttatccatttcagtgcttaggcttcacccccgagcaccaaagagattttatcgctagagatttgggccctacactagcaaactcaacgcaccacaacgttcgtttgttaatgttagacgaccaaaggctgctgctgccgcactgggctaaagttgtgctgactgatcccgaagccgctaagtatgtacacggaattgccgtccactggtacctggactttctagccccagctaaggctacactcggcgaaactcaccgtctgtttcctaatacaatgctctttgcctccgaggcctgtgtagggtctaagttttgggaacagtcagtgagattggggtcttgggaccgaggcatgcaatatagccattccatcatcaccaacctgctgtatcacgtggtggggtggacggactggaatctggcacttaaccccgaaggaggaccaaattgggtgaggaactttgtcgattcgccaatcatcgtcgacatcacaaaggatactttttacaagcagccaatgttctatcatctggggcatttctccaaatttattcctgaagggtctcagcgcgttgggctggtggcttcccagaaaaatgatctggacgctgttgccttgatgcaccctgacggcagcgcggttgtcgtggtgctgaatcggagcagtaaggatgtgccactgacaattaaggaccctgctgtgggattccttgagaccatatcccctggttatagcatccacacatacctatggagacggcagtag

SEQ ID NO: 4401 - DNA, 1464 bp, Artificial Sequence
  Description of Artificial Sequence: Synthetic coding sequence
atggagttctcaagtcctagtcgggaggaatgcccaaagccactttccagagtgtccatcatggccggttcactcactggacttctcctattacaggcggtctcatgggcttccggcgctcgcccatgtatcccaaagtcctttggatatagctctgtggtttgtgtctgcaacgccacgtactgcgatagtttcgatccaccgacattcccagctctgggaaccttctccaggtacgagagtacaagaagcggcaggcgtatggagttgtctatgggaccaattcaggcaaaccacaccgggacaggcataggatataatatcatccgggtaccaatggcatcatgcgacttttcgatcaggacctatacttatgctgacacccctgacgactttcagctgcacaactttagcctgcctgaggaggataccaagctcaagattccactgattcacagagcccttcagctcgcacagcgtcccgtgtctctcctggccagcccctggacttccccgacttggctaaagaccaacggggctgtcaacgggaaaggctccctaaagggacaacccggagacatctaccatcagacctgggcccgttatttcgtcaagttcctagatgcatacgcggagcacaagttgcagttctgggccgtgaccgcagagaatgaacccagcgctgggctgctaagcgggtatcctttccaatgcctcggttttacaccggaacatcagcgagacttcattgccagggacttaggcccaaccctggctaactctacccatcacaacgttagacttctgatgcttgatgaccaaagactgttgctgccccactgggcaaaggtggtgcttaccgatccagaagctgccaagtacgtgcatggcatcgccgttcattggtacctggactttttggccccagctaaagctaccctgggagagacacaccgcctgttccctaacacaatgttgttcgccagcgaagcgtgcgtgggaagcaagttctgggagcaaagcgttcgacttggtagctgggacaggggcatgcagtatagccacagtattataaccaacctcttgtatcatgttgtggggtggacagactggaacttggctctgaatccggagggaggccctaattgggttcggaacttcgtcgatagcccaattattgtcgatattactaaagataccttttacaaacagcctatgttctatcacttagggcatttcagtaaatttattccagaaggttctcaaagggttgggttggtggctagtcagaagaacgatctggacgctgttgcactgatgcatccagacggatccgctgttgtcgtggttctgaatcgttcttctaaagacgtgcctctgactatcaaggatcccgctgttggtttcctggagaccatctcccccggatactccatccacacttacttgtggcgacgacagtag

SEQ ID NO: 4402 - DNA, 1350 bp, Artificial Sequence
  Description of Artificial Sequence: Synthetic coding sequence
atggagctaagcatgggacctattcaggccaatcacacaggcactggtttgctcctgaccctgcagcctgaacagaagtttcaaaaggtcaaagggtttggtggggcaatgaccgacgctgctgcattgaacatactggctctttccccacccgctcagaatctgcttttaaaaagttacttctctgaagagggaatagggtataacatcatccgggtgccaatggcatcttgtgatttcagcataaggacatatacctatgccgatactcccgacgacttccagctgcacaatttctcccttcccgaagaagatacaaagctgaaaattccattgatccaccgcgctctgcaactcgctcagcggccagtgtctttactggcatccccctggacttctccaacctggctaaaaacaaacggcgctgtgaacggcaaaggctctctaaagggacagcctggagacatctatcaccagacatgggcccgttacttcgttaagttcctggatgcttatgcagagcacaagctgcagttttgggccgtgaccgcagagaacgaaccatccgcaggactgctgtcagggtacccttttcagtgcctggggttcaccccagaacaccagcgcgacttcatagccagagacctgggaccaaccctggccaattctacccaccataatgtgcggcttctgatgctggatgaccagagattgctcctgccccactgggccaaggtggtgctgacagatcctgaagccgctaagtatgtgcatggaatcgctgttcactggtacctggattttcttgccccagccaaagcgaccctgggtgagactcatcgcctattcccgaacaccatgctgtttgcttccgaggcatgtgtgggtagtaagttctgggaacagtccgtgagactcgggtcttgggaccgtggtatgcaatattctcatagcatcatcacaaacttactctaccacgtcgttggatggactgattggaatctggctctgaatcctgagggtggacccaactgggttagaaacttcgttgatagtcctattatagtggacattacaaaggacactttttacaagcaaccaatgttttatcacctggggcacttctctaaattcatccctgaggggagtcaaagagttggactggttgcctcccagaaaaatgacttggatgccgtggctctgatgcaccccgacggaagcgcagtggtggtcgtactgaaccggagcagtaaggacgtccccttaaccatcaaggaccctgccgtcggctttttagaaacaattagccctggatactctatccatacatatttatggagacgccagtag

SEQ ID NO: 4403 - DNA, 1482 bp, Artificial Sequence
  Description of Artificial Sequence: Synthetic coding sequence
atgaccttgcgaggatggtcatttcaggtcttgcccgagtctaacgccacatattgtgatagtttcgatccaccgaccttccctgctcttggaacattcagccgctatgagtctactcgcagcggcagacgcatggagttgtctatgggcccaatccaggccaatcacacaggaaccggcctgctgctcacactgcaaccagagcagaagtttcagaaggtgaaggggttcgggggagccatgactgacgccgctgcattgaatatactggctctgagcccacccgctcaaaatctgctgttaaagtcgtacttctcggaggaaggcatcggatacaatatcattcgggtacccatggcatcctgcgacttctctatccgaacctacacctacgccgacaccccagatgacttccagttgcacaatttctcgctccccgaggaagacaccaagttgaagatcccactgatccaccgcgcactgcagctcgcacagcggccagtcagcctgctcgcctctccatggaccagtccaacttggttgaaaaccaatggcgctgtgaatgggaagggcagtctgaagggacagcccggagacatctatcaccaaacatgggcaaggtacttcgttaaatttctggatgcatatgcggagcacaagctgcagttctgggccgtgacagcagagaatgaaccatctgctggactgcttagtggatatcccttccagtgcctgggcttcacccccgagcaccagcgagacttcatagcgagagatctgggaccaacactggctaactccactcatcataatgtcagactgctcatgctggacgaccagaggctgctgctgcctcattgggcgaaagtcgtgctcaccgatcccgaagcagccaagtacgtgcatgggatcgcagtccactggtacctagactttcttgcccctgctaaagctaccctgggggaaacacatcgtctgtttcctaataccatgctgttcgccagcgaggcctgcgtggggagcaaattttgggagcagtccgtaagattaggttcttgggatcgtggaatgcagtactctcacagcattattacaaatttactgtatcacgttgtcggatggacagattggaatctggcgctgaaccctgaaggaggccctaactgggtgcggaacttcgtggactccccaattatcgtagatattacaaaggacaccttctataagcagcctatgttttatcacctgggccacttcagtaaattcattcccgaaggctctcagagggtaggcctcgtagcaagtcagaagaatgacctcgacgccgtcgcgctgatgcatcctgacggctccgccgtcgttgttgtcctgaaccgctcttctaaagacgtgccgctgaccatcaaagaccccgctgtaggattcctggaaaccatttcacccggatacagtattcatacatacttatggcggagacagtag

SEQ ID NO: 4404 - DNA, 1272 bp, Artificial Sequence
  Description of Artificial Sequence: Synthetic coding sequence
atggagttcagcagtccgagcagagaggagtgtcctaaacctctctctagggtcagtatcatggccggatcattaaccggcttgctacttctgcaagctgtcagttgggcctcaggtatcggctacaacatcatcagagtgccaatggcctcatgcgacttctcaatcaggacttacacctacgccgacacacctgatgattttcagcttcacaacttttctctgcctgaagaagacactaagttgaaaatcccactgattcaccgcgctcttcagctcgctcagagaccggtgtccctgcttgcaagcccatggacttcccctacatggctaaagaccaacggtgctgtgaacggtaagggtagtctaaaaggacagcccggagacatctatcatcagacatgggctaggtatttcgttaaatttctggatgcttacgcagaacataagttacagttctgggcggtcactgcggagaacgaacctagcgctgggctgctgtctggatacccatttcaatgcctcgggtttacgccagaacaccaacgggacttcatcgccagagacctgggacccactctggcaaatagcacccaccataacgtaagactgttgatgctggatgaccagcgtcttcttttgcctcactgggccaaagtggttcttacagatcctgaggcagccaagtatgttcatgggatagccgttcactggtatctcgatttcctggctcctgcaaaagcaacgcttggagagacccaccggttgtttcccaacacgatgctgtttgcaagcgaggcctgcgtcggttctaagttctgggagcagtccgtgagattgggctcgtgggacaggggaatgcagtatagccactcaatcatcacgaatctgctctatcacgtagtgggctggactgactggaacctagccctcaatcccgaaggaggacccaactgggtccggaattttgtggacagtcctatcatcgtggatatcactaaggatacattctataagcaaccaatgttctatcaccttggccacttttctaagtttataccagaaggctcacagagagtcgggcttgtcgcatctcaaaaaaatgatcttgacgctgtcgctctgatgcaccccgacggctccgccgtggttgtcgtgttaaatcggagttccaaggatgttcccctcacaatcaaggacccggctgtcgggttcttggagacgataagcccgggatactcgatccatacctacctgtggcgacggcagtag

SEQ ID NO: 4405 - DNA, 2112 bp, Artificial Sequence
  Description of Artificial Sequence: Synthetic coding sequence
atgctacgtgggcgttccctcagcgttactagtttgggcggactgccccagtgggaagtcgaagagctgcctgtggaggagttgttattgtttgaggtggcttgggaagtaacgaacaaggtgggcggtatttacactgtgattcagactaaggcaaagacaactgcggatgagtggggcgaaaattactttcttatcggcccatactttgaacacaatatgaagacccaggtggagcagtgtgagccagtgaatgatgccgtccggcgtgcggttgatgcgatgaacaagcacgggtgtcaggttcacttcggtagatggctcatcgaaggtagcccttacgttgtcctttttgacataggatacagtgcctggaacctcgatcgctggaagggagacttatgggaggcttgtagcgtaggaatcccttatcacgatagggaggctaatgacatgctaattttcggcagtctgacagcctggttcctgaaggaggtcacagatcacgccgatggcaagtatgtggtggcccagtttcacgaatggcaggccggaattggccttatcctttcccgcgcacgtaaactccctatagccaccattttcaccacacatgccacccttctgggtcgttatctctgcgcagctaatatcgatttttacaatcacctggataagtttaacatcgataaggaggcaggcgagaggcagatataccatcggtattgcatggaacgcgcaagtgtgcactgtgctcacgtgttcacaaccgtgtctgaaattacagcgatcgaggcagaacacatgcttaagaggaaacctgatgtggtcacacctaatgggctaaacgttaaaaaattctccgcagtccacgaattccaaaatctccatgcgatgtacaaagcgaggatacaggacttcgtccggggacatttctatggccacctcgatttcgatctggaaaagaccttgttcctctttatcgcaggccgatacgagttctcaaataaaggcgcagacatattcctagaatctttgtccaggctgaattttctgcttcggatgcataaatccgatatcaccgttatggttttcttcattatgccagctaaaacgaacaacttcaatgtggagacacttaagggccaggcggtccggaagcagctgtgggatgtggctcattctgtcaaggagaagtttgggaaaaagttgtacgacgctctcctgcgcggagagatccctgacctgaatgacattctggaccgagatgatctcacaatcatgaaaagggctattttctcaacccagaggcagtctctgccacccgtcaccacccacaacatgatcgacgattctaccgatcccatcttgagcacaattcggaggatcgggctgttcaacaaccgaacagatagggtgaaagtaattttgcatccagaatttctgtcctctacctcgcctctgctacccatggattatgaagagttcgtgcgaggatgccacctcggggtcttccctagttactacgagccctggggctacacgccggcagagtgtacagtcatgggcatccccagtgtaaccactaacctgtctggcttcggctgttttatgcaagaacacgttgcagaccccacagcttatgggatctatattgtcgatcgtcggttcagatctccagatgactcatgtaaccaactcacaaaatttctgtacggtttctgtaagcagagcaggaggcagcgcattatccagcgcaatcggacagagaggctctcggacctgctggactggcggtatctaggcagatattaccaacatgctagacatttgaccttaagccgcgcttttcctgataagtttcatgtcgagctcacgagtccccctaccaccgaggggtttaaatatccacggccaagttctgtgccaccatctccaagtggctcccaggccagtagtccccaaagcagcgatgtggaggatgaagtcgaggacgaaagatatgacgaagaagaagaggccgagagagatcggctcaatattaaaagtccattttcactatcccatgtgccccatgggaaaaaaaaactgcatggagaatacaaaaactag

SEQ ID NO: 4406 - DNA, 351 bp, Artificial Sequence
  Description of Artificial Sequence: Synthetic coding sequence
atggactattacagaaaatacgctgccatcttcctcgtcactttgtccgtttttctgcatgtcctgcacagcgccccagacgttcaggactgccctgagtgtactttgcaggagaaccccttcttctctcaacccggagcacctatcctgcagtgtatgggctgttgtttttcaagggcatacccaacccctctccggtcaaagaagaccatgctggtgcagaagaatgtcacttctgaaagcacctgttgtgtggcgaagagctacaatagagtgaccgttatgggaggtttcaaagtggaaaatcacacagcctgccactgctctacatgttactaccacaaatcttag

SEQ ID NO: 4407 - DNA, 654 bp, Artificial Sequence
  Description of Artificial Sequence: Synthetic coding sequence
atggctactgggtcacggaccagcctcttactcgcctttggactgttgtgcctgccctggttgcaggaaggcagtgcattccccacaattccactcagccggctgttcgataatgcgatgcttcgggcacacagactccaccagctggcctttgatacttaccaggaattcgaggaggcctacatccccaaagaacagaaatatagcttcctccaaaaccctcagacttccctgtgcttctcggaatctattcccaccccaagtaaccgcgaggagacgcaacagaagagcaacctggagctgttgcggattagcctgctcttgatacagtcctggttagagcccgtgcaattccttagaagcgttttcgcgaattcactggtgtacggcgctagcgactctaacgtgtatgatctgctgaaagacttggaagaaggcattcaaaccctgatgggcaggctggaggacggttccccccgaacaggtcaaatttttaagcagacctacagcaagtttgatactaactcccataacgatgacgctctgctgaaaaactatggtttgctttactgtttcagaaaggacatggacaaggtggagacatttctgcggatagtgcaatgccgctctgtggaggggtcttgtggtttctag

SEQ ID NO: 4408 - DNA, 369 bp, Artificial Sequence
  Description of Artificial Sequence: Synthetic coding sequence
atggctactggttcccgcaccagcctgctgctggcattcgggctgctgtgtctcccctggttgcaagagggttccgcatttccaacaattcctctgagccggctctttgataacgctatgttgcgggctcaccgactccatcagctggccttcgacacctatcaggaatttaggttagaagacggatcccccaggaccggacaaatctttaagcagacctactctaaatttgacactaactcccacaatgatgatgcactcctgaaaaattacggactgctttattgtttcagaaaggacatggacaaggtcgagacgttcctcagaattgtccagtgtcggtcggtcgaggggtcttgtggattctag

SEQ ID NO: 4409 - DNA, 534 bp, Artificial Sequence
  Description of Artificial Sequence: Synthetic coding sequence
atggccactggctcaaggaccagcttactgcttgctttcgggttgctgtgcctgccatggctgcaggaagggagcgctttccccactattcctctgtctaggctgtttgacaatgctatgctgcgcgcacacaggctgcaccagctggccttcgatacataccaggagttcaatctggagctgctaaggatctccctcctcttaattcagtcatggctggaaccggtgcaatttttgaggtctgtcttcgccaatagtctcgtctatggcgctagcgactccaacgtgtacgacctgctcaaagatctggaagaaggcattcagactctgatgggtcggctcgaagatggctctccacgaacaggtcagatcttcaagcagacatactcaaagtttgacacaaactctcacaatgatgacgctctgctgaagaattatggcttactgtactgctttcgcaaagatatggacaaagttgagaccttcctgcgcatcgtccagtgccgcagcgtagaagggagttgtggcttctag

SEQ ID NO: 4410 - DNA, 609 bp, Artificial Sequence
  Description of Artificial Sequence: Synthetic coding sequence
atggccaccgggtcacgaactagtctgcttctcgcatttggtctgttgtgtctcccatggttacaggaaggaagtgccttccccaccatacctctgtcaaggctctttgacaatgccatgctgagagctcacaggctgcaccagctggcctttgacacctaccaggagttcaacccacagacgtcgctatgctttagtgagtccattcctactcctagcaaccgagaggagactcagcagaagagcaacctggaattgctgcggatttcgctgttactgattcaatcctggctcgagccagtgcaattcctgagatctgtttttgctaacagcttggtttacggagccagtgactctaacgtttacgatctcctaaaggacctggaagaagggatccagacccttatggggagactagaagacggctcaccaaggaccggccaaatctttaagcagacctattctaagtttgatactaacagtcacaacgacgacgcgctgcttaagaattatggcttgctctactgttttcgcaaagatatggacaaggtcgagacttttttacgtatcgtgcagtgtcgatcagttgaggggtcctgtgggttttag

SEQ ID NO: 4411 - DNA, 771 bp, Artificial Sequence
  Description of Artificial Sequence: Synthetic coding sequence
atggccgctggcagccgaacctccctactcctcgcctttggccttctctgcctttcatggctgcaagaaggttctgcattccccaccatcccgctgagtcgactttttgataatgccatgctaagggccagacggctctaccagctcgcttatgacacctatcaagagttcgaagaggcctatatcctgaaagagcagaagtatagctttctgcagaatccgcagaccagcctttgcttcagcgagtctattccaaccccatccaatagagtaaagactcagcagaagtccaacctagagctgctgaggatcagtctactgctgatccagtcttggctcgagcccgttcaattgctcaggtccgtgttcgctaattctctggtgtacggagcttccgactccaacgtgtatcgacacctgaaggatctggaagagggcattcagaccctgatgtgggtaagagtcgccccagggatccctaacccgggtgccccactggcaagcagagactggggagagaagcactgttgcccactgttcagttcgcaggcacttacacaggagaattccccatatagttcttttcctttggtgaaccctcctggtctcagcctgcagcctggtggagaggggggaaaatggatgaatgagcgagggcgagagcagtgccctagcgcctggccattgctgctgtttttacacttcgcggaggcaggccgatggcagccaccagattgggcagatctacaaagcgtgttgcaacaggtatag

SEQ ID NO: 4412 - DNA, 654 bp, Artificial Sequence
  Description of Artificial Sequence: Synthetic coding sequence
atggctgccggatccagaacttctttgttactcgcgttcggactgctgtgcctgtcctggttacaggaaggctctgcattccccacaattccattatcccgtctgtttgataatgcaatgctgcgggcaagacgcctgtaccagctggcctacgatacctaccaggagttcgaagaggcttacatcctgaaagaacagaagtatagctttttacagaatccacagacttccctgtgtttctccgagagcatcccaactccgtccaatcgagtgaaaacgcagcaaaaatctaatttggaactccttcgtatctcgctcctattaatacagagctggctcgaacccgtgcagctgttacggtcagtttttgcgaatagccttgtctacggcgcttctgacagcaatgtttaccgacatctcaaggatctggaggagggtattcagactttaatgtggcgactggaagacggcagtccccgtacgggtcagatcttcaatcagagttattcaaaatttgataccaaatcgcataacgacgacgctctcctgaaaaattatggtctattgtactgcttccgcaaagacatggataaggtggagactttccttcggattgttcagtgcagatctgttgagggctcttgtgggttttag

SEQ ID NO: 4413 - DNA, 609 bp, Artificial Sequence
  Description of Artificial Sequence: Synthetic coding sequence
atggctgccggatctcggacctctctgttgcttgctttcggcttgttatgcctatcttggctgcaagaaggcagcgccttcccaaccatccccttgagcaggttattcgataatgctatgctgcgggctagaaggctgtatcaactcgcctatgatacctatcaagagtttaatccccagacctccctgtgtttctctgagagtatccctacaccaagcaatcgcgttaagactcagcaaaaatcgaacttggagcttcttaggatctcgttactgctgatacagagctggctcgagcctgtgcaactgcttaggtcagtctttgctaattccctggtgtatggcgcatccgatagtaatgtgtataggcatcttaaggaccttgaagaaggtatccaaactctgatgtggaggttagaagacggctcaccgcgaactggtcagatttttaatcagagctactcaaaattcgatacgaaatctcacaacgacgacgccctgcttaagaactacggccttctgtactgtttccgaaaagatatggataaagtcgagacgtttctaaggatcgtgcagtgccgatctgtggaaggatcatgcgggttctag

SEQ ID NO: 4414 - DNA, 738 bp, Artificial Sequence
  Description of Artificial Sequence: Synthetic coding sequence
atggctgcgggttctagaacgtctctgctgctggctttcggcctcctgtgcctttcttggcttcaggaagggtccgcattccccacaattcccctcagccgcctgttcgacaatgcgatgttgagagcccgacgtctatatcagctggcgtacgatacataccaagaatttgaggaggcctacatcctgaaagagcagaagtattcatttctgcagaatccccagactagcctgtgtttcagtgaaagtatcccaactccttccaatcgggtgaagacccagcagaagtccaacctagagctgctcagaatcagcctcctgctgatccagagctggctagagcctgtgcagcttctgaggtccgtcttcgcaaatagcctggtttatggcgcttctgactccaacgtgtatagacatcttaaagacctggaggaaggcatacagactttgattggctggaagatggcggctcctggtttaggaagaagtagtatctcacccacggcttctctgactcaaaaccgcacgacaatgacccactgctcccgcacgaccggttgctccacggccagcggacgtacctggactcgaagtcgccactcgtgcgccagttgttcagctgcactttggcgcgctgctgtggcctctagctgcccaggtggtatcccagttacccctccccaatgcttatcctggtcttggaaggtgctcttgcaatgccctcccgctctttcatag

SEQ ID NO: 4415 - DNA, 753 bp, Artificial Sequence
  Description of Artificial Sequence: Synthetic coding sequence
atggagaaaggtccagtgagagccccagcagagaaaccacggggagccagatgctcaaatggcttcccagagcgggacccccctagaccaggaccatctcgcccagccgagaagcccccacggcctgaggctaagagtgcccagcctgcagatggttggaaaggagagcggccaagatctgaggaagataatgagctgaacctgccgaatctcgccgctgcctactctagtatactgtcttcactcggagagaatccccagcgccaaggtctgctcaagacaccatggagggcagcctctgctatgcaattttttacgaagggataccaggagacgatcagtgatgtgctgaacgacgccatctttgacgaggaccacgatgaaatggtaattgtgaaagatatcgatatgttttcaatgtgcgaacaccatctggtgcctttcgtcggcaaagtgcacattggctatctgcccaacaaacaggtgctggggctatcaaaattggccagaatcgttgagatctactctcgcaggctgcaggtccaggaacgcctgacaaagcagatagccgtcgccatcacggaggccctcagacccgcaggagtgggggttgttgttgaggcaacccacatgtgcatggtcatgagaggggtgcagaagatgaactccaaaaccgtgacctccaccatgctgggcgtttttcgagaggacccaaaaacacgcgaggaatttctaacacttatccgtagttag

SEQ ID NO: 4416 - DNA, 693 bp, Artificial Sequence
  Description of Artificial Sequence: Synthetic coding sequence
atggaaaagggccctgtgcgggctccagccgagaaacctaggggggctagatgtagcaacggttttcctgaaagggacccccctcgtccagggcctagccgcccagcagagaaaccacctcgacctgaggccaaaagtgcacaacctgctgatggttggaagggcgaacgccctcgcagcgaggaagacaacgagctgaatttgccaaatttggctgccgcatactccagtatcttgagcagcctcggcgaaaacccacagaggcaagggctcctgaaaaccccctggcgggctgcctccgccatgcagttcttcacaaaggggtaccaggagaccatcagtgacgtgctaaatgacgcgattttcgacgaggaccacgacgagatggtgatcgttaaggatatagacatgttctccatgtgcgagcatcatctcgtcccattcgtgggtaaagttcacatcggatacctgcctaacaaacaagttctgggcctttccaagctggcacgcatcgtcgagatttactctagaagactgcaggtgcaggaacggctcacaaaacaaatagccgttgcaatcaccgaggctctgcggccagctggggtgggggtggttgtggaggcaacaaagtctaacaagtacaataaagggctatcctacttcttactcgccacctttctgtggcagtattag

SEQ ID NO: 4417 - DNA, 753 bp, Artificial Sequence
  Description of Artificial Sequence: Synthetic coding sequence
atggagaaaggacctgttcgcgcaccggcagagaaaccaaggggcgctaggtgcagcaatgggttcccagaacgcgacccgccaagaccagggccttcccgtccagccgagaaacccccacgcccagaagcaaagagcgcacagcctgccgatggctggaaaggcgagcgaccccgtagtgaggaggataatgagctaaatctcccaaatttggctgctgcctattcgtcaatactcagcagcctcggcgaaaatcctcagcggcagggtctcctgaaaacaccttggcgcgctgcaagtgcaatgcagttttttaccaaaggatatcaagagactatctccgacgtgctgaacgacgctatctttgatgaggatcatgacgagatggtgatcgttaaagatatcgatatgttctccatgtgcgaacaccacttggttccgttcgtgggtaaggtgcacattggctacctccccaacaaacaagtcctgggtctgtccaaactggccagaattgtagaaatctacagccgacgcctccaggtacaagagcggcttacgaagcagattgccgtggccataacagaagccctgcgccctgctggcgtgggtgtggtcgtcgaggcaactcacatgtgcatggtaatgcggggagttcagaagatgaactccaaaactgtgacttccacgatgctgggagtcttccgcgaggacccgaagactagggaagagttcctcaccttgattcggtcctag

SEQ ID NO: 4418 - DNA, 642 bp, Artificial Sequence
  Description of Artificial Sequence: Synthetic coding sequence
atggaaaaaggccctgtgcgcgctcctgccgaaaaaccgagaggagcgagatgttccaatggcttcccggagagagacccaccaagaccaggtccctccagaccagccgagaaacctccccgaccggaggcaaagagcgcccagccagccgatggctggaaaggagaacgacccagatccgaggaggataatgagctgaatttgccgaatctggctgcagcctacagttccatcctcagtagcctaggcgagaatccgcagaggcagggcctgctgaagactccttggcgagcagcttcggccatgcagttctttaccaaggggtatcaggagaccatatccgatgtcttaaatgatgccattttcgatgaggaccacgatgagatggtcatcgtaaaggacatcgacatgttctcaatgtgcgagcaccacctggtccctttcgtggggaaggtgcacattggctacctgccaaataagcaggtgctgggattgtccaagctggccaggattgttgagatttattcccgccgtctgcaggtacaggaacggctcacaaagcagatcgctgtggcaattaccgaggcactgcgtcctgccggagtcggggtggtggtggaagcaacatctgccgaaccctag

SEQ ID NO: 4419 - DNA, 702 bp, Artificial Sequence
  Description of Artificial Sequence: Synthetic coding sequence
atggagaaaggcccagtgagagcccctgctgagaaaccaaggggcgctcgctgcagcaatggcttccccgagagggaccctcctcgaccaggcccttcccggcctgccgaaaaacccccaagaccggaggccaaaagtgcccaacccgcagatggttggaagggcgagcggcctcgatcagaggaggacaatgagctcaacttaccaaatttggccgctgcctactcaagtatcttgagttccttgggcgaaaatccccaacgccaaggcttactcaaaaccccatggagggctgcttcagctatgcagtttttcaccaaaggttaccaggaaactataagtgacgtcctgaatgatgccattttcgatgaagaccacgatgagatggtaatcgtgaaggatattgacatgttctctatgtgcgaacaccacctggttcccttcgtggggaaggtccacatcggctatctgccaaacaagcaggttctcgggttgtcaaagcttgccagaatcgtggagatctactcgagaagactacaggtccaggagaggcttacaaaacagatagccgtggccataactgaggccctccggccagctggagttggcgttgttgtggaagcgaccaaatcaaacaagtataacaagggcctatcccccctgttatccagctgccacttatttgtggctatcctgaagtag

SEQ ID NO: 4420 - DNA, 1014 bp, Artificial Sequence
  Description of Artificial Sequence: Synthetic coding sequence
atgggcccaagggccaggccagctctccttctgctgatgcttctgcagactgccgtcctccagggccgtctcttaagatcacattcacttcattacctgttcatgggcgcatctgaacaagatttagggctgtcgctgttcgaggccctgggctacgtggatgatcagctctttgttttctatgatcatgaaagccgaagagtcgaaccgcgaacaccttgggtctcaagtcgaatttcatctcaaatgtggctacagttatcacagtctctgaagggttgggaccatatgttcactgtggacttttggaccataatggagaatcataatcatagtaaagagagccacacacttcaggtaatcctgggatgcgaaatgcaagaagacaattcaacagaggggtactggaaatacgggtacgacgggcaggatcacttagagttttgtccggacactctggactggagagccgctgaaccacgggcttggccaaccaaactggagtgggagaggcacaaaatccgcgctagacaaaatagggcatacttggagcgggactgccccgcacagctccagcaactgctggagctcggcaggggcgtgttggaccagcaggtccctcccctcgtcaaggtgactcaccacgtgacctcatcagtcaccaccctcaggtgtcgcgcacttaactattatccacagaatatcactatgaaatggctcaaggacaagcaaccaatggatgctaaggagttcgaaccaaaggatgtactcccaaacggggatggaacctaccagggatggataactcttgctgtgccccctggcgaggagcagcgttatacctgccaggtcgaacatcccggtctcgatcaacccttgattgtgatttgggaacccagtccatccggcaccttggtcatcggagtcatctcgggaatcgctgtgttcgttgtcatcctcttcatcggcattctttttatcatcctgcgcaagcgccaggggtcctctttctag

SEQ ID NO: 4421 - DNA, 771 bp, Artificial Sequence
  Description of Artificial Sequence: Synthetic coding sequence
atgggccctcgtgcacgacccgcactgttgctcttgatgctgctccagacagctgttttgcagggcagactgcttcgctcacactccttgcattatttgtttatgggggcaagcgaacaggacctgggccttagtctgtttgaggcactgggttacgtggatgaccaattgtttgtgttttacgaccacgagagtagaagagttgagccgaggacaccctgggtgagttcccgcatctcctctcaaatgtggctgcagctgtcacagtccttgaagggatgggatcacatgttcactgtcgacttctggaccatcatggaaaaccacaaccactctaaggtccccccactagttaaggtcacccaccatgtgacatcgagtgttacgacactccgatgcagagcgctaaattactacccacagaacataaccatgaaatggctcaaggacaaacagcccatggacgccaaggaattcgagcccaaagacgtgctgcctaatggcgatgggacgtaccagggctggatcactctggccgtcccccctggcgaagagcagaggtatacttgtcaggtggagcatccaggtctcgatcagccacttatagtcatctgggagccctcacctagtggtaccctggtaattggagttatctctggtattgcagtcttcgtggtcattctgttcatcggaatccttttcattattctgaggaaacggcagggatctcgcggagcaatgggccactacgtcctggcagaacgcgagtag

SEQ ID NO: 4422 - DNA, 729 bp, Artificial Sequence
  Description of Artificial Sequence: Synthetic coding sequence
atgggaccccgtgcgaggccggctctgctcctgctaatgctgttacagacagcagttttgcagggtcgacttttgcgaagccactcattacattacctgtttatgggcgcttccgaacaggacctggggttgagtctgtttgaggccctggggtatgtggatgaccaactgttcgtcttctacgaccatgaaagtcggcgagtggagcccagaacgccatgggtgagttcaagaatcagctctcagatgtggttgcagctgagccagtcactgaagggctgggatcacatgtttacagtggacttttggaccatcatggagaaccacaatcatagcaaggttacgactctgaggtgccgcgcactcaactattatccccaaaatatcactatgaaatggctgaaagataagcagccaatggacgccaaagaattcgaacctaaggatgtactccccaacggggacggcacctaccagggttggataacactggctgtgcctccaggcgaggagcagcggtatacatgtcaggttgaacacccaggcctggatcaaccactgattgtgatctgggaaccctccccctcgggaactcttgtgatcggtgtgatctccgggattgctgtttttgtcgtgatcctttttatcggaatactctttattatcttgaggaaaaggcaggggtcacggggtgcgatggggcattatgtgctggccgaaagggagtag

SEQ ID NO: 4423 - DNA, 783 bp, Artificial Sequence
  Description of Artificial Sequence: Synthetic coding sequence
atgggcccaagagcacgtccagccttgctcctccttatgctgctgcagaccgcagtgctgcagggtcgcctgctgcagtctcataccctgcaggttattctcgggtgtgagatgcaggaggacaatagcaccgagggatactggaagtatggatacgacgggcaggatcacctagagttctgcccagatacccttgactggcgtgccgctgagcctcgagcctggcctactaaattggagtgggagcgccataaaatcagagcccgacagaatagagcttatctagagcgcgattgtcccgcacagctgcagcagctgctcgagctgggcagaggcgtgttggaccagcaggtgcctcctcttgttaaggtcactcatcatgttacctccagcgtgacgaccctgcgttgcagagccctgaattattacccccagaacattactatgaagtggttaaaagataagcaacctatggatgctaaggaattcgagcccaaggatgtcctgccaaacggcgacggcacttaccagggttggataactttggctgtgcccccaggtgaagaacagcgctatacctgtcaggttgaacatccaggattagaccagcccctaattgtgatatgggagccatcaccgtcaggcactctggtgatcggtgtgatctccggcattgccgtttttgtcgtgatcctttttatcggcatcctgttcataatcctaagaaagcggcagggtagccgaggagcgatgggccactatgttctggcagaacgagaatag

SEQ ID NO: 4424 - DNA, 231 bp, Artificial Sequence
  Description of Artificial Sequence: Synthetic coding sequence
atgggcccacgtgccaggcctgcattactcctgctaatgttgctccaaactgcagtgctgcaaggaaggcttcttcaaccatcaccaagcggaacactggtcattggagtaatctctggaattgcggtcttcgttgtgatcctcttcatcgggatcctgtttattatcttacgcaaacgtcagggaagtaggggggcaatgggtcactacgtcttggcggaacgggagtag

SEQ ID NO: 4425 - DNA, 507 bp, Artificial Sequence
  Description of Artificial Sequence: Synthetic coding sequence
atggggccacgagctaggcctgcgcttctgctgttaatgctgctgcaaaccgccgtgttacaaggcaggttgttgcttcctccactcgtaaaagtgacgcaccacgtgacctcaagtgtgacgacgttgcgctgccgggctctcaactattacccccaaaacatcaccatgaagtggcttaaggataagcagcctatggacgcgaaggagtttgagcctaaagacgtgctccctaacggggatggaacctaccaggggtggatcacgttggccgtgccgcctggtgaggaacagcgctacacttgtcaggtagagcatccaggactggaccagcccctcatcgttatttgggagccttcacccagcggcaccctcgtgatcggggtcatttctgggattgccgtgttcgtggtgatcctcttcatcggcattctattcattattctgaggaagagacagggaagtagaggggctatgggccattatgtgttggccgagcgcgaatag

SEQ ID NO: 4426 - DNA, 1047 bp, Artificial Sequence
  Description of Artificial Sequence: Synthetic coding sequence
atgggcccacgcgcaagacccgctctcctcctgctcatgctgctgcagaccgctgtcctacaaggaagactgctcagatcgcacagtcttcattacctgttcatgggtgctagcgaacaagatctggggctcagtctgttcgaggcgctgggctacgttgacgatcagctcttcgttttttacgatcacgagagtcgcagggtggaaccgaggaccccatgggttagttctcggatttctagccagatgtggttgcagctctcccagagccttaaggggtgggaccatatgtttactgttgatttctggaccatcatggagaaccacaaccacagtaaggagtcccacactctgcaggtcatcctggggtgtgaaatgcaagaggataattcaactgaaggatactggaaatatgggtacgacggccaagatcatctcgaattctgtcctgacacgctagattggagggctgcagagccaagagcatggcctaccaaactggaatgggagaggcacaagatccgagctcgccaaaaccgcgcatatctcgaacgggattgccccgcacaacttcagcagctgcttgaattggggcgaggtgtcctggatcagcaagtgccccctcttgtaaaagtgacccatcatgtaacgagcagcgtcacaactctgagatgcagggcgctcaactattaccctcagaacatcacgatgaaatggctgaaggataaacagccaatggacgccaaagagttcgagccgaaggacgttctcccgaacggggacggaacataccagggttggataacactggcggtgccccctggggaagagcagaggtacacctgtcaagtggagcaccccggactggaccagcctctcatcgtgatatgggaaccgagcccttcaggcaccttagtcatcggcgtcatctcgggaatcgcagtatttgtggtcattctgttcatcgggatactgttcattattttgcgcaagagacaggggtctagaggagccatgggtcattatgtgcttgccgagcgcgagtag

SEQ ID NO: 4427 - DNA, 978 bp, Artificial Sequence
  Description of Artificial Sequence: Synthetic coding sequence
atgggcccacgggcacggcctgctctgctgctgctgatgctgctgcagaccgcggtgctccaaggcaggctgctgcctctcggttacgtggacgatcaactgtttgtgttctatgaccacgagtcgaggcgggtggagcccaggaccccatgggtttcaagcaggatcagcagccaaatgtggctccaattgagccagtcgctaaaaggatgggaccacatgtttacagtagatttttggacaataatggaaaaccacaaccattctaaggagagccataccttgcaggtgattctcggctgcgaaatgcaggaggacaactccacagaagggtactggaagtatggttatgacggccaagaccacttggagttctgcccagatacccttgattggagggctgcagagccaagagcctggccaaccaaactcgagtgggaaaggcacaaaatacgagccagacagaaccgagcgtacttagagcgggactgtcccgcacagctgcagcagctgttggagctgggcaggggtgtgctggaccagcaagttcctcccttagtgaaagttacccatcacgtgacaagttcggtgactactctacggtgtcgggctctgaattactatccccagaatatcaccatgaagtggttaaaagacaaacagccaatggacgctaaggaatttgaacccaaagatgtcctgccaaacggagacggaacttaccaaggatggattacgttggcagtgcccccaggggaggagcagcgttatacctgccaagttgaacaccctggccttgaccagcctttaattgtcatctgggagccaagcccatctggaaccttggtgatcggcgttatctccgggatcgccgtgtttgtggtaatcctgttcattggtatcttatttatcatcctgagaaagcgtcagggctctcgaggcgcaatgggacattacgttctggcagagcgcgagtag

SEQ ID NO: 4428 - DNA, 1005 bp, Artificial Sequence
  Description of Artificial Sequence: Synthetic coding sequence
atggggccacgcgcacggccagctctcctgctgctgatgctgttacagactgctgtgttgcaggggcgactgctgaggtcccatagtttgcactacctgtttatgggggctagcgaacaggacctcggcctgagcctttttgaagcgcttggctacgtggacgaccaactcttcgtcttctacgaccacgaatcccgacgagtcgaaccccgtacgccgtgggtgtcatcccgcatcagcagccaaatgtggctgcagctgtcccagtcactcaagggatgggaccacatgtttaccgtcgacttctggacgatcatggagaatcataaccacagtaaggagagccataccctccaggtaattctggggtgtgaaatgcaggaggataactccacagagggttactggaagtacggctatgatgggcaggatcacctggaattttgtccggatactcttgattggagagctgcagaacctagagcatggccaaccaagttagagtgggagagacataagattagagccaggcagaatcgcgcatacctggagcgagactgtccggcacagctccaacagttgcttgaactgggcaggggggtgttagatcaacaggtaaccactctgcggtgtagagccctgaactactatccacagaacatcacaatgaagtggctgaaagacaaacaacctatggatgccaaagagttcgaaccaaaagacgtgctgcccaacggagatggcacgtatcaaggctggattacccttgctgtacccccaggagaggaacagcgctatacttgccaggtcgaacaccctgggctggaccaaccactgatcgttatctgggagccttccccttccgggaccctagtgatcggagtaattagcggtattgccgtcttcgtggtgatcctgtttattggtatcctgttcataatacttaggaagcgacagggttctcgcggagcaatgggacattatgtcctcgctgaacgagagtag

SEQ ID NO: 4429 - DNA, 1038 bp, Artificial Sequence
  Description of Artificial Sequence: Synthetic coding sequence
atgggcccaagagctcggcctgcattgcttctgctaatgctgctgcagaccgctgtgctccagggcaggctcctgagaagtcactcccttcattatctgtttatgggagccagcgagcaggacctgggcttgagcctgttcgaagcactcggttatgtggacgaccagcttttcgtgttctatgaccacgaatctagacgcgtcgagcctcgcaccccgtgggtcagttccaggatctcatctcaaatgtggttacagctctctcagagccttaaggggtgggatcacatgttcacagttgacttctggactatcatggaaaatcacaaccacagtaaggagtcccataccctacaggtaattctcggttgtgagatgcaggaggataattctaccgagggatattggaagtacggctacgatggacaggaccatttggaattctgcccagacacgctggattggagggccgctgagccaagggcctggcctacgaaattagaatgggagagacataaaatcagggctcgacaaaatcgcgcttatctcgagcgtgattgtccggctcagctgcagcagttactggaattgggcaggggggtgttagatcagcaggagggatccgagtcttcaagcttgcctggcaaagtcacaacacttaggtgcagggccttaaactattacccccaaaatatcaccatgaaatggcttaaagacaaacaacctatggacgctaaagagtttgaacctaaggacgtcctgccgaacggggatggaacgtaccagggctggatcaccctggctgtgccacctggagaggagcagagatatacttgccaggtcgagcaccccggattggatcaaccactgattgtaatctgggaaccctcacccagcggcactcttgtgattggggtgatttccgggattgccgtgttcgttgtgattctcttcatcggtatattgtttattattctcaggaagcgacaggggagtaggggtgccatgggccactacgtgctcgcagaacgggagtag

SEQ ID NO: 4430 - DNA, 741 bp, Artificial Sequence
  Description of Artificial Sequence: Synthetic coding sequence
atgggtcccagggccaggccggctcttctgctgcttatgctgctccagacagcagtgttacagggtaggctgttacagtcccatactttgcaggtcatactgggctgcgaaatgcaagaggacaattctaccgagggctactggaagtacggttacgatggccaggaccatctcgaattttgccccgatactctcgactggcgtgctgccgagccgagggcatggcccacaaaactagaatgggagaggcacaagatccgagcgagacaaaacagggcctacctggaaagagattgtcctgctcagctccaacagttactggagctcggtagaggagtgttagatcagcaggtcacaacgctgagatgtagggccctgaattattacccccagaatattacaatgaagtggctgaaggacaaacagcctatggatgctaaggaattcgagccgaaggacgtgctgcctaatggggatgggacttaccagggatggatcaccctcgccgtccctcccggtgaggagcagcggtatacctgtcaggttgaacatccagggcttgaccagcctctgatcgtgatttgggagccttctcctagcggcacgttggtgattggagtaatctctggtatcgccgtcttcgtcgttattctttttatcggtattttgttcatcattctccgcaagagacagggtagtaggggagccatgggccactatgttttggcggagcgggaatag

SEQ ID NO: 4431 - DNA, 486 bp, Artificial Sequence
  Description of Artificial Sequence: Synthetic coding sequence
atgggtccacgcgcaagaccagccctgctgctgctgatgttactccagaccgcggttttgcaaggacgcctcctgcgctcacacagtctgcattatcttttcatgggggcttccgaacaggacctcgggctatccctgtttgaagccctggggtatgtggacgaccagttgtttgtgttttatgaccacgaatctaggcgggtcgagcctagaacaccgtgggttagctcgagaataagtagccagatgtggcttcagctttctcaatcactgaagggctgggaccacatgttcacggtggatttctggacaatcatggagaaccataatcacagtaaggaaagtcacacactacaggtgatcctaggatgtgagatgcaggaggataactccacagagggatactggaagtacgggtacgacggccaggtgctgcaggacactatttatagctctgaagtcagctcattggggatcaaattctag

SEQ ID NO: 4432 - DNA, 366 bp, Artificial Sequence
  Description of Artificial Sequence: Synthetic coding sequence
atggaaaatcacaaccacagcaaagaaagccataccctgcaggttattttgggatgtgaaatgcaagaggacaacagcacggaggggtactggaagtatggttacgacggccaggatcacctcgaattttgtcctgatacgctggactggcgagcagctgagccacgcgcatggcctaccaaactcgagtgggagcgtcataaaatcagagctagacaaaacagggcttatctcgaacgtgactgccccgcacagttgcaacagctgttagagctgggcagaggcgtactcgatcagcaggtaccaccactggtaaaggtgacccaccatgttagccatccggctcagccctccaaagagagctag

SEQ ID NO: 4433 - DNA, 1281 bp, Artificial Sequence
  Description of Artificial Sequence: Synthetic coding sequence
atgggagaacctggccagtctcccagcccgcgtagctcacacgggtctcctccaactctctccaccctcacccttctgctactgctttgtggacacgcacactcccagtgtaagattctccgttgcaacgctgagtacgtctccagcaccctgtccctgcgcggaggcggatcgtctggtgcactccgtggcggaggtgggggaggccgaggcggtggcgtgggatccgggggtctgtgtagggccttgagatcttacgccctctgcacaagacgcaccgcccgtacttgtcggggtgacctcgccttccacagcgccgtgcatggaattgaggatctcatgattcagcacaattgcagtcgacaaggacccactgcaccaccaccaccacgcggacccgctctgccaggggcaggttcaggattgcctgccccagatccctgcgattacgagggcagattttctcggctgcacggacggcctccgggttttctccattgcgctagcttcggggacccacatgtccgatcgttccatcatcattttcacacctgccgagttcagggtgcgtggcctcttttggataacgacttcctttttgtccaggctacaagctcacccatggccctgggagctaatgccactgccacaaggaagctgacaatcatttttaaaaatatgcaagagtgtattgaccagaaagtctaccaggccgaggtggacaacctccctgtagcattcgaggacggcagcatcaacggaggtgataggcctggtgggagcagcctgagtattcagacagccaatccgggtaaccatgtagagatccaggccgcttacataggcactacgatcatcatccgccagaccgctggacagctgagcttcagcatcaaggtcgcagaggatgtggccatggccttcagcgcggaacaggacctccaactgtgcgtcggcggatgcccaccgtcccagaggttgtctagatccgagagaaaccggagaggggcaatcactattgatactgcacgtagactgtgtaaggaaggcctgcctgtggaggacgcttatttccactcctgcgttttcgatgtgctgatttccggggatccgaacttcaccgttgccgcacaggccgctctcgaggatgcccgagcttttcttcctgatctcgagaagcttcatctcttcccatctgacgccggagtgcctctgagcagcgcgaccctgttagcgcctctgctaagcggtctgttcgttctctggctgtgtatccagtag

SEQ ID NO: 4434 - DNA, 942 bp, Artificial Sequence
  Description of Artificial Sequence: Synthetic coding sequence
atgatccagcataactgcagtcgccaaggtcctactgccccaccacccccacgcggacccgcactccccggagccggtagcggattacccgctcctgatccatgcgactatgaggggcgtttctcacgattgcatggtcgtcccccaggctttcttcattgtgcctcattcggcgacccacatgtccggtcttttcaccaccacttccatacatgtcgtgttcagggcgcttggcctctgctcgacaatgatttcctatttgtccaagccacctccagccctatggcgcttggcgctaacgccactgctacccgcaaactcacaattattttcaagaacatgcaggagtgcattgatcagaaagtatatcaggccgaggttgataacttaccggtggctttcgaggatggctccattaatggaggggatcgaccgggaggatcctccttgagtattcaaacagcaaaccctggcaaccacgtcgagattcaagccgcttatatcggaacgactatcatcatcaggcagaccgctggacaattgtctttttctataaaggtggctgaggacgtggcgatggcttttagcgcagagcaggatctccagctgtgtgtcggaggctgcccgccatcacaacgactcagcaggagcgagaggaaccgtagaggtgccattactatcgacacagccaggcgactttgtaaagagggcctgccagtcgaggatgcgtatttccacagctgcgtgtttgacgtcctcatttcgggtgaccccaatttcaccgtcgcagcccaggctgccctcgaggacgctcgcgctttcttgcccgacttggagaagctgcatctctttcccagtgatgccggtgtccccctctcaagcgccactttattagctccactcctgtctggtcttttcgtgctgtggctttgcatacaatag

SEQ ID NO: 4435 - DNA, 282 bp, Artificial Sequence
  Description of Artificial Sequence: Synthetic coding sequence
atgggggaaccgggtcagagtccatctccaaggtcaagtcatgggtctccacctacactttctacactgacgcttctcctactcctttgcgggcacgcccatagtcagtgtaagatcctgcgctgcaatgcagagtacgtatccagcacattatctctgagaggcggaggctcaagtggcgctctgcgcggaggcggtgggggtggccgaggcggaggcgtggggtccggaggactgtgtcgggcattgaggagctacgccctgtgcacgcgaaggacttag

SEQ ID NO: 4436 - DNA, 603 bp, Artificial Sequence
  Description of Artificial Sequence: Synthetic coding sequence
atgcaggaatgtattgatcagaaagtgtatcaagcggaggtggataatctccccgtggcatttgaagatggatctatcaacggcggagatcgaccgggtggcagctctctatcaattcagaccgcaaatcctggaaatcatgtcgaaatccaagccgcatatattgggactacgataataatccgacagacagctggtcagttgagcttctctattaaggtggctgaagatgtggctatggctttttctgctgagcaggacctgcagctgtgtgtgggtggatgcccaccatcccagcgcctgtccagatcggagcgcaaccggcgtggtgcaatcacaatcgataccgcccgaagactatgcaaagagggactgcccgttgaagatgcttactttcactcctgtgtatttgacgttctgatctcgggggacccaaactttactgtggctgcccaggcagccctcgaagacgctagggcctttcttcccgatctggaaaaactgcacctgtttccttccgacgcaggggtgcctctctcctcagcaacacttctggcccctctgctgagcggtctattcgtgttgtggctttgtatccaatag

SEQ ID NO: 4437 - DNA, 603 bp, Artificial Sequence
  Description of Artificial Sequence: Synthetic coding sequence
atgcaggaatgtatagaccaaaaggtgtaccaggccgaagttgacaatctgccggtcgcgttcgaggacgggtccattaatggcggagatcggcctgggggatcatccttatccatccagacagctaaccctggtaatcacgtcgagatacaggcggcttatatcggtacaacaattattatcagacagacggctggccagttatcattctcgattaaagttgctgaagacgtcgcgatggcttttagtgcggaacaggaccttcaattgtgcgtgggaggctgcccaccgtcccaaaggctctcgagatccgagagaaatcggagaggtgctatcacaatcgataccgcgcgtcgactctgcaaggaaggcctgcccgtagaggatgcctacttccactcttgcgtgtttgatgtgcttatctctggcgaccccaatttcacagtcgccgctcaggctgctctggaagatgctagagcttttctccccgatctggagaaattgcacctattcccctccgacgccggagtgcctctttcctctgccactttgttggcgcctttactgtctgggctgttcgtgctctggctttgtattcagtag

SEQ ID NO: 4438 - DNA, 603 bp, Artificial Sequence
  Description of Artificial Sequence: Synthetic coding sequence
atgcaagagtgcatagaccagaaagtgtaccaagccgaggtcgataacctccccgtggcgttcgaagacgggtcaattaacggaggggataggcctggcggatcctctctttcaattcagaccgctaaccccggaaaccacgtcgaaatccaagcggcatacattgggactactatcatcattaggcagactgctggacagctgtcatttagtatcaaggtggcagaagacgtggcaatggccttctccgccgagcaggatcttcagctctgtgtcgggggatgccctccctcacagcggctctccagaagcgaaagaaatcgccgaggagcgatcacaatcgacactgcacgcaggctatgtaaggaaggacttcctgtggaagacgcctattttcatagttgtgtgttcgatgtcctgatctcaggagaccccaattttaccgtagccgcacaggctgctctagaggatgccagggccttcctgcccgatttagagaagctccacctctttcccagcgacgcaggtgtcccactctcgtcagcgacgttgctggcccctttgcttagcggactgtttgttttgtggttatgtatccagtag

SEQ ID NO: 4439 - DNA, 603 bp, Artificial Sequence
  Description of Artificial Sequence: Synthetic coding sequence
atgcaggagtgtatcgatcaaaaagtttaccaggccgaggttgacaaccttcctgtcgccttcgaggatggcagtattaatggcggagaccgacctggcggatccagcttgagcatccaaacagcaaatcccggaaatcacgtggaaattcaggctgcgtatattggaacaaccatcattataaggcagacagccggtcagttaagcttctcgatcaaagtggcagaggatgttgcaatggccttctcagcagaacaggatcttcagctctgtgtcggtggctgtccccctagtcagcgcctgtcccgatctgaaagaaacagaaggggcgcaatcacaatcgatacagccaggagactgtgcaaagagggtctgcccgtggaggacgcatatttccacagctgcgtgttcgacgtattaatctccggtgatccgaacttcactgtggccgctcaggctgccttagaagatgcacgtgcctttctccccgatctggagaagctgcatctgtttccttcggacgccggagtccctctctcctctgccaccctactcgcacccttactgtccggtctgtttgtgctatggttgtgcattcagtag

SEQ ID NO: 4440 - DNA, 1905 bp, Artificial Sequence
  Description of Artificial Sequence: Synthetic coding sequence
atgccctccgacctcgcaaagaagaaggccgctaagaaaaaggaggcggctaaggccagacagaggccacgcaagggtcatgaggaaaacggcgacgtggtgactgagcctcaggtcgccgaaaagaatgaagctaatggtagggagactactgaagtagaccttctaacgaaggaactggaggacttcgaaatgaagaaagcagccgcacgcgcagttactggcgtcctagcctcccacccaaactcaaccgacgtgcatatcattaatctcagcctgacattccatggccaggaactcttatcggataccaaactggaactcaatagcggacgcaggtatgggttgatcggactaaacggaattggaaagtccatgctcttatccgcaattggaaagagagaagtgcctatccctgaacatatcgacatttaccatctgacaagagagatgccgccaagcgacaaaacacctctccattgtgtgatggaagtggatacagaacgggcaatgcttgagaaggaagccgagcggctagcacatgaggacgctgaatgcgagaaattgatggaattatatgaaagactggaagaactcgatgctgataaagccgaaatgagggcctcccgcattctgcacggacttggctttacccccgctatgcagaggaaaaaactgaaggatttcagtggcggatggagaatgcgggtggcgctagcacgcgctctcttcattaggccgttcatgttgctgctggatgaaccaacaaaccacctggatctagatgcctgtgtttggctcgaagaggagctcaagacctttaaaagaatcctggtcttggtgagccatagtcaggatttcctgaatggcgtctgcactaatatcattcatatgcataataaaaaactgaagtactacacgggcaattatgatcagtacgttaagacccggttagagttagaagaaaaccagatgaagcgatttcattgggagcaggatcaaatagcccacatgaagaactacattgccagattcggacacggctcagctaaactggccaggcaggcccagtctaaggaaaaaacacttcagaaaatgatggcctccggactcacagaacgggtggtctccgataaaaccctgtcattctattttcctccgtgtgggaagataccccctccggtaattatggtccagaatgtgtcctttaagtatactaaggacggcccttgcatttacaacaacctggagttcggtatcgacctagatacccgggtggcactggtggggccaaatggagcgggtaaaagtacgctcctcaagctcctgaccggcgaattactcccaactgatggcatgatcagaaagcactctcatgtgaagattggcagataccatcagcacttacaggagcagctcgatctggacctgtccccgttggagtacatgatgaagtgctacccagagatcaaggagaaagaagagatgagaaagataattggcagatacggtctgacaggaaagcaacaggtatcgcctatccggaacctgagtgacggacagaaatgtagagtatgtctggcctggcttgcttggcaaaacccacatatgctcttcctggacgagccaacaaatcacctggacattgaaacaattgatgcactggcggatgccatcaacgagtttgaagggggtatgatgcttgtgagccacgatttccgccttatccagcaggttgcccaggagatatgggtgtgcgagaaacagaccatcacaaaatggcctggtgatatactggcctataaggagcatttaaagtcaaaactcgtcgacgaggagcctcagctgactaagaggacgcataacgtctgcacccttacactggcgtcattgcctcgcccatag

SEQ ID NO: 4441 - DNA, 555 bp, Artificial Sequence
  Description of Artificial Sequence: Synthetic coding sequence
atgtgggtaaccaagcttcttcctgcgttactgttacagcacgtcctcctgcacctactccttctgccgattgccattccatacgcggaaggccagcgtaaacgcaggaacactatccacgaatttaagaaaagcgctaaaaccactctcattaaaatagatccggcactcaaaattaaaacgaagaaagtcaatacggctgatcagtgcgcaaatcggtgcaccaggaataaaggcctgccttttacatgcaaagcatttgtttttgataaggccaggaaacagtgcctctggttccctttcaacagcatgtccagcggagtgaagaaggaattcggacacgagtttgacttatatgagaacaaggactatattaggaattgtataataggtaaaggcagatcatacaaggggaccgtatcgatcacaaagagcggaatcaaatgccagccatggtcttctatgatcccccacgaacactcaggaggcgatgactgtctggtagaaagtaccttttattctattcccttctgggggcataactcagctagatag

SEQ ID NO: 4442 - DNA, 891 bp, Artificial Sequence
  Description of Artificial Sequence: Synthetic coding sequence
atgtgggtgacaaagctattacccgcattgctcctccaacatgtgctgctccatctgcttctactgcccatagccataccctacgccgagggacaaagaaagcgaagaaatactattcatgagttcaaaaagtcagccaaaaccacactgataaaaatagaccctgctctgaaaatcaaaaccaagaaagttaacactgctgatcaatgtgctaaccggtgtaccaggaataaaggcctgcctttcacgtgtaaagcctttgtcttcgataaggcgcgaaaacagtgcctgtggttccccttcaactcaatgtcaagcggggtgaagaaagagttcgggcacgaattcgatctgtatgaaaacaaggactacataagaaactgtatcattggaaagggtcgttcgtacaagggcactgtgagcatcacaaaaagtggaattaaatgtcaaccctggtctagcatgatcccgcacgaacactcctttctgccatctagctatcgtggcaaagatctacaagaaaattattgtcggaacccacggggtgaggagggaggtccatggtgtttcactagtaatcccgaagtccggtacgaggtttgcgacatccctcagtgctcggaggtggagtgcatgacatgtaacggcgaaagttaccggggactgatggatcacaccgagagcgggaaaatatgccagaggtgggatcaccagacacctcacaggcataagtttctgcctgagcgttatcctgacaagggatttgacgacaactactgcagaaacccagacggccaacccaggccttggtgttacaccctcgatccacacacaagatgggaatattgtgctatcaagacctgcggcgatatcacctgggccttgaactag

SEQ ID NO: 4443 - DNA, 426 bp, Artificial Sequence
  Description of Artificial Sequence: Synthetic coding sequence
atgtgggtgacgaaattgctgcctgctctcctgctgcagcacgtactgctccacttgcttttattgcctattgccatcccctacgctgaaggacagcggaaaaggagaaacaccattcatgaatttaagaagagtgccaagacgacactgatcaagatcgaccccgctctgaagattaaaactaaaaaggtgaataccgccgatcaatgtgcaaatcggtgtacccggaacaagggactcccctttacctgtaaagcattcgtgtttgacaaggcgcgtaagcagtgcttgtggtttccatttaatagcatgtcctcgggtgttaaaaaagaatttggtcacgagttcgacttatacgagaacaaagattatatcaggaactgtatcatcgggaaaggtagatcatataaaggcacagtatcttag

SEQ ID NO: 4444 - DNA, 357 bp, Artificial Sequence
  Description of Artificial Sequence: Synthetic coding sequence
atgtgggtaactaagttactgcctgcactgctactccaacacgtgctattgcatctgctcctcctgcccatcgcgatcccctatgcagaagggcagcgcaagcgccgaaatactatacatgagttcaaaaagtccgcaaaaaccactctaattaagatcgatccagcgctcaagataaaaaccaaaaaagtgaatactgccgatcagtgcgcaaacagatgtaccaggaataaaggcctcccttttacctgcaaggccttcgtgtttgataaggcaagaaagcaatgtctgtggttcccttttaacagcatgtctagtggagtgaaaaaagagtttggccacgaattcgacctgtag

SEQ ID NO: 4445 - DNA, 633 bp, Artificial Sequence
  Description of Artificial Sequence: Synthetic coding sequence
atgtgggtgactaaattactccctgcactcctgctgcagcacgtcctcttacacctcctccttcttccgattgccatcccatatgccgaaggtcagaggaagcgcaggaataccatacatgaattcaagaaatctgctaaaacaacactcattaagatagaccccgctctgaagatcaaaacgaagaaagtgaatacagctgaccaatgcgccaatagatgtactcggaacaaagggctaccattcacctgcaaggccttcgtgttcgataaggcaaggaagcagtgtttgtggtttcctttcaacagcatgagctccggtgtcaaaaaggagttcggccatgaattcgacttgtacgaaaacaaggattacatccggaactgtatcatcggaaaaggacggagttacaagggtactgtaagcattacgaagtccggtatcaaatgtcagccctggtccagcatgatcccgcacgaacacagcttccttccttcctcctataggggcaaagatctgcaggaaaactactgcaggaaccctagaggggaggaggggggtccctggtgttttaccagtaaccccgaggttcggtacgaagtttgcgacatcccccagtgctccgagggaaagtag

SEQ ID NO: 4446 - DNA, 873 bp, Artificial Sequence
  Description of Artificial Sequence: Synthetic coding sequence
atgtgggtgactaaattgctcccggcactcctactgcaacacgtgctgctccatctcctgctgcttcccatcgccatcccctatgctgaagggcaaaggaaacggcgaaatacaattcacgaattcaagaagtccgcaaaaactacactcatcaaaatcgatccggcattaaagattaaaaccaagaaagtgaacacagcagaccagtgcgccaacagatgtacgaggaataagggcctgccattcacttgtaaagcatttgtgttcgacaaggctaggaaacaatgtctgtggttccccttcaattctatgtcatcgggagttaaaaaggagtttggtcacgagttcgacctgtacgaaaacaaggactacatccgaaactgtattatcggtaaagggagaagctataaaggaaccgtttcaatcaccaaatcaggaattaagtgccagccatggtcatccatgatccctcatgagcatagtttcttaccctcgtcctatcgtggcaaagaccttcaggagaattattgtaggaatccacgaggtgaggagggaggcccatggtgctttaccagcaaccctgaggttcggtatgaagtgtgcgacattccccaatgctcggaggtggagtgtatgacttgcaatggagagtcgtacaggggactgatggaccacacagaatcagggaaaatttgccagcggtgggaccatcagacgccacaccgacacaaattcttacctgagcgctaccctgataaaggctttgatgataactattgccgcaaccccgacggacagcccagaccttggtgctacacactcgacccccacacaaggtgggagtattgcgccattaagacttgtgaaacttag

SEQ ID NO: 4447 - DNA, 858 bp, Artificial Sequence
  Description of Artificial Sequence: Synthetic coding sequence
atgtgggtcaccaaattattacccgcacttctgctccagcacgtacttctgcaccttctcctccttccaatcgccattccatacgccgagggtcagcgcaagaggagaaacaccatccatgagttcaaaaagtctgcaaagaccactctcatcaagatcgatcctgccttgaaaattaagaccaaaaaggtaaacacggccgatcagtgtgccaatagatgcaccaggaataaaggtctacctttcacatgtaaggccttcgtcttcgataaggcgagaaaacagtgcctgtggttcccttttaatagtatgagttccggtgtgaaaaaggagttcgggcatgaatttgacctgtatgagaacaaagattacattcgtaattgcatcatcgggaagggtcgatcgtataaaggtaccgtgagcattaccaaaagcggcattaagtgccaaccttggagctccatgatcccccatgaacatagctatcggggaaaagatctgcaggaaaattactgtagaaacccacgcggtgaggaggggggtccttggtgctttacttccaaccctgaagtgcgttacgaagtatgtgacatcccacagtgttcagaggttgagtgtatgacttgcaacggggagtcataccgcggtctgatggatcacacagaaagtggaaagatttgccagaggtgggaccaccagacgccacaccgtcataaatttttacctgagcggtatcctgacaaaggcttcgacgacaattactgtaggaatccagatggacagccgcgaccctggtgctatacactcgacccccacacaagatgggagtactgcgccattaagacctgcgagacctag

SEQ ID NO: 4448 - DNA, 2172 bp, Artificial Sequence
  Description of Artificial Sequence: Synthetic coding sequence
atgtgggtgaccaagctactgccggctctgctactacagcacgtgctgcttcatctgctgctcctgcctatcgccatcccatacgcagaggggcagcgcaaaaggcgtaatactattcacgagttcaagaaatcagccaagacaacactaatcaagatcgatccagccctgaagataaagactaagaaggtcaacactgctgaccagtgcgctaaccgctgtactaggaacaaagggctgcctttcacctgcaaagctttcgtatttgacaaagccagaaaacagtgcctatggtttcccttcaactccatgagctctggagtgaagaaggagttcggacacgagtttgacctgtacgaaaataaggattacattcggaactgtatcatcgggaaaggcagatcctacaagggaaccgtctccatcacaaagtcggggatcaagtgtcagccctggagctccatgattccccacgagcactcctaccgaggtaaagatctccaggagaactattgtaggaaccccagaggagaggagggcggaccctggtgttttacgagcaatcccgaggtcaggtacgaggtgtgcgacatcccccagtgttcagaggtggagtgcatgacctgcaatggggaaagttatcggggtctgatggaccacaccgaaagcggcaaaatttgccagcgctgggatcaccagaccccgcatcggcacaaattccttccagagcgatatccagacaaaggtttcgacgacaattactgccgaaatcccgatggccagccacgaccttggtgctacacacttgatccacatacgagatgggaatactgcgcaattaagacctgcgcggataacactatgaacgatacggatgtgccccttgaaacgaccgaatgcatccagggacaaggcgaaggctacagaggcacggttaataccatctggaacgggatcccctgccaacgttgggacagtcagtacccccatgaacacgatatgacccccgaaaactttaagtgtaaggatctccgcgaaaactattgtcgcaaccctgacggatcagagagcccatggtgtttcactaccgacccaaacatcagggttgggtactgctcccaaattccaaattgtgacatgtctcatggtcaagactgttatcggggaaacggcaaaaactatatgggcaaccttagtcaaacacgaagtggtcttacctgttccatgtgggacaagaatatggaagatcttcaccgccacatattctgggagcctgatgctagtaagctgaacgagaattattgtcggaacccagacgatgatgcgcacgggccttggtgttatactggcaaccctttgatcccatgggattattgccccataagccgctgcgaaggagatacgactcctaccattgtcaatctggaccaccccgtcattagctgtgccaaaactaaacagttacgcgtcgtgaatggtatccctacacggactaatatcggctggatggtatctctgaggtaccgaaacaaacatatctgcgggggtagcttgataaaggagtcttgggtcctcacagcgaggcagtgcttcccgagcagagacctcaaagactacgaggcgtggctcgggatccacgacgtgcatggcaggggtgatgaaaaatgcaagcaagtcctgaatgtgtcacagcttgtgtatggacccgagggctcagatctggtgctcatgaaactggctcggccagccgttctcgatgactttgtgtcaactatcgatttgccaaactatggctgcactatcccagagaagacgtcctgttcagtctacggatggggctacacgggtctgatcaactacgacggcttgttgagagttgcgcatctgtatatcatgggcaacgaaaaatgttcccagcatcataggggtaaagtgacccttaacgagtctgagatctgcgctggcgcagagaagattggttccggcccatgtgagggcgattacggaggccctttggtctgtgagcagcacaaaatgaggatggttctgggtgttattgtcccgggacgcggatgcgccatccccaaccggcctggtatcttcgtccgggtcgcttattatgccaagtggatccataagatcatcctcacctacaaggtccctcagtcatag

SEQ ID NO: 4449 - DNA, 363 bp, Artificial Sequence
  Description of Artificial Sequence: Synthetic coding sequence
atgaatggtgaggaaaagtcgtgctctggctacggcggaccggatgccatggatggcaagctggtctcctcagacgatgacgatttcatcgtgaagcgggaacacacgagggcctccgggataagaaaggcggtactgtctggacccggtcaatctgccgaaaacgaaaccgaccaggtgaattttcgcgagattccacccagatgctatcctaaacatgcaaaggcatgtatctactttacatacaaagtgcattattctaactcatccacggagatcccagaattcttgaccgccctggaagtgctgatggcttctgactttctggatatttacatcttcctcttttttctttttttttag

SEQ ID NO: 4450 - DNA, 255 bp, Artificial Sequence
  Description of Artificial Sequence: Synthetic coding sequence
atggctctctctagccagatctgggccgcatgtctgctgcttctattactgctagcctctctaacttccggttctgtgttcccacaacagaccggacagctcgctgaactacagccccaggacagagcaggggcaagagcgagctggatgcccatgtttcagcgcaggcgacgtagagacacacactttcctatctgtattttctgttgcggctgttgccatcgatcgaagtgtggcatgtgctgcaagacatag

SEQ ID NO: 4451 - DNA, 1422 bp, Artificial Sequence
  Description of Artificial Sequence: Synthetic coding sequence
atggccgttatggcccctagaaccttggtgcttcttttgagtggcgctctcgcgctgacccaaacttgggctgaggtgcaactcgtggaaagcggaggtggcctcgtgcaaccagggggaagcttgcggctaagttgtgctgcgagcggctttaatattaaggacacttatatccactgggtgagacaagccccaggaaaaggactggaatgggttgccagaatctaccccaccaacggatacacacgatatgccgacagtgtcaagggaaggttcacaattagtgccgatactagtaagaatactgcttacttgcagatgaatagcctgcgagccgaagacacggcagtttactactgttcccggtgggggggtgatgggttctacgcgatggattattggggccagggcaccctggtgacagtatcctcggccagcactaaggggcctagtgtattccctctagcccctagcagcaagtcgacatccggcggaacagccgcattggggtgcctggtgaaagactacttccccgagcccgtgacagtgtcttggaactctggcgcactgacatccggcgtgcacacatttcctgctgttcttcaaagttccggactctatagtctctcttcagtggttacggtaccctccagttccctgggtactcaaacttatatctgcaatgtgaatcacaagcccagcaatactaaggtggataagaaggtggagcccaaaagttgtgacaaaacacacacgtgccccccatgccctgcacctgagctgctggggggaccttccgtctttctcttcccccctaaacctaaggacacccttatgataagtagaacaccagaggtgacctgcgtagtagttgacgttagtcatgaggatcctgaagtgaagttcaattggtacgtggacggagtggaggttcataacgcaaaaaccaaacctcgcgaagagcaatataattctacatacagagtggtatcggttctgacagtcctgcatcaggactggctgaacggtaaggaatataaatgtaaggtctctaataaggctttgccagcaccaatagagaagacaatatccaaggccaagggtcagccaagagagcctcaggtctacaccttgccaccctcgcgggacgaactcacaaaaaatcaagtgagtctcacatgcctcgtcaaaggattttaccccagcgatattgctgtagagtgggagtccaacggccagccagagaataattacaagaccacaccgcctgtattggattcagacggatcttttttcctgtattctaaattgactgtggacaagtcgagatggcagcaaggaaacgtgttttcatgcagcgtaatgcacgaggccttgcataaccactacactcagaagtccctgagcctctcacctggctag

SEQ ID NO: 4452 - DNA, 717 bp, Artificial Sequence
  Description of Artificial Sequence: Synthetic coding sequence
atggcagtaatggctcccagaacactggtcttgctcttgagtggcgctctcgcactcactcagacatgggctgatatccagatgacacagagtccctcttccttatcggcctcggtgggcgaccgggttacgatcacttgtcgcgctagtcaggacgttaatactgccgtcgcatggtaccagcaaaagcctgggaaggcgccaaagctgttgatatattctgccagttttctgtattccggcgtgccatccagatttagcggaagcagaagtggaacggactttacgctgactatttctagtttacaacctgaagactttgctacctattactgccagcagcactataccacgcccccaacttttgggcaggggaccaaagttgaaatcaaacgcacagtcgccgctccatccgttttcatctttcctccctcagacgagcagctgaagtctggaaccgcatccgtggtgtgcctgttgaacaacttttatccacgggaggccaaggtgcaatggaaggtcgataacgctcttcagagcggcaatagccaagagtcagtgacagagcaggactctaaggactccacttattcgctgtcttcaacgctgaccctgtccaaagctgattatgaaaagcataaagtctacgcctgcgaggtgacgcaccagggattgtcgtcgcccgtcacaaagagcttcaaccgcggagaatgctag

SEQ ID NO: 4453 - DNA, 657 bp, Artificial Sequence
  Description of Artificial Sequence: Synthetic coding sequence
atggccactcggtctcccggtgtagtgatatctgacgatgagcctgggtatgaccttgacttgttttgcatccccaaccattacgccgaggacctagagagggtcttcatccctcatgggttaatcatggatcgcacagagcgactagcgagggacgtcatgaaggaaatgggcggtcaccacatagttgcactgtgtgttctaaaagggggatacaagttttttgctgatctgctggactacatcaaagctttgaatagaaactcagatcggtccatcccgatgactgtggacttcatccgacttaagagttattgtaacgatcagtctaccggcgatattaaagtgatcgggggagatgatttgagtacacttaccggcaaaaacgtactgattgtggaagacattatcgacaccggtaagactatgcagaccctgctgtcccttgttcggcaatacaacccgaaaatggtgaaagtagctagcctcctggtcaagcggactcccagatcagtggggtacaaaccagactttgtagggttcgaaatccctgataaattcgtggtgggttacgcactggattacaacgaatattttcgggacctgaatcatgtctgcgtgatatctgagactgggaaggctaagtacaaagcctag

SEQ ID NO: 4454 - DNA, 657 bp, Artificial Sequence
  Description of Artificial Sequence: Synthetic coding sequence
atggcaacaagaagtcctggggtggttataagtgatgacgagcccggatacgacctggacttgttttgcatcccaaatcactatgctgaggatttagagcgagtgttcattccacacggattgatcatggacaggacagagaggttagctcgtgatgtgatgaaagaaatgggcggacaccacatcgtcgcactctgcgtgttgaagggcggttataagttctttgcagacctactcgattatattaaggccctgaatcggaattctgatagaagcattcccatgaccgtagattttatcaggctgaagtcctactgtaacgaccagtccactggtgatattaaggtgattgggggtgacgacctctctaccctcaccggcaagtcccgtctgctagccgaggacattattgacacaggcaagaccatgcagacactgctgagcctcgtgcgccagtataaccctaagatggtgaaggtggcctccctcttagtgaaacgtacaccaagatctgtcgggtataagccggatttcgtgggctttgagattccggacaagtttgtcgtgggctacgcgttggattataacgagtactttagagatctaaaccacgtgtgtgttatctctgaaactggcaaggccaagtataaggcgtag

SEQ ID NO: 4455 - DNA, 1653 bp, Artificial Sequence
  Description of Artificial Sequence: Synthetic coding sequence
atgcctcctcctcggacaggccgaggtctgctgtggctggggctcgttctgagctccgtgtgcgtcgctctgggctctgagacgcaggccaattcaaccactgatgcactcaatgtactcctgatcatcgtggacgatctgcgtccttcacttggctgttatggcgataaactggtccgtagccctaacatcgaccagcttgcttctcactcattattgtttcagaatgccttcgcccagcaggctgtttgtgccccatcaagagtcagttttctcacagggagaaggcccgatacaacacgtttgtacgactttaatagttactggcgcgtacacgcaggcaacttttcaacaattccacagtatttcaaggagaacgggtacgtaaccatgtccgtggggaaagtcttccatcctggcatatcttctaaccacaccgatgattccccatactcctggagcttcccaccttaccacccatcctcagaaaagtatgagaatactaagacctgtcggggacccgatggtgagctgcacgcgaatctgctgtgtcccgtcgacgtgttggatgtgccggaaggcacactgcctgacaagcagtccacagagcaggctatccagcttctggaaaaaatgaagacaagcgccagtccatttttcctggctgtggggtaccacaaaccgcacattcctttccggtaccctaaggagtttcagaagctctaccctctggagaatatcacactggccccagatcctgaagtccctgacggtcttcccccagtggcctacaacccttggatggatattcgccagagagaggatgttcaggcactgaacattagtgtcccctacggacccattccggttgattttcaacgtaagatccgacagagttactttgccagcgtgtcttacctggatactcaggtgggccgtctgctgtccgctctggatgatctgcagttggccaactctaccattatagccttcaccagcgatcacggctgggcactcggtgagcacggagagtgggcgaagtactcgaacttcgacgttgctactcacgttccgcttattttttatgtacctggaagaacagcttcactgccggaagccggtgaaaaactgttcccctacctggacccattcgattcagcatcacagctaatggagccgggtagacagagcatggatctcgtggaactggtgtctctgttcccaacactcgctggattagctgggctacaggtaccccctagatgccccgttccatcttttcacgtcgagttgtgcagagaaggtaagaacttgctgaagcattttaggtttcgcgacctggaagaggacccttacctgcccggtaacccacgggagctgatcgcgtactcacaataccctcggccaagtgacatcccccaatggaacagtgataagccctcactgaaagacattaagatcatgggctactccattagaacaatcgactacagatacacagtgtgggtcggcttcaaccctgatgagtttctcgcgaatttctctgacatccacgcgggtgagttgtacttcgtggattccgatcctctgcaggaccataatatgtacaatgatagccagggaggtgatctcttccaattgctgatgccctag

SEQ ID NO: 4456 - DNA, 1032 bp, Artificial Sequence
  Description of Artificial Sequence: Synthetic coding sequence
atgccaccacccagaacaggaagaggccttctgtggctgggactcgtgctgtctagcgtgtgcgtcgctctcggtagcgaaacccaggctaatagcacaaccgacgctctaaacgtgttactcatcatagttgacgatttgcgcccatccttagggtgctatggcgacaagctggtacgcagccctaacatcgaccagctggcctctcattctcttctgtttcagaacgcgttcgctcagcaggcagtttgtgcgccaagcagggtaagctttctaactggacgcagaccggacacgaccagactgtatgacttcaactcttactggagggttcatgcaggcaacttttcaaccattcctcagtactttaaggagaatgggtatgtcactatgtctgttgggaaggtgtttcatccgggtatctcaagcaaccacacagatgactccccttattcgtggtcattccccccatatcacccttcaagcgaaaagtatgagaatacaaagacctgtcgaggacccgacggtgagttacacgccaacttactgtgtcctgtggatgttctggacgtgcctgagggcactcttcccgacaaacagtccaccgagcaggccatccaactgctggagaagatgaagaccagtgcgagccccttcttcctcgccgtagggtatcataagccacacattcctttcaggtatccaaaagagtttcaaaaattgtacccactggagaatattacacttgcgccagatccagaagtccctgatggcctgcctcctgtcgcgtacaatccttggatggacattagacagagagaggatgtgcaggctctgaacatctctgtgccttatgggccaataccggtggatttccagcgcaagatcagacagagctattttgccagcgtaagctacctggacacacaggttggtcgtctcctgagtgctcttgacgacctacaactggccaactcaactattatagcctttacgtccgaccacggttttctcatgcgaaccaacacgtag

SEQ ID NO: 4457 - DNA, 939 bp, Artificial Sequence
  Description of Artificial Sequence: Synthetic coding sequence
atgccgccaccacgcacaggaagaggactgctgtggttgggtcttgtgctgagtagcgtttgtgtggccctggggtcagagacacaagccaatagcactaccgatgccctcaatgtgttgctgataattgtagatgatctgagaccttctctggggtgctatggcgataagctggtgagaagccccaacattgaccagttggcatctcactcactcctgttccagaatgccttcgctcagcaggcggtgtgtgccccttctcgggtttcttttctaacagggagacggcctgacacaactagactgtatgacttcaactcctattggcgggtccatgcaggtaattttagcacaatccctcagtacttcaaggaaaacggttacgtaactatgtctgtgggtaaagtgtttcacccagggatatcgagtaaccataccgatgacagcccgtactcctggtcctttccgccataccacccaagctcagaaaaatacgaaaacactaaaacctgcagaggcccagacggagagctgcacgccaatctcctatgccctgttgacgttttagatgtcccggagggaactctgccagataagcagagtactgagcaggccatccagcttctcgagaagatgaaaacctcagcctcgcctttctttctggctgttggatatcacaaacctcatattcccttccgctacccaaaggagttccagaagctgtatccgctggaaaacattactctggcccctgatccagaggtccccgacgggctcccaccagtagcctataacccttggatggacatcaggcagagagaagacgtacaggcccttaatatctccgtcccgtacggacccattcctgtcgatttccaggaggaccagagtagcactggattcagactcaagacctcatccacaaggaaatacaagtag

SEQ ID NO: 4458 - DNA, 540 bp, Artificial Sequence
  Description of Artificial Sequence: Synthetic coding sequence
atgccacctccccgtaccggacgcggactcctatggctgggattggttctgagtagtgtctgcgtcgccctcggctcagagacccaggctaactcaaccacagacgccctaaatgttctgttgatcattgtagatgatctccggccatccctcgggtgctacggggacaagctggtgagatcaccaaatattgaccagctagcttcacacagcctcctttttcaaaacgcctttgcccagcaggccgtgtgcgctccttctagagtcagcttcctcaccggcaggcgtcctgatactacacgtttgtatgactttaacagttactggcgcgttcacgccggaaactttagcactatcccgcagtacttcaaggagaacggctatgttactatgtcagtcggcaaagtgttccatccaggtaccgccccatgccccgaatccggattttcatggttcgtcgtatctgaatcttcgatcccaatcctggggatggggttgtcattgcagagccctctgcttgcagggagggtcccacgttag

SEQ ID NO: 4459 - DNA, 261 bp, Artificial Sequence
  Description of Artificial Sequence: Synthetic coding sequence
atgccgcctccacgtaccggaagaggactgctgtggctgggcctcgtgctctctagcgtgtgcgtggctctcggtagtgagacacaagctaattcaactactgatgcattaaacgtgctgctgatcatcgtggatgacctgcgccctagtcttgggtgttatggggacaaactcgttcgctcaccaaatattgaccagttggcctctcattccctgctgttccagaacgcattcgcccagcaagcggtgtgtgctccttag

SEQ ID NO: 4460 - DNA, 462 bp, Artificial Sequence
  Description of Artificial Sequence: Synthetic coding sequence
atggatttggttgagctagtttccctgttcccaacactggcgggtctggccggtctccaggtcccaccacgatgccctgttccgagcttccatgttgagctctgtcgggaagggaaaaatctcctaaaacacttcaggttcagagacctcgaagaggacccttatctccctggaaatcctagagagttgatcgcctattctcagtacccccgacccagtgacatcccacagtggaatagcgacaagccgtcactgaaagacattaaaatcatgggatatagcatcagaacaatcgactacagatacactgtttgggtgggatttaatccagacgaattcctggccaatttttccgacatccacgccggagaactgtactttgttgacagtgatcccctgcaggaccacaatatgtacaatgattcccagggtggggatcttttccagctgctcatgccctag

SEQ ID NO: 4461 - DNA, 1020 bp, Artificial Sequence
  Description of Artificial Sequence: Synthetic coding sequence
atgaagacatccgcctctcctttcttcctcgcggtcggatatcacaaaccacatatcccctttcgctatcctaaagaattccagaagctgtaccctctagagaatatcacgctggcccctgaccctgaagtaccagacggcctgccccctgtggcttataacccatggatggatataaggcagcgggaggacgttcaagctttaaatatttctgtgccatatggacctatccccgtggactttcagaggaaaatcagacagagttatttcgcctctgtttcctacctcgacacccaggtgggcaggctacttagcgccctggatgacctccaactcgccaattccactatcatagccttcacgagtgaccacggttgggctttaggcgagcacggcgagtgggccaaatattctaatttcgacgtggccacacacgtacctcttatcttctacgtcccaggcaggaccgcctcattacccgaggccggagagaagcttttcccatacctggatccttttgatagcgcgtcccagttgatggagccagggagacagtccatggatctcgtagagctagtcagcttattccccaccctggccggattggccggactgcaggtgcccccaaggtgtcctgtcccttcattccatgtagagctgtgcagggaaggcaagaatttgttgaagcacttccggtttagggatctcgaggaggacccctacctgcctggtaatcctcgagagttaatcgcgtattcgcaatatcctcgcccatctgacatacctcagtggaactccgataaaccctccctcaaagacataaagattatgggatactctatccggactatcgactataggtatactgtttgggtcggtttcaaccctgatgagtttctcgccaacttctcagatatacatgcgggagaactgtatttcgtggactctgatccattgcaagatcacaacatgtacaacgattctcaggggggagacctctttcagctactgatgccatag

SEQ ID NO: 4462 - DNA, 1962 bp, Artificial Sequence
  Description of Artificial Sequence: Synthetic coding sequence
atgagaccattgagaccaagggcggcattactagcattgctagcttcactgttggccgcaccaccggtggctcccgctgaagctccacatttagtacacgtggatgcagcaagggccttgtggcctctgcggagattctggaggtcgaccgggttctgcccacccctcccacactcacaggcagaccagtatgtcctgtcttgggaccaacagctaaatcttgcatacgtgggagctgtaccacacagaggtatcaagcaggtacgtacacattggctgctcgaactcgtgacgacacggggatctaccggcaggggtctgtcatataatttcacgcacctggatgggtacctggacctgctcagagagaatcagctgctcccaggctttgagcttatggggtcagcttctggacacttcacagatttcgaagacaagcagcaggtgtttgaatggaaggatctcgttagttcattggcacgcaggtacatcggaagatatggcctggctcatgtctctaagtggaactttgagacgtggaacgagcctgaccaccacgattttgacaatgtgtccatgacaatgcagggatttctcaattactatgatgcatgttctgaaggcctgcgcgctgcatctccggcactgaggttagggggacctggggactctttccacacccctcccaggagtccactatcctggggccttttgaggcattgccatgacggcactaactttttcaccggtgaggcaggcgtccggttggattatatttcacttcaccggaagggtgcacggtctagcataagtattctcgaacaagagaaggtcgtggcccagcagattaggcaattatttcctaagtttgccgacacccccatctacaacgacgaagccgatcctctcgtaggttggtctctcccccaaccatggcgagcagacgtgacctacgccgctatggtcgtcaaagtgattgcacaacaccagaatctcctacttgccaatacaacgagcgcattcccctacgcactgctgagtaacgataacgcatttctgtcctaccacccacacccatttgctcagcgcaccctaaccgcaagatttcaagtgaataatacccgacctccccacgtgcaactcctccgaaagccggtcttgactgccatggggctgctggctttgctggatgaggagcagctctgggccgaggtctcacaagcaggcaccgtgctggactccaaccacacggtgggagtgttagctagtgctcacaggccccagggcccagccgacgcctggagggcagctgtgctcatttatgcgtctgatgatacacgggctcaccccaatcggtccgtcgcagtgacactgaggcttaggggggttcctcccggacctggactggtgtatgtgacaagatacctagacaatgggctgtgtagccctgacggagaatggcggagacttggacgtcctgtgttccctacagctgaacaattccgaaggatgcgggctgcggaggacccggtggctgcggctcccagacccctgcccgctggcggacgactcacgctcagacctgctttgaggttgccgtcactccttctcgtgcatgtgtgcgctaggcctgagaagcctcctggacaggtgactcggctccgggcactacccctgacccaggggcaattggtgctggtctggtctgacgaacacgttggcagcaaatgcttgtggacgtacgagatccagttttcacaggacggaaaagcgtatactcccgttagccggaaaccgagcaccttcaacctgtttgtgtttagtcctgacaccggcgcagtcagcggcagttacagagttcgcgctctggactactgggccaggcccggtccctttagcgacccagtgccttatttggaggtgccagtccccaggggacccccatcacctgggaacccatag

SEQ ID NO: 4463 - DNA, 2028 bp, Artificial Sequence
  Description of Artificial Sequence: Synthetic coding sequence
atgcggcctctcagacccagagcagccctccttgcgctgcttgccagcctgcttgcggctccgcctgtggcccctgcagaagctccccaccttgtccacgtggacgccgctcgagccttatggcccctccgcagattctggcggagcacgggtttttggggtagcaccggacggggactgtcgtacaacttcacgcacctggatggatacctggatctcctgcgggaaaatcaattactgccgggattcgaactaatggggagcgcctccggccactttaccgatttcgaggacaagcagcaggtgttcgaatggaaagatctcgtttctagcctcgcacgcaggtatatcggtcgctacgggctggctcacgtgtctaagtggaactttgaaacttggaatgaacctgaccatcacgattttgataacgtgtccatgactatgcagggctttttgaactactacgatgcatgcagcgagggactgcgggcagcttctccggctttgagattggggggtcctggggattcgttccatactccgcctcggagtcccttgtcgtggggcttgctacgccactgtcatgacgggactaacttcttcactggtgaggccggtgtgcgactggactatatctccctccatagaaaggtccgaccggcaccgccatccgctcctgtgttttgtgcactgtcccggtgcgccccaggtagagctgatcccggtggcgctgaagctgcccctcctgccggatgtgcacagctgcatttgcaccccggagccggagaaggacgcagggccgctgaccccgcagccctcccacaggtccgaggacatccccacctgcagcgacggggaggccctgccggagggttggtgcctgctacggccgttgagggaggacgggacctacgcggtcatggtggggagggcggtcctgcccagcggcctgctagaccacctgcgaccttcttaccaaggcgggaccgtagggcggtggcggcacccccagggcctagctgcccaggacatccccaggtaatcgcacagcaccagaatttactcttggcaaacactacctctgcatttccttacgccttacttagcaacgacaatgcatttttatcataccacccccatcccttcgcacagagaaccctgacagctaggtttcaagtcaataataccaggccgcctcacgtccagctgctgagaaagcccgtgctgacagcaatgggactgttggcgcttttagatgaggagcagctatgggcagaagtgtctcaggctggaactgttctcgacagcaatcacacagtcggtgtcctcgcttccgcgcataggccccagggcccagctgacgcctggcgtgctgccgtcctcatctacgcgagcgatgacaccagagcccacccaaaccgctctgtggctgtgaccttacgcctgcgtggggtgcctccgggtcccggactcgtgtatgtaactaggtatctggacaacggactctgtagccccgatggggaatggaggcgattggggaggcccgtgttcccgacagctgagcagtttcgcaggatgagagcagctgaagaccccgtcgctgccgcaccgaggcctctccccgctggaggacgccttacgttgcgccctgcattgcggctgccttcccttctgctcgtgcacgtgtgcgcacgaccagagaaacctccgggtcaagttacccgactgcgtgctctgcccctgacccaaggccagctcgttttggtgtggagcgatgaacatgtgggatcgaaatgtctgtggacttacgagatccagttttcacaggacggcaaggcctatacgcctgtttcgcgcaaaccctccaccttcaacctgttcgtgttttcccctgacactggagccgtgagcggcagctatcgggtgcgcgcactagattattgggccaggcctggaccctttagcgacccggtcccttatctcgaggttcctgttcccaggggcccaccatcacccggaaacccgtag

SEQ ID NO: 4464 - DNA, 603 bp, Artificial Sequence
  Description of Artificial Sequence: Synthetic coding sequence
atggcactttggatgaggctcctgcccctgctcgcacttctagccctttggggaccagatcctgctgcagcttttgttaatcaacatctgtgcgggtcacatctggtcgaggccttgtatcttgtgtgcggggaacgtggtttcttctacacccccaaaaccagaagagaagccgaggatctccaggccagcgcactttcactgagttcctcaacgtccacctggccagaggggcttgatgccacggcgagagccccacccgcattagtggtaaccgccaatatcggccaggctggcggttcctccagtagacagtttagacagcgggctttgggcacaagcgatagtcctgtcttgttcatacactgccccggagcagcaggaacagcccaagggcttgagtaccgtgggaggagggttactacggagctagtttgggaagaagtggatagcagcccacagccacagggctcggagtcattaccagctcaaccgcctgcacaaccggcacctcagcccgagccacagcaagccagggaaccttctcctgaagtatcatgctgtggactctggccacggaggcctcagcgatcacagaactag

SEQ ID NO: 4465 - DNA, 333 bp, Artificial Sequence
  Description of Artificial Sequence: Synthetic coding sequence
atggccttgtggatgcgcctactgccgcttcttgcacttctggccctgtggggcccagatcctgctgctgcgttcgtgaatcagcatctctgcggtagtcacctcgttgaagcattatatctcgtatgcggagagcggggattcttctatacaccgaagacacgcagagaggccgaagatctccaggtgggtcaggtggaactaggaggcggaccgggagccggatcgttacagccactggctctggagggttcactgcagaagagaggcatcgtcgagcagtgttgtacgtctatctgcagcctgtatcagcttgaaaattactgtaactag

SEQ ID NO: 4466 - DNA, 333 bp, Artificial Sequence
  Description of Artificial Sequence: Synthetic coding sequence
atggcactctggatgagattgttgcccttgctggctctgctggctctttgggggccagacccagccgctgccttcgtgaaccaacacttgtgcggatcccacctggtcgaggccttgtatctcgtttgtggagaaaggggctttttctacacgcctaagactcgacgggaggcggaggatctgcaagtgggccaggtggaactgggtgggggtcctggcgcaggttctctgcagccactggcgctggaaggatcgttacagaaaagaggaatagtggaacaatgttgcaccagtatctgttctctgtaccagctggagaactactgcaactag

SEQ ID NO: 4467 - DNA, 333 bp, Artificial Sequence
  Description of Artificial Sequence: Synthetic coding sequence
atggctctgtggatgagacttttgccgctgttggccctactggccctctggggtcctgacccagccgcagcttttgtgaaccagcacctctgcgggtcacatttggtggaggccctctacctggtttgtggggaaaggggattcttctatacgccaaaaaccaggcgagaggctgaagacttgcaggttggccaggtagaactgggcggtggaccgggagccggaagcctgcagcccttggccctggaggggagcttacagaaacgagggatcgtggaacagtgctgtaccagtatctgttctctatatcagcttgaaaattattgtaactag

SEQ ID NO: 4468 - DNA, 297 bp, Artificial Sequence
  Description of Artificial Sequence: Synthetic coding sequence
atggctctttggatgcgacttctaccgctgttggcactgttggctctctggggcccagaccctgcagccgctttcgtgaatcaacacctgtgcggcagtcatttggtggaagcgctatacttggtgtgtggcgaacgtgggttcttttatacgcctaagactcgcagggaagcggaggatctgcagggaagcctccaaccactcgccctggaaggttcattgcagaaaaggggaattgttgagcagtgctgtacgtccatctgttctttgtaccagctagaaaattactgtaattag

SEQ ID NO: 4469 - DNA, 333 bp, Artificial Sequence
  Description of Artificial Sequence: Synthetic coding sequence
atggcactttggatgcggctcctgcctctgcttgccttgttagcgttgtgggggcctgaccctgcagctgcattcgtgaaccaacatttatgcggctcccatctcgtggaagctttgtacctggtttgcggagaacggggtttcttctataccgacaagacacgccgagaggcagaagaccttcaagtaggtcaggttgagttggggggaggaccgggagccggatccctccagccactggcccttgaagggagcctgcagaagaggggaatcgttgaacagtgctgtacttcaatttgcagcctgtatcagctggaaaattactgcaactag

SEQ ID NO: 4470 - DNA, 333 bp, Artificial Sequence
  Description of Artificial Sequence: Synthetic coding sequence
atggcgctatggatgcgactgctgcctctgctggcactgcttgccttgtggggtccggatcctgccgcagccttcgtcaaccaacatctttgtggatcgcacttggtggaggccctgtatctggtgtgtggggagcgtggctttttctatacccctaagacccgcagggaagctgaggatcttcaagtggggcaggtcgaattggggggaggccctggtgcgggttcactacagccactcgccctcgaaggaagcttgcagaaacgcggtattgttgagcagtgttgcacatcaatatgcagtctctaccaactggaaaattactgcggttag

SEQ ID NO: 4471 - DNA, 333 bp, Artificial Sequence
  Description of Artificial Sequence: Synthetic coding sequence
atggccctttggatgagactgttacctctactggccttactggccctctggggccctgaccccgcagccgcattcgtgaagcaacacctctgcgggtcccatctggtggaggctctgtatctcgtgtgcggtgagcggggattcttttatactcctgaaaccaggagggaggccgaggatctccaggtcggccaggttgagctagggggaggcccaggcgcaggatctctccagccattagcactggagggatctctgcagaagcgaggcatcgttgaacagtgttgtaccagcatctgtagtctctatcagttggagaattattgcaactag

SEQ ID NO: 4472 - DNA, 333 bp, Artificial Sequence
  Description of Artificial Sequence: Synthetic coding sequence
atggcactgtggatgcgcctgttaccactgctggccttgcttgctttatggggccctgatccagccgctgccttcgttaaccaacacctgtgcggaagtcacctggtggaggccctttatttggtgtgcggtgagaggggatttttctacacgaaaccaacgcgcagagaggctgaagacttgcaggttggccaggttgagttggggggtggtccgggagctggatccctgcagcccctggcactggagggctcccttcaaaaaaggggcattgttgagcagtgttgtacctccatatgctccctatatcagctggagaattattgtaattag

SEQ ID NO: 4473 - DNA, 570 bp, Artificial Sequence
  Description of Artificial Sequence: Synthetic coding sequence
atggctttaagttttagtctcctcatggccgttttggtgctctcatataagagcatttgcagcttgggctgcgatctcccacaaactcatagtctggggaacaggagagccctcattttgctaggacagatgggaagaatttcacctttctcttgcctgaaagacagacacgacttcagaatacctcaggaagaattcgatggaaatcagttccagaaagcacaagctatctctgtgctgcatgaaatgattcagcagacatttaatctgtttagtacagaagactcctcagccgcttgggagcagagtctgctcgagaaattctctactgagctatatcaacagctcaacgatctagaagcgtgcgtcatccaggaggttggggtggaagagaccccgcttatgaatgaggacagcattctggctgtacgcaaatacttccagaggatcaccctgtacctcattgagcgcaaatatagcccgtgtgcctgggaggtcgtgagagccgagattatgcggtcattgagtttctcaaccaacttgcagaaaagactgaggaggaaagattag

SEQ ID NO: 4474 - DNA, 573 bp, Artificial Sequence
  Description of Artificial Sequence: Synthetic coding sequence
atgatggcaagcccctttgccttgctcatggccttagtggtcctgagctgcaaatcttcttgctcattggggtgcgatctgcctgagactcacagtctcgataaccgacgaactctgatgctcctggcccagatgtcccggatctccccttccagctgtctcatggaccgtcatgactttggctttcctcaagaagagtttgacggaaaccagtttcagaaagccccagccattagcgtcctgcacgagctgatccaacagattttcaatctgtttaccactaaggactccagcgccgcttgggatgaagacctgctggacaaattctgtaccgaactttaccagcagcttaacgacctagaagcttgcgtaatgcaagaagagcgggtgggtgagacccctctcatgaacgctgacagtatattggccgtcaagaaatattttcgacgcatcacactgtacctgactgagaagaaatattcgccatgtgcttgggaagtagtccgggctgaaataatgcgatcactctccctgagcacgaacttgcaggagcggctgcgtcgtaaagagtag

SEQ ID NO: 4475 - DNA, 570 bp, Artificial Sequence
  Description of Artificial Sequence: Synthetic coding sequence
atggctctgccttttgccttaatgatggccctggtcgtcctctcttgcaagtcgagctgctcactgggctgcaatttgagccagacgcattctttaaataatcggcgtacactgatgttgatggcacagatgagacggattagccctttctcttgcttgaaggaccgccatgattttgagttcccccaggaagagtttgacggaaaccagttccagaaagctcaggccatcagcgtgctgcatgagatgatgcagcagacgttcaatctgttttccacaaaaaactctagcgctgcttgggacgagaccctgcttgagaaattttatattgaactgtttcagcaaatgaacgacttggaagcttgtgtgattcaagaggtcggcgtggaggagacaccattgatgaatgaagactctattcttgcagtgaagaaatactttcagcgaataaccttgtatctgatggaaaaaaaatattctccctgcgcatgggaagttgtcagagctgagatcatgcgttccctatctttcagcacaaatctccagaagaggctaaggcggaaagattag

SEQ ID NO: 4476 - DNA, 570 bp, Artificial Sequence
  Description of Artificial Sequence: Synthetic coding sequence
atggccctgtccttcagcctcctgatggctgtgctggtcctatcctacaagagcatctgctcgctcggatgcgacctgcctcagactcattctctgggaaacagaagagctctcattttgctagcacagatgggcaggatcagccattttagctgtttgaaggacagatatgacttcggcttcccccaagaggtgttcgatgggaatcagtttcaaaaggcgcaagctatctctgcatttcacgaaatgattcagcaaaccttcaacctcttcagcacaaaagactcaagcgcggcttgggacgagactctgctggacaaattttacattgaattgttccagcagctgaatgacctggaggcttgcgtgactcaagaagtgggcgtagaagagatcgccctcatgaacgaagattccattctcgctgtgcgaaagtattttcagcgtatcacactctacctgatggggaagaaatattccccgtgtgcctgggaagttgtccgggcagaaattatgcgaagcttttccttttccacaaacttacaaaaaggactccgacggaaggactag

SEQ ID NO: 4477 - DNA, 570 bp, Artificial Sequence
  Description of Artificial Sequence: Synthetic coding sequence
atggcactgtccttcagtttattaatggctgtgctggtgctgtcttacaagtctatttgctccctcggatgcgatcttccccagactcactcactaggaaaccggagagctctcatcctactcgcacagatgggtcggataagccctttctcatgcctcaaagatagacacgactttggactgccacaagaagagttcgatggcaaccagtttcaaaaaacccaggctatttccgtgctgcacgagatgatccagcagacctttaatctgttctctaccgaagacagttcagccgcatgggagcagtcactcttagagaaattctcgactgagctctaccagcagctgaacaatctggaagcttgtgttatccaggaggtgggtatggaagaaacacccctcatgaacgaagattctatcctggcggtgaggaaatacttccaaaggatcaccttgtacctcaccgagaagaaatactccccatgcgcgtgggaggtggttcgggcagagattatgaggtcactgagtttcagtacgaaccttcagaagatactaagaaggaaagactag

SEQ ID NO: 4478 - DNA, 567 bp, Artificial Sequence
  Description of Artificial Sequence: Synthetic coding sequence
atggccctgacattcgccctgctggttgcattactggtgctgtcttgcaaatccagttgcagtgttgggtgtgacctgcctcagacccattccctgggttcccgcagaacactgatgctgctcgcccagatgagaagaatttctctgttctcatgcctcaaagacagacatgatttcggcttccctcaagaagagttcggcaaccagttccagaaagctgagaccatccctgtcctgcacgagatgatccagcagattttcaatctgttcagcaccaaagactcatctgccgcatgggacgaaaccctcctcgacaagttctacaccgagctgtaccaacagcttaacgaccttgaggcctgcgtcattcagggtgttggcgtgaccgagactccgcttatgaaagaggatagtatcctcgcagtgaggaaatacttccagaggattaccttatatttgaaggaaaaaaagtacagcccctgcgcctgggaagtggtgagggctgaaattatgaggtccttctcactgtccactaacttgcaggaaagtctgaggtccaaagagtag

SEQ ID NO: 4479 - DNA, 570 bp, Artificial Sequence
  Description of Artificial Sequence: Synthetic coding sequence
atggctctttccttttctcttttgatggccgtgctggtgctgagctataaaagcatttgcagcctgggatgtgacttaccacagactcatagtctcggcaataggcgggctctgattctcctcgctcagatgggtcgcatcagtcccttttcctgcttgaaggatcggcacgactttggctttccccaggaagagtttgacggcaatcagttccagaaagcacaagcaatatccgtgctacacgagatgattcagcagacatttaatctcttcagtacaaaagattctagcgccacgtgggagcaaagtctccttgagaaatttagtacggaactcaaccagcagctgaacgatctggaggcctgcgtcatccaagaggttggtgtggaagaaaccccattaatgaatgttgatagtattcttgcagtgaaaaaatatttccagcgcattaccctatatttgactgagaaaaaatattccccatgcgcttgggaagtcgtgagggccgagattatgcggagcttttcactctctaaaatttttcaggagcggcttcgacgcaaagagtag

SEQ ID NO: 4480 - DNA, 570 bp, Artificial Sequence
  Description of Artificial Sequence: Synthetic coding sequence
atggctctgagcttcagccttcttatggcggtgctggtgctgtcctataaatccatttgcagcctcgggtgcgatctgccacagacacactctctgggcaatcgtcgcgcactgattctgctagcgcagatgggccgtattagtcactttagctgcttaaaagatcgacatgacttcggcttccccgaggaggagtttgatggtcaccagttccaaaaagcccaggcgattagtgtgttgcacgagatgatccagcagactttcaatctcttttccaccgaagacagcagcgcagcatgggagcaaagtcttctggagaagttttcaaccgaactgtaccaacagttaaatgaccttgaagcttgtgtgatccaggaagtaggggtggaggaaacccccctgatgaacgaagattcaatccttgcggtgcggaaatacttccaaagaattaccctgtacctcacagaaaagaaatactctccatgcgcctgggaagtggtgagggcagaaatcatgcgatcattaagcttcagtacaaacctccaaaagcgcctacgcaggaaagattag

SEQ ID NO: 4481 - DNA, 570 bp, Artificial Sequence
  Description of Artificial Sequence: Synthetic coding sequence
atggcattaccttttgtgttattgatggcactggtagtcctgaactgtaagtcaatctgtagccttgggtgcgatcttcctcagactcattccctttctaaccggagaaccctgatgattatggcccagatggggcgaatcagcccattctcctgtctcaaggacaggcacgatttcgggttcccacaggaagaattcgacggcaaccaatttcagaaagctcaggccatcagtgtcctgcacgagatgattcagcaaaccttcaacttgttcagcacaaaggactcaagcgccacttgggacgagacactcctcgataaattctacacggagctctatcagcagctaaacgacctggaggcttgcatgatgcaggaagttggagtcgaagatacccccctcatgaatgttgacagtatcctcaccgtcaggaagtactttcagagaattacactgtacctgactgaaaaaaaatattcgccttgtgcctgggaggtggtacgcgcagagatcatgagaagctttagtctgtctgcaaacctgcaggaacggctgcggaggaaggagtag

SEQ ID NO: 4482 - DNA, 570 bp, Artificial Sequence
  Description of Artificial Sequence: Synthetic coding sequence
atggccctgcctttcgccctgcttatggccttggtggtcctctcttgtaaatctagctgtagtcttgattgcgatctgccccagacccattctctggggcaccgccgaacaatgatgctgttagcgcaaatgagaagaattagtttattctcttgtctcaaggatcgtcacgactttcgatttccgcaggaagaatttgacggtaatcagttccagaaagccgaagcaatctctgtgcttcacgaagtgatccagcagacctttaacctattttctaccaaggattcttctgtggcctgggacgagcggttactcgacaagttgtataccgagctataccagcagctgaacgacctggaagcctgcgtgatgcaggaagtgtgggtagggggaacgcccctgatgaatgaggattctatattggccgtcaggaagtactttcagcgcatcactctttacctaacagaaaagaagtactctccctgtgcgtgggaggtggtgcgggcagaaatcatgagaagcttcagcagcagcagaaacctccaggaaagacttcggaggaaagaatag

SEQ ID NO: 4483 - DNA, 570 bp, Artificial Sequence
  Description of Artificial Sequence: Synthetic coding sequence
atggctcggtctttttcgttgctgatggtggtactcgttctaagttacaagagcatttgctcactcgggtgtgatcttccacagacccattctttgagaaatagaagggcactcattctcctcgcccagatgggcagaatttcccctttttcctgcctgaaggataggcatgaatttaggtttccagaggaggaatttgatggtcatcaatttcaaaaaactcaagccatttctgtgctgcacgaaatgattcagcagactttcaatctgttttccacagaagactcgtcagctgcctgggaacagtccctcttagagaagtttagtactgaactgtatcagcagcttaatgacctcgaggcctgtgtgatccaagaggttggcgtagaggagactccgctgatgaatgaggacttcatactggccgtgcgaaagtacttccagcgcataacactatatttgatggagaagaagtattccccatgcgcatgggaggtggttcgggcagagattatgcggtcctttagtttctcaaccaacttgaagaaggggctgcgcaggaaggattag

SEQ ID NO: 4484 - DNA, 570 bp, Artificial Sequence
  Description of Artificial Sequence: Synthetic coding sequence
atggccctgacattctacctgcttgtggcacttgttgtgctctcttataagtcattctcctcattaggctgcgacttgcctcagacccactcactaggaaatcgaagagccctgatcttgttagcccaaatgaggagaattagcccttttagttgtctgaaggaccgacacgacttcgagttcccccaggaggaattcgatgacaagcaattccagaaagctcaggccattagcgtgttgcacgagatgattcaacagacttttaatctctttagcactaaggattcatccgcagcactcgatgagactttgctggacgagttttacatagagttggatcagcagttaaatgatttagagagttgcgtgatgcaggaagtgggggtcatagaaagtccactgatgtacgaggatagtattttggcggttaggaaatattttcaacgtatcacattgtatctgactgaaaagaagtattctagctgcgcctgggaagtggtccgcgctgaaataatgaggtccttttctttgagcattaatctccagaaaaggctaaaatcaaaggagtag

SEQ ID NO: 4485 - DNA, 564 bp, Artificial Sequence
  Description of Artificial Sequence: Synthetic coding sequence
atgacaaataaatgccttctgcagatcgccctcttactgtgcttctccaccacagccctctccatgagttacaacctgctgggcttcctgcagcgctctagcaacttccagtgtcaaaagctgctctggcagcttaacgggaggcttgaatactgcctcaaggatagaatgaacttcgacatcccagaggagataaagcagctgcagcaatttcagaaagaagacgcagcacttaccatttatgagatgttgcagaacatcttcgccattttcagacaggacagcagctctaccggctggaatgagactatcgtagagaatctgcttgccaacgtctatcatcagatcaaccacctgaaaaccgtgctagaagaaaaattggagaaggaggattttacacgcggaaagctcatgtcatcccttcatctcaagcgctattatggtaggattctacactatctgaaagctaaagagtacagccattgcgcctggacgattgtgcgggtggaaatcctgaggaatttttatttcataaatcggctcacgggttatcttcggaactag

SEQ ID NO: 4486 - DNA, 537 bp, Artificial Sequence
  Description of Artificial Sequence: Synthetic coding sequence
atgcattcttctgctctactgtgttgcctggtcttactgaccggcgtgagggctagtccaggccaaggtactcaaagcgaaaactcatgcacacactttcctggcaacttgccaaatatgctgcgtgaccttcgggacgcattcagtagagtgaagacattcttccagatgaaagatcagctagacaatttgctccttaaggaaagcctgctggaagacttcaaagggtatctcgggtgccaggcactgtctgagatgatccagttttacctggaggaggtgatgcctcaggcagagaatcaggatcctgacattaaggcacacgtcaattccctcggtgaaaatctaaaaacactgcgactccgcttgagaaggtgccatcgattcctgccatgtgaaaacaagtccaaagccgtagaacaggttaagaacgccttcaataagctgcaggagaagggcatctacaaagctatgagcgaattcgatatattcatcaattatatcgaagcttacatgaccatgaaaattcgaaattag

SEQ ID NO: 4487 - DNA, 489 bp, Artificial Sequence
  Description of Artificial Sequence: Synthetic coding sequence
atgaggagtagcccagggaacatggagcgcatcgtgatctgtctgatggtgatcttcctggggactctggtgcataaaagctctagtcagggtcaggaccggcatatgattcggatgaggcagttaatcgacattgtggaccagctaaagaattatgtaaacgatttggtccctgaatttctccccgctccagaagacgtggagactaactgtgaatggtccgcgttcagttgtttccaaaaagcacagctgaagtccgccaatactgggaataacgagaggatcatcaacgtctcaataaaaaagcttaagcgcaagcccccatccacgaatgccggtcgacggcagaagcacaggttgacttgcccatcttgcgattcctacgaaaaaaagccgccaaaggagtttcttgagaggttcaagagcctacttcagaagatgattcaccaacatctctccagtagaacccacggtagcgaggactcctag

SEQ ID NO: 4488 - DNA, 534 bp, Artificial Sequence
  Description of Artificial Sequence: Synthetic coding sequence
atgttccacgtgtcattccgctacatcttcggcctgccgccacttatactagtgttacttcccgtggccagctccgactgtgatatcgagggtaaggacggaaaacaatatgagtcggtgctgatggtgagcattgaccaactgcttgattctatgaaagagatcggatccaattgtctgaataatgagttcaacttttttaaacgacatatatgcgatgccaataaagaaggaatgttcctgttccgggctgcacggaagctccgacagtttttgaaaatgaatagcacaggggatttcgacctccatttactgaaagtttctgagggcacaactatactgcttaactgcactggtcaggtcaaggggcgtaagccagctgccctgggggaagctcagcctacgaaatcgcttgaggagaacaagtcactcaaggaacaaaagaagctcaatgatctttgcttcctcaagcgcttgctgcaagagatcaagacatgctggaacaagatcttgatgggcaccaaggaacattag

SEQ ID NO: 4489 - DNA, 216 bp, Artificial Sequence
  Description of Artificial Sequence: Synthetic coding sequence
atgttccatgtgagtttccgctacattttcggcctgccacctctcattttggtgctgctccctgtggcaagcagcgactgtgacattgaaggtaaggacggaaagcagtacgaaagtgtgctcatggtgagcatcgatcagctcttaaatcaaccttataagaaaaaagagaaacgcacagaacgcaagcaacagtcagccatgtccaacaactag

SEQ ID NO: 4490 - DNA, 393 bp, Artificial Sequence
  Description of Artificial Sequence: Synthetic coding sequence
gttagcttccgatacatctttggtcttcctccactgatcctggtgctattaccagtggcttcgagtgactgtgacattgaggggaaggatggaaaacagtatgagagcgttcttatggtcagtattgaccaattattagactcaatgaaagagatcggctctaactgtctgaacaatgaatttaatttctttaaacggcatatttgcgatgcaaataaagtgaaggggaggaagcccgcagctctcggcgaggcccagccaactaagtctttagaagagaacaagtctctgaaggagcagaagaaactgaatgacctttgcttcctcaaacgtttgctacaggagataaaaacctgctggaataaaatcctcatgggcactaaggaacactag

SEQ ID NO: 4491 - DNA, 216 bp, Artificial Sequence
  Description of Artificial Sequence: Synthetic coding sequence
atgttccatgtgtcatttcgatatatcttcggcctaccacctttaatactggttctgctacccgtagccagttctgactgtgacatcgaaggcaaagacggaaaacaatatgaatccgtattgatggtgagcatcgaccaattactgaaccaaccatataaaaagaaagaaaagaggactgaacgcaaacagcagtcagcgatgtccaacaactag

SEQ ID NO: 4492 - DNA, 114 bp, Artificial Sequence
  Description of Artificial Sequence: Synthetic coding sequence
atgtttcatgtctccttccgctacatcttcggcctgccaccgctgatcctggtgctcttgcctgtagccagcagcgactgtgacatcgaagggcagcacgaaaggaattggtag

SEQ ID NO: 4493 - DNA, 402 bp, Artificial Sequence
  Description of Artificial Sequence: Synthetic coding sequence
atgttccatgtttcgttcagatatatcttcggcctccctcccctcatcttagttctactgccggtggcctcttccgactgtgacattgaaggaaaggatggaaaacagtatgagtcagtcctcatggtgagcatagatcagctgctcgacagcatgaaagaaatcggcagtaactgcttgaataacgaattcaatttctttaagcggcatatttgtgatgctaataaggtgaagggccgaaaacctgctgcgctaggcgaggctcagccaaccaagtcacttgaggagaataaatctcttaaggagcagaaaaaactgaatgatctgtgctttctgaaaagacttctccaggagataaaaacttgctggaacaagatactaatgggcactaaggaacactag

SEQ ID NO: 4494 - DNA, 114 bp, Artificial Sequence
  Description of Artificial Sequence: Synthetic coding sequence
atgtttcatgttagctttaggtatattttcgggcttccacctctgatcctggtccttctcccagtggcttcatctgattgcgacattgaggggcaacacgaaagaaattggtag

SEQ ID NO: 4495 - DNA, 195 bp, Artificial Sequence
  Description of Artificial Sequence: Synthetic coding sequence
atgaaagaaattggttcgaactgcctgaataacgagttcaacttttttaaaagacacatatgtgatgctaataaggaggaaaacaagagcctgaaagagcagaagaaattgaatgatctgtgcttcctgaagcggctgctgcaggagatcaaaacttgttggaacaagatcctgatgggcacaaaggagcattag

SEQ ID NO: 4496 - DNA, 2643 bp, Artificial Sequence
  Description of Artificial Sequence: Synthetic coding sequence
atggcggagctgtaccgagtgctagaggccggaaaaatcgggatcttcgagagtccaacgggaacgggcaagagtctttcattaatctgtggggcactgtcttggctacgcgacttcgaacagaagaaacgagaggaggaggctcgattacttgagaccgggactggccctctacacgacgagaaggacgaatctctctgcttatcttccagctgcgaaggcgcagccggtacacctaggcctgccggagagcccgcatgggtaacacagttcgtgcaaaaaaaagaggaaagagatcttgttgatcggcttaaagctgagcaggcgagacggaagcagcgagaagagcgcctccagcagctccagcacagagtgcaactgaagtacgccgctaaacgcctgcgacaggaggaggaagaacgtgaaaacttactgagactgagcagggaaatgcttgaaaccggtcctgaggccgagcggctagaacaactggagtcaggcgaggaagaactcgttctggctgagtatgagtccgatgaggagaagaaggtggcttcccgcgtggacgaagatgaggatgaccttgaagaagaacatatcacaaaaatctattattgctcccggacacattcccagctggcccagttcgtgcatgaggttaaaaaatcgccctttggcaaggatgtgcgactggtgtctctgggaagccgccaaaatctgtgcgtgaatgaggatgtgaagtcactcggcagcgtccaactcatcaacgacaggtgtgttgatatgcagaggtccagacacgaaaagaagaagggcgctgaggaggaaaagccaaaacggcgacgtcaagagaagcaggctgcgtgccccttctacaaccatgaacagatgggccttctgcgagatgaagcactggctgaggtcaaggacatggagcagctgctggccctgggcaaggaagcccgagcctgcccttactacggaagcagactagccattccagccgctcaactggtggtgctgccgtaccagatgcttctgcacgccgctactcggcaggccgcaggcatcagattgcaagaccaggtggtgattatcgatgaagcacacaacctgattgataccatcaccggtatgcatagcgtggaggtgagcggttcccaattatgccaggcgcactcgcagctcttgcaatacgtggagcgatacggaaagcggctgaaggcgaagaatctaatgtacttgaagcaaattctgtatttgctggaaaagtttgtagccgttctcgggggaaacattaaacagaatccaaatacgcagtccttgtctcagacaggaacagaactgaagacaatcaatgacttcttattccagtctcagattgataacattaatcttttcaaggttcagagatattgcgaaaagagtatgattagccgcaaattattcggcttcaccgaaagatatggagccgttttttcttcacgagagcagccaaaacttgcgggattccagcagtttctccaaagcctgcagcctagaacaactgaggcactggcagcccctgccgacgagtcccaagccagcaccttgcgcccagcctccccccttatgcatatccagggattcctagccgcactcaccactgcgaatcaagacgggagggtgatcttatccaggcagggctccctgtcccagtcgacactaaagtttctcctattgaatcctgcagtgcacttcgcacaggttgtgaaggaatgtcgcgcagtagtcatcgcgggaggcacaatgcaacctgtgtccgattttcggcagcagcttctggcttgtgctggcgttgaggccgaaagagtcgtcgagtttagctgcgggcacgtgattcctcccgacaacatccttccactagttatctgtagcgggatctctaaccagcctctggagttcactttccagaagcgcgagttgccgcagatgatggacgaagtcggtcgaattctgtgtaacttatgcggggtggtgcctggcggtgtggtctgcttcttccccagctacgagtacctccgccaggtccatgcacactgggaaaaagggggtttactgggacggctggccgctaggaagaagatctttcaggagcctaaatccgctcaccaggtggaacaggtccttctcgcctactcaaggtgtattcaggcatgcggacaggagcggggtcaggtcacaggggctctgctgttaagtgttgtgggtgggaagatgtctgaggggatcaatttctccgacaatttggggagatgtgttgtcatggtgggcatgccgtttccaaacatccgcagcgccgagttacaggaaaagatggcataccttgaccagacactgccacgcgctccaggccaggccccaccaggcaaggcgctggttgaaaacctatgcatgaaggccgtgaatcagtcgataggccgtgcaatcagacaccagaaagattttgcctcagtggtcctcctggatcagcggtacgccagacctccagtcctcgctaaactgcccgcttggattcgagctcgcgtcgaagttaaagctaccttcggccctgctatagccgctgtacagaaattccatcgggagaagagcgcttcatcctag

SEQ ID NO: 4497 - DNA, 738 bp, Artificial Sequence
  Description of Artificial Sequence: Synthetic coding sequence
atgaagaaaacacagacctggatactcacatgcatctatttgcagctgctcctgttcaaccctctagtaaaaactgagggaatttgccgaaatagggtgacaaataacgttaaggatgtaaccaaattggtcgccaatcttcccaaagactatatgataacactgaagtacgtgcctggaatggacgtgctgccttcacactgttggatcagcgaaatggtggtccagctttccgactctctgacagatctcctggataagttttctaatattagcgaggggctgagcaactatagcatcatcgacaagttggtcaacatcgtggatgatctggtcgagtgcgttaaggaaaatagcagtaaggacctcaaaaaaagtttcaagtccccggagcctcgcctgtttaccccagaagagtttttcagaatcttcaatcgttcaattgatgcatttaaagacttcgttgtggcttcagaaacaagcgactgtgtggtctcgagtaccctcagtcctgagaaaggtaaggccaagaatcctcctggggattcaagtctacactgggctgccatggcactgccagctctgttctctcttatcataggttttgcatttggcgctctgtactggaagaagcgccagccttcccttactcgggcagtagagaatatacaaattaacgaggaggacaacgagatctctatgttgcaggaaaaggagagagaattccaagaggtttag

SEQ ID NO: 4498 - DNA, 93 bp, Artificial Sequence
  Description of Artificial Sequence: Synthetic coding sequence
ggaatggatgtgctgggaaggccaaagatccccctggagacgcccgcatatactggacagccctggcattgtcagcattgcttcctcttgtag

SEQ ID NO: 4499 - DNA, 3039 bp, Artificial Sequence
  Description of Artificial Sequence: Synthetic coding sequence
atgcccgcatctgcaccacccagacgccctaggcctcccccaccctcgttgagcctgctgctggtgctcctggggctcggcggacggaggttgagggcagaacctggagatggtgctcaaacctgggctagattcagtaggcctccagcccctgaggccgctggcctattccaggggacttttcccgacggatttctgtgggcagtgggcagcgccgcttaccagacagaaggcggatggcagcagcacggcaaaggcgcatccatttgggatacttttacgcaccacccattggctccacccggagactctaggaacgcctctctacccctgggagcgccaagccccctgcagccggctacgggagacgttgcctctgactcctataacaacgtgttccgggataccgaggccctgcgggagttgggggtgacacattaccggttcagtatttcatgggcacgggtcctgccgaatggatcagcaggcgtgcccaaccgagagggcctgaggtattacagacggcttctcgagcggttgagggaactgggagtccagccagtcgtaaccttgtaccactgggatctgccacagaggttacaagatgcttatggcggatgggctaatcgggcacttgcagatcacttccgggattatgcagaactctgtttcagacattttggtggtcaagtaaaatactggattaccatcgataatccatacgtggtagcttggcacggttatgccactggacggctggctccagggatacgcggatcccctcgcctcgggtatctcgtggcccataacttactcctggcgcacgccaaggtctggcatctctacaatacgagctttcggcctactcaaggagggcaggtctcaattgccctgtcttcacactggattaatcctcggcgaatgaccgaccactctataaaggagtgccaaaagtctcttgatttcgttctcggctggtttgccaagcctgtgttcatcgatggggattacccagagtctatgaagaataacctgagcagcattttgcccgattttaccgaatcagagaagaaattcataaagggtactgccgacttttttgccctgtgctttggtccgactttatcattccaactgctcgatccgcacatgaaattccggcagctggagagccctaatctgaggcagctgttgtcttggatagacctggaatttaaccatccacagatctttattgtagagaatggctggttcgtgtccggtactaccaagagggacgatgccaagtacatgtattatctgaaaaagttcatcatggaaactctgaaggctatcaaattggacggagtggatgtcattggctacaccgcttggtctttgatggatgggtttgaatggcaccggggatattctatacgccgaggcctgttttatgtcgatttcctgagccaggacaagatgctgctgcccaagagctcagcgctcttttaccagaagcttatagagaagaacggatttccaccattacctgaaaatcagccactggaagggacattcccttgcgatttcgcgtggggggtcgttgacaactatatacaggtcgataccactcttagccaatttacagacttaaatgtgtacctctgggatgttcatcattcaaagcgtctcatcaaggtggacggagtcgtgactaagaaaaggaaaagctactgtgtggactttgcagctatacagccacaaatcgcactgctacaagagatgcacgttactcatttcaggtttagcttagactgggctctgatattgcccctcgggaaccaatctcaagtcaatcacaccattttgcagtattacaggtgtatggctagcgaactcgtgcgtgtcaacattactccagtggttgccctctggcagccgatggctcccaaccaaggcctgccccgactcctggccaggcagggcgcttgggaaaatccgtatacagcactggctttcgctgagtacgcaaggctctgcttccaggaattaggacatcacgtgaaactctggattacgatgaatgagccctataccagaaacatgacttacagcgcaggccacaatcttttaaaggcccacgcactcgcctggcatgtctataatgagaagtttaggcacgctcagaatggaaagatctccatcgccctccaggctgattggatagagcccgcatgcccattctctcagaaggacaaagaggtggctgaaagggtgctagagtttgatattggttggctggccgagcctatattcgggtccggggattacccctgggtgatgcgcgactggctgaatcagcggaacaatttcctgctcccatacttcaccgaggatgaaaaaaagctcattcagggtacattcgattttctcgcgttgtcccactacacgacaatactcgtggactctgagaaagaagacccaatcaagtataatgattatctagaggttcaggagatgactgacatcacctggttgaattctccttctcaggtggccgtggtgccctggggactccgaaaagtgttgaattggttaaaattcaagtacggcgatctaccgatgtatatcattagtaatggcattgacgatggcctgcacgccgaagatgaccaactcagggtatactatatgcagaattacatcaacgaggctctgaaggcacacattttggacgggatcaacctatgtggctacttcgcctactccttcaatgataggactgctcctcgatttggcctgtataggtatgccgctgaccagttcgaacctaaggcatcgatgaagcattatcgtaaaattatcgacagcaacgggttcccagggccagagaccttggaaaggttctgcccagaggagtttaccgtatgtaccgaatgctccttttttcatactagaaagtcactcctggcttttatcgcatttctgttttttgcatctattatcagccttagcttgattttctactacagcaaaaaaggacggaggtcatacaagtag

SEQ ID NO: 4500 - DNA, 729 bp, Artificial Sequence
  Description of Artificial Sequence: Synthetic coding sequence
atgaccgaccatagcatcaaggagtgtcaaaagtctctggactttgtcctcggttggtttgcaaaacccgtgttcatcgatggcgactatccagaatcaatgaaaaataacttaagctcgatcctgccagacttcactgaaagcgagaaaaagttcattaagggcactgcagatttctttgcgctgtgtttcggacctacacttagcttccaactgttagacccgcacatgaagtttaggcagttggagtctcccaacctgcgacaactgttgagctggatcgatctggagttcaaccacccccagattttcattgttgagaatgggtggtttgtctcagggacaactaagcgggacgatgctaagtacatgtattatctgaagaagtttataatggaaaccctcaaggcaataaagctggatggtgtggacgtcattgggtacactgcatggtccttgatggacggatttgagtggcatcggggttatagcattcggaggggtctgttttatgtggacttcctctcgcaggacaaaatgctgctccccaagtcatctgccttgttctaccagaaattgatcgagaagaatggatttccacctttacctgagaatcaaccgcttgaaggaacattcccgtgcgattttgcgtggggcgtggtagacaattacattcaggtgtctcaattaaccaagcccatctcttctttgacaaagccctaccactag

SEQ ID NO: 4501 - DNA, 1440 bp, Artificial Sequence
  Description of Artificial Sequence: Synthetic coding sequence
atgcgccaaccacctggagagtcggatatggccgtatctgacgcactactgcctagtttctccacatttgcctcgggccctgcagggagggagaagactttgaggcaggcgggagcacctaataacagatggagggaggaattaagccatatgaaacggctaccaccagtgttgccagggcgaccttatgacctggcagccgcaacagtcgcaactgatctagagtccgggggagcaggagcagcttgtggcggtagcaacctggccccactgcccagaagagagactgaggagtttaacgacctcctggacttagattttatcctgtctaattctctgactcatcctccagaaagcgtcgccgcaaccgtttctagctcagctagtgcttccagtagctcctcccctagttcttcgggacccgcaagcgctcctagcacttgttccttcacctacccaattagggccggtaatgatcccggtgtggcaccgggtggcacgggaggaggcctactctacgggagagagtccgctccccctcccactgcaccattcaaccttgctgatatcaatgatgtaagccctagtggcggtttcgtagccgaactgctgcgtcccgagctggacccagtatatatcccaccacaacagccacagccgccaggcggtgggctgatgggcaagtttgtgctcaaagcttcactatccgcgccaggctcggaatacggatctccatctgttatctctgtaagtaaaggcagcccggatggttcccaccctgtcgtggtggccccatataatggaggaccacctcggacttgccctaaaattaagcaggaggcagtctcaagctgtacccacttaggggctggccctcccttaagcaatgggcataggcctgctgcccacgacttccctcttggcaggcagctgccctcccgcaccactcctacgttgggactggaagaggtgctgagttcacgtgattgccaccccgcactcccgttgccacctggcttccatccgcatccagggccaaattatccatccttcctgccagatcagatgcaacctcaggttccaccgctgcattatcaggagttaatgcccccaggatcatgcatgcccgaggagcctaaacctaaacgcggacggagaagctggcccagaaagagaaccgctacccacacgtgtgattacgccggatgcggaaagacatataccaaatcctcacacttgaaggcccacctacgcacgcacacaggggaaaagccgtaccactgtgactgggacggatgcggatggaagttcgctcgtagcgacgagctcactaggcactataggaaacatacagggcacagaccttttcagtgtcagaaatgcgatcgggcattttccagatctgaccatttggcgctccacatgaagcgccacttttag

SEQ ID NO: 4502 - DNA, 699 bp, Artificial Sequence
  Description of Artificial Sequence: Synthetic coding sequence
atggctgtgagcgacgctctcttgccgagtttcagtaccttcgcaagcggaccagccggtcgggagaagacgctacggcaagccggagccccaaacaacaggtggcgggaggagctgagccatatgaaacgtctaccgccagttctcccaggcaggccatatgacctcgcggctgcaaccgtcgcaactgacttagagtccggaggtgcaggcgctgcctgcggcggaagtaatctggccccactgcctcggagggagacagaagagttcaacgacttgctcgatctggacttcatcctttcaaactcgctgactcaccctcccgagtccgtggccgcaactgtttcctccagcgcatccgcgtctagcagctcaagcccctctagttcaggcccagcttctgcgcctagcacttgctcatttacctaccccatccgggctggcaacgaccccggtgttgctcccggaggaacagggggagggctcctgtatggaagggagtctgcaccccctccaacggccccattcaatttagccgatataaatgacgttagtcctagtgggggatttgtcgcagagctccttagaccagagttagatccggtatatatacctccgcagcagccacagcccccagggggagggctgatgggaaaatttgtcctaaaagcaagtctgagcgctcctggatctgaatag

SEQ ID NO: 4503 - DNA, 69 bp, Artificial Sequence
  Description of Artificial Sequence: Synthetic coding sequence
atgaggcagccacccggtgagagcgatatggcagtaagtgacgcgctattaccctcattcagtacatag

SEQ ID NO: 4504 - DNA, 117 bp, Artificial Sequence
  Description of Artificial Sequence: Synthetic coding sequence
atgagacagccgcctggggagagcgatatggccgtaagcgacgccttgctgccctcctttagcacatttgccagcgggcctgccggtcgcgagaagactctccggcaggccggttag

SEQ ID NO: 4505 - DNA, 1323 bp, Artificial Sequence
  Description of Artificial Sequence: Synthetic coding sequence
atggggcctccgggtagtccatggcaatgggtaacactgttgctgggcctattgctgcctcctgcggcacccttctggcttctgaatgtgctgttcccacctcacacaacacctaaggcagagctgtccaatcatacgagaccggtgatcctagtccccggttgtctgggcaatcaacttgaggctaaactcgataagccagatgtagtaaactggatgtgctataggaagaccgaagacttcttcaccatctggctggatctgaatatgtttttgcccctgggggttgactgctggatagacaacacaagggtggtctacaatagaagttcaggacttgttagcaacgcccctggggtacagattcgcgtacctgggttcggcaaaacctactctgtggaatatctggacagctcgaagctggctgggtatctccatacactggtccaaaacttagtcaacaacggatacgtgagagacgaaacagtgcgcgctgctccatacgattggaggttggagcctggacagcaagaggagtattatagaaaacttgccggactcgtggaggagatgcatgctgcatatggcaagcccgtgtttcttatcggccacagtcttggatgcctccacttgttgtatttcttgctccggcaaccacaggcctggaaggacaggtttattgacggcttcatcagcttaggcgctccttggggagggagcataaagcctatgttggtactcgctagcggagacaaccagggcatccccattatgagtagcattaagcttaaggaagaacagcgaattacaactactagcccatggatgtttccaagtagaatggcatggccagaggatcacgtgttcatctccacgcccagcttcaactatacaggccgtgactttcagaggttctttgctgaccttcatttcgaagaagggtggtatatgtggctgcagagtagggatctgttagctgggctgccggctcccggtgtggaggtttactgcctgtacggagttggattgcccacaccgagaacctatatttacgatcacggcttcccttataccgatccagtgggagtcctctacgaggacggtgatgatactgtagcgactcggtccaccgaactgtgtggcctatggcagggccgacagccacaacccgtgcacctcttacccttacatggaatccagcacctgaatatggtgttctctaatctgacactggagcatatcaatgcaatcctgcttggagcctacaggcagggaccccctgcaagtcccacagcaagcccagagcctccacctcctgaatag

SEQ ID NO: 4506 - DNA, 753 bp, Artificial Sequence
  Description of Artificial Sequence: Synthetic coding sequence
atggctgataacttttccttgcatgatgctctcagcgggtccgggaatccgaatcctcagggctggccaggcgcatgggggaaccagcccgctggggctggcggatatcccggagcttcctaccctggggcataccccggacaggctccgcctggcgcttacccaggccaggcccctcctggcgcataccctggggctcccggagcctacccaggagcacccgcacctggggtgtaccctggaccaccttcagggcctggagcatacccttccagcggtcaaccttccgcaaccggagcgtatcccgcaactggaccttacggagccccagcaggcccattgattgttccttataatctgccattaccagggggagtggtacctagaatgctgatcactatacttggaacagtaaagcctaacgctaatagaattgctctggatttccaacggggaaacgacgtggctttccactttaatcctcgctttaatgagaacaatcgacgggtgattgtgtgtaacaccaaactcgacaacaactggggcagagaggaaaggcaatccgtgtttccttttgagtcaggcaagccattcaaaatccaggtgctggttgaacctgatcactttaaagtggctgtaaacgatgcccaccttctccagtataatcacagggttaagaagcttaatgagatatctaagctgggcatttccggggacatcgaccttacgtctgccagttacaccatgatttag

SEQ ID NO: 4507 - DNA, 630 bp, Artificial Sequence
  Description of Artificial Sequence: Synthetic coding sequence
atgggatctgttagtaaccagcagttcgcgggtggatgtgccaaggctgctgaagaggcccctgaggaggctccggaggacgctgccagagctgccgacgagccccagttactgcacggagcgggaatatgcaagtggttcaacgtgcgcatgggtttcggtttcctcagcatgactgctagagctggggtggcgctggatcctccagttgacgtattcgtccatcagagcaagctacatatggaaggcttcaggtccttgaaggaaggagaagctgtcgagtttacatttaagaagtccgctaagggcctcgaatctattagagtcacagggcctggaggagttttctgtatcgggtctgagcgacgcccaaagggaaagtcgatgcagaaaagaaggtctaagggcgacaggtgctacaactgtggtggactggatcatcatgccaaggagtgtaaactccccccacagcccaagaaatgccacttctgccaatccatctctcacatggtggccagttgcccgctcaaagcccaacaaggaccatccgcccaaggcaaacctacgtacttcagagaggaagaagaggagattcacagcccaacgctgctgcccgaagcgcaaaactag

SEQ ID NO: 4508 - DNA, 630 bp, Artificial Sequence
  Description of Artificial Sequence: Synthetic coding sequence
atgggaagcgtttccaaccagcagtttgccggtggctgcgcaaaggctgcggaggaggcgcctgaggaagctccagaagatgccgcacgcgcagcggacgaacctcaactccttcatggtgctggtatttgtaagtggttcaatgttagaatgggatttgggttcttaagtatgaccgccagagctggggtagcactggaccccccagttgacgtatttgttcatcaaagcaaactccacatggaagggttccgatcgctcaaagagggggaggccgtcgaattcacattcaaaaagagcgcgaaaggccttgagagtattagagtcaccgggcctggtggagtgttttgcataggtagcgaaagacgaccaaaggggaagtctatgcagaagaggcgctcaaagggcgatcggtgctataattgcggcggacttgaccaccacgcaaaagagtgcaagctgcccccacagcccaagaaatgccacttttgtcagtctatttcacacatggtggccagctgcccactgaaggcgcagcaggggcctagtgcgcagggcaaacccacctacttccgggaggaggaggaagagattcactctcccaccctgctccccgaagcccaaaattag

SEQ ID NO: 4509 - DNA, 660 bp, Artificial Sequence
  Description of Artificial Sequence: Synthetic coding sequence
atgaagatgcgcttcctcggcctggtcgtgtgtctggtcctttggaccctacactctgagggttccggcggaaagctgacagctgtggatccagagacgaatatgaatgtgagcgagatcatttcttattggggcttcccatccgaagagtatctggtggagaccgaagacggctacatcctttgtttgaataggatcccccatggtcgaaagaaccactcagataaaggccctaagcccgtcgtgtttctgcagcacggcctgcttgccgattcatccaactgggtcaccaacttggcaaacagtagtctgggcttcatcctggccgacgccggtttcgatgtgtggatggggaacagcaggggtaatacatggtcccgtaagcacaaaacactgagtgtatcacaagatgagttctgggcgttttcctacgacgagatggccaagtacgacctccccgcatccataaatttcatcctgaacaaaaccggccaggagcaggtctactacgtagggcactctcagggaacaactatcggatttatcgctttttcacagatacctgaactggccaaaagaatcaaaatgttcttcgcactcggtcccgtcgcaagtgtagccttctgcaccagtccaatggcaaagttaggtcgcctgtag

SEQ ID NO: 4510 - DNA, 1200 bp, Artificial Sequence
  Description of Artificial Sequence: Synthetic coding sequence
atgaaaatgcgattcctcggtttggtggtgtgcttggtcttgtggacactgcattccgaaggatccgggggaaaactgactgccgtggatcctgagacgaacatgaatgtgtctgagataatctcctactggggattcccctctgaggaatacctcgtggagactgaggatggctacatcctttgcctgaacaggattccccatggtcgtaagaatcatagtgataaagggcctaagcctgtggtgttccttcagcacgggctccttgctgactcgagcaattgggtaacaaatctggctaactcaagcctcgggtttattttagctgacgcaggcttcgacgtgtggatgggcaatagcagagggaacacatggtctcgaaaacataaaacactgagcgtctcccaggacgaattctgggcctttagctacgacgaaatggccaagtacgatctgccagcaagcatcaactttatcctgaataaaacagggcaggaacaggtctactatgttgggcattcccaaggaaccaccattggcttcatcgcattcagccagattcctgagctggctaagaggatcaagatgttttttgcgttaggccctgtcgcttcagttgcgttttgcacatcacctatggccaaactgggcagattacctgatcacctgattaaagatctttttggtgataaggagttcctcccccaaagcgcctttttaaaatggttagggacacatgtatgcacccatgtgatactaaaagagctgtgcggaaatttgtgcttcctcctatgcggtttcaacgaaagaaatctaaatatgtcacgcgtcgacgtgtataccacccatagtccagccggaacttccgttcagaacatgttgcattggtcccaggcggtgaaatttcagaagttccaggcctttgactggggctcatcagcaaaaaattacttccattacaatcaatcatacccaccgacttataacgtaaaggatatgctagttccaacggctgtctggagtggtggacatgattggctggccgatgtgtatgatgtgaacatactacttactcagattactaatttggttttccatgagtctatccctgagtgggagcacctcgactttatttggggactggacgccccttggcgactgtacaataagatcataaatctcatgcgaaaataccagtag

SEQ ID NO: 4511 - DNA, 1074 bp, Artificial Sequence
  Description of Artificial Sequence: Synthetic coding sequence
atgaagctgcggaccctcgcggtttctgccaccgtggtcaaggacggggtcagcggcgtgtgctcttttagatgtagtgacgtgtcaggcgttttgccctcaggcccaaaaccggtagtgttcctccaacatgggcttcttgcagacagctccaactgggtgaccaatctggccaacagctccttgggattcatactggctgatgccggattcgacgtctggatgggaaactcaagagggaacacttggagccgtaaacacaaaactctgtctgtgtctcaggatgaattctgggcttttagctacgatgaaatggccaaatacgatctgccagcatctatcaattttattctgaataaaactgggcaagaacaggtttattacgtaggacattctcaggggacgacaatcggctttatcgctttcagccaaatccccgaactagccaaacgtatcaagatgttcttcgctctcgggccagtggcttccgtggccttttgcaccagccctatggccaagctggggcgactgccagaccaccttatcaaagacttattcggcgacaaggaattcctgccccagagcgcgtttctgaagtggctgggaacacacgtctgcacccatgtgatactgaaagagttatgcgggaacctttgcttcttgctgtgcggtttcaatgagcggaacctcaacatgtcaagagtggacgtgtacaccacccatagccccgcaggcacgtctgtgcagaatatgctacactggtcccaggccgttaagtttcagaaatttcaagccttcgattggggaagtagcgccaaaaactactttcattataaccaatcttatcccccaacttacaatgtgaaggatatgctggtgcctaccgccgtgtggtcgggaggccacgactggcttgcggatgtgtacgatgtgaatatccttctgacccagattacgaacttggtcttccacgagagcatccctgaatgggagcacttagactttatctggggccttgacgccccttggcggctctacaataaaataataaatctgatgaggaagtatcagtag

SEQ ID NO: 4512 - DNA, 1200 bp, Artificial Sequence
  Description of Artificial Sequence: Synthetic coding sequence
atgaagatgagattccttggactggtggtgtgcctggttctgtggacgctgcactcggaaggctctggcggtaagctgaccgctgtggatcctgagacaaacatgaacgtgtcagaaatcatctcttattggggattcccttcggaggagtatctggtcgagacagaggacggctacattctatgcctgaacaggatacctcacgggagaaaaaatcacagcgacaagggacctaaaccggtggttttcctgcagcacggacttctagctgatagtagcaattgggtgacaaatctagcaaatagttcattagggtttattttggccgatgccggattcgacgtgtggatgggcaacagtcgcggtaatacttggtcccggaaacacaagaccttgtctgttagtcaagacgagttctgggccttttcatacgatgagatggcgaaatacgatttgccagcctcaatcaattttattctgaacaagacaggtcaggaacaagtttattacgtgggacattctcaggggaccacgatcggcttcattgcattctcccagattcccgagctggcaaaacggatcaaaatgttcttcgctctgggcccagtggcctctgttgccttttgtacgtccccaatggctaagttgggccgtcttccagatcacttgatcaaggatctgttcggagacaaagaattcctgccacagtccgctttcctcaaatggcttggtactcacgtttgtacccatgtgatccttaaggaattgtgtggaaacctgtgctttcttctgtgtggtttcaacgagaggaacttaaatatgtcccgggttgatgtttacaccacacattcacccgctggaacatcagtgcagaatatgctacactggtctcaggccgttaagttccaaaagttccaagcattcgactggggctcgtctgcaaaaaattacttccattataatcagagctatccccctacctacaatgtcaaggatatgctggtgccaaccgctgtgtggtcaggcggtcacgactggctggcagatgtctacgatgttaatatactgctgacacaaattaccaatctggtgttccatgaaagtattccagagtgggaacacctcgatttcatttggggcctggacgcaccatggcggttgtacaacaagataataaacctcatgcggaaataccagtag

SEQ ID NO: 4513 - DNA, 1032 bp, Artificial Sequence
  Description of Artificial Sequence: Synthetic coding sequence
atggcttgcctggaatttgtgccctttgatgtgcagatgtgcctagaattcctcccctcagggccaaagcccgtcgtctttttacagcatggcctgctagccgattcatcaaattgggtgaccaaccttgctaactcaagccttggattcatcctggcggatgccggttttgacgtatggatgggcaatagcagaggcaatacatggtcaaggaaacataaaaccctgtcagtctctcaagacgagttctgggcattcagttatgacgagatggcaaagtatgacctgcctgcttctatcaacttcattcttaacaaaacggggcaagagcaagtgtactatgtgggtcacagtcagggtaccacaattgggtttattgctttctcacagattcccgaactggcaaagcgcattaagatgtttttcgccctcggccctgtggcgtctgtcgccttttgcacatctcccatggctaaactcggaaggctccctgaccacctgatcaaagacctgttcggggacaaagagttcttgcctcagtccgccttcctgaaatggttaggcactcacgtgtgcacgcacgtgattctcaaagagctgtgcgggaatctttgttttctcctgtgcggatttaatgagagaaatcttaatatgtcgcgggtggacgtctacacgactcactctcccgctggtaccagtgtccagaacatgctgcactggagtcaggccgtgaaattccagaagtttcaggcctttgactggggatccagcgccaaaaactattttcactacaaccagtcatatcctccgacatacaatgtgaaagatatgttggtaccaacagctgtttggtctggaggccatgactggctagcagatgtgtacgacgttaatatactgctgacacagattactaacctggtgtttcacgaatctattccagagtgggagcacctggactttatttggggactggatgctccttggcggttgtacaataagatcattaacttaatgaggaaatatcagtag

SEQ ID NO: 4514 - DNA, 1206 bp, Artificial Sequence
  Description of Artificial Sequence: Synthetic coding sequence
atggcatgcttggaattcgtcccattcgatgtccagatgtgtctggagttcctgccaagtggcgagttcgtggtcctccttacttctggagtccagttacagacattcaccgtatccgtaacagaccttaagggaggcgcatccggggtggtgcgttcatcgagatgggtacggggatttacggattttcgttctaaggcggtcgatctctgtgggccaaagccagtagtgtttctgcaacatggattattagcagacagcagcaattgggtaaccaatctcgccaattcttcccttggattcattcttgccgatgctggatttgacgtttggatgggcaattctaggggcaatacttggagtcgcaagcacaaaaccctctccgtctcccaggacgagttttgggccttcagagtgcccttcctggattactcgtacgacgaaatggcaaaatatgatcttcccgcttcgatcaattttatcctgaataagactgggcaggagcaggtgtattatgtcggccactcccagggaacaactattggcttcattgctttctctcagatccccgagctggctaaaaggatcaagatgtttttcgctctgggccctgttgcatctgtcgccttctgcaccagccccatggctaaactgggcagactgccggatcatttgattaaagacctgtttggggacaaggagttccttcctcagagcgcttttcttaagtggttggggacacacgtatgtacgcatgtcatcctgaaagaattgtgtgggaatctctgcttcctgctgtgcgggtttaatgagcgaaatctcaatatgtcgcgagtggacgtctataccacacactcccccgcaggtaccagcgttcagaacatgctacactggagccaggccgtaaaatttcagaaattccaggctttcgattgggggtcttcagccaagaactactttcattataatcagagctacccaccgacctacaacgttaaagatatgcttgtgccaactgcagtgtggagcggcggacacgattggctggctgatgtgtatgacgtgaacattctgttaacacaaataaccaacctcgtctttcatgaaagcattcctgagtgggaacaccttgactttatctggggcctggatgctccatggaggttgtacaacaaaattattaaccttatgcggaaataccagtag

SEQ ID NO: 4515 - DNA, 873 bp, Artificial Sequence
  Description of Artificial Sequence: Synthetic coding sequence
atgaagatgcgctttctgggactggtggtatgcttagttctttggacactccacagtgagggatcaggcggaaaattgaccgcggtggaccctgagacgaatatgaatgtgtccgagatcattagctactggggcttcccaagtgaagagtacctggtcgaaactgaagacggatatatcctatgtctcaatcgcatcccacatgggagaaagaatcactctgacaaaggcccaaagccagtcgtattcctgcagcacggcttgctcgcagattccagcaattgggtgaccaacctggccaattcctctctgggatttattctcgctgatgccggtttcgatgtctggatgggcaacagccgtgggaacacatggtccaggaagcataagactcttagcgtgagccaagatgagttctgggcttttagttacgatgagatggctaaatacgacctacccgcaagtatcaatttcatactgaataaaacagggcaggaacaggtttattacgtcggacactctcagggcaccactataggctttatcgcattttcccaaatccccgaacttgccaaaaggataaaaatgttctttgcgctggggcctgtagcctcagtggctttctgcacttctccaatggctaagctcggcaggttgcccgaccacctgatcaaggatctgttcggagataaagaatttcttccccagtccgcattcctgaaatggctaggcacccacgtttgtacgcacgtaattctcaaggagttatgcggaaacctctgcttcctgctctgcgggttcaacgagcggaatctcaatatgtcacgggtggacgtctatactacccactcgcccgctggaaccagcgtatag

SEQ ID NO: 4516 - DNA, 1200 bp, Artificial Sequence
  Description of Artificial Sequence: Synthetic coding sequence
atgaagatgcggtttctgggactggtcgtgtgtcttgttctgtggacgctacattcagagggcagcggcggaaagttaactgccgtggatccagaaaccaacatgaatgtgagtgaaataattagttattggggatttccctctgaggagtacctggtcgaaaccgaagacgggtatatcctctgtctcaatagaatccctcatggcagaaagaatcattcggataaggggccaaaacccgttgtttttctccagcacggattattggctgactcaagcaattgggttacgaatctcgccaacagttccttgggcttcatcttggctgatgccggtttcgacgtctggatgggcaattcccggggaaacacatggagccgaaagcacaaaacccttagcgtgagccaggacgagttctgggctttctcttatgacgagatggcaaagtacgatctgccagcctccataaactttatcttaaacaagacgggtcaggagcaggtgtattacgtcgggcattcgcagggcactaccattgggtttatcgctttttcccaaattcctgaacttgccaaaagaataaagatgtttttcgccctgggcccagtcgccagtgtggctttttgtactagtccaatggctaagctggggcgtctcccggatcacctcataaaggacctgttcggcgacaaagagttcctgccccagtcagcctttctcaaatggctgggaacccatgtctgtacacatgtgatcctgaaagagctatgcggaaatctctgttttctgctctgtggcttcaatgagaggaatcttaacatgagcagagtcgatgtctacacaacacactcacctgcgggaactagcgtgcagaacatgcttcactggtcccaggccgtcaaattccagaaattccaggcattcgattggggctcaagtgccaagaattacttccactacaatcagtcctatcctcccacctacaacgtcaaggatatgttggttcccaccgctgtgtggtcagggggtcatgactggctggccgatgtttacgacgtaaacatccttctgacacagattactaatcttgtttttcacgaatcaattccggagtgggagcacctggattttatctggggcctcgatgctccttggagactctacaacaaaatcattaatctgatgcgaaagtaccagtag

SEQ ID NO: 4517 - DNA, 87 bp, Artificial Sequence
  Description of Artificial Sequence: Synthetic coding sequence
ttgtgctttttgctctgtgggtttaacgagcgcaacctgaacatggccgtcaaattccagaagttccaggccttcgactggggttag

SEQ ID NO: 4518 - DNA, 1200 bp, Artificial Sequence
  Description of Artificial Sequence: Synthetic coding sequence
atgaaaatgcgttttcttggactcgtggtgtgcttggtcctgtggaccctgcacagcgaaggctcgggcggtaaactgactgctgtagatcctgagactaacatgaacgtgagcgaaattatctcttactggggcttccctagcgaagagtatctggtagagacagaagacgggtacatcctgtgcctgaatcggatccctcatggcagaaaaaatcattctgacaagggacctaagccagtggttttcctgcagcacgggctgctcgccgactctagcaactgggtcaccaacctagccaatagttctctgggctttattctcgcagatgcgggtttcgacgtgtggatgggcaactcccgtgggaatacctggagcaggaagcataagactttatcagtgtctcaggacgaattctgggcctttagttatgacgaaatggccaaatacgatctacctgcctcgatcaattttatactcaataaaacgggccaggagcaggtatattatgtggggcatagccagggcaccaccattggctttatcgccttctcccagatcccggaattagctaagagaataaagatgttttttgctttgggcccagttgcttccgtggccttttgcaccagtcccatggccaaacttggccgactgcccgaccacctgattaaagacttattcggggataaagagttcctgcctcaaagtgcgttcctcaagtggctgggcacacacgtgtgcacccatgtgatcttgaaggagctatgtggtaatctgtgtttccttctgtgcgggttcaacgagaggaacctgaacatgtcgcgcgtggatgtatacactacccatagccccgcaggtaccagtgtccagaatatgcttcactggtcccaggccgtcaagtttcaaaaatttcaggcctttgactgggggagctcagcgaagaattattttcactacaatcagagttaccctcctacttacaacgtgaaggatatgctggtgccaactgctgtgtggagtggaggccacgattggttggcagacgtgtatgacgtcaacatcctgctaacccagattaccaacctcgtgtttcatgaatctatcccagagtgggagcacctcgactttatctggggcctggacgcgccttggcggctgtataacaagatcatcaacctcatgagaaagtatcagtag

SEQ ID NO: 4519 - DNA, 411 bp, Artificial Sequence
  Description of Artificial Sequence: Synthetic coding sequence
atgaaaatgaggtttcttgggctcgtggtgtgtctcgtactgtggacactgcattcggaaggttctggcggaaaactgactgccgtggacccagagaccaacatgaacgttagcgagattatcagctactggggttttccttcagaagagtatctggtggagacggaagacggttacatcctctgtttgaatcggataccacatgggcgtaaaaaccacagcgacaaaggaccaaagccagttgtatttctgcaacacggcctgttggccgacagtagtaattgggtgactaacctggccaattcctctttaggatttatcctagccgatgccggtttcgacgtgtggatgggcaactccaggggcaacacctggtctcggaagcacgtcacactagaacctggctgctag

SEQ ID NO: 4520 - DNA, 1428 bp, Artificial Sequence
  Description of Artificial Sequence: Synthetic coding sequence
atggagtctaaggccctccttgtacttacactggctgtgtggcttcagtccctgacagcttccaggggtggcgttgctgcagcagatcagcgacgggattttattgacattgagagtaaatttgccctgcgtactcccgaggatacagccgaagatacctgtcatttgatccctggagtcgccgagagcgtggctacctgtcatttcaaccattctagcaaaacatttatggtgatacacgggtggacagtcacaggaatgtatgagagctgggtgcccaaattagtggctgctctgtacaagagggaacctgactctaacgtcattgtcgtagattggctgtcccgggctcaagagcattaccccgtgtctgccggttataccaagctggtcggccaggatgttgctcgcttcataaattggatggaggaagagttcaattaccctctggataacgttcacctgctagggtactcactaggggctcacgctgctggaatcgcgggatcgttgaccaacaaaaaagtcaaccgaatcaccggcctcgaccctgcaggcccaaattttgagtatgccgaagccccaagcagactgtcccccgacgatgcggacttcgtggatgtgctgcacacgtttacaagaggaagcccagggagaagcatcggcatccagaagccagtgggacatgtggacatttacccaaacggcggtactttccagccagggtgtaatataggggaggccatacgggtgatcgccgaacgcggtctgggggatgtggaccagttagtgaaatgttcccatgaacgtagcatccatttatttatcgattccctcctgaacgaggagaaccccagcaaggcataccggtgctccagtaaggaggcgtttgaaaaggggctttgtctgagctgtcgaaagaataggtgcaacaatttgggatacgagatcaataaagtcagggcaaagcgttctagcaagatgtaccttaaaactagaagccagatgccttataaggtgtttcattatcaagttaagatccacttctctggaacagaatcggagacacacaccaatcaagcttttgaaatttctctttatggtacagtcgctgaaagcgaaaatattcctttcaccctgcccgaggtcagtaccaataaaacctattcctttctgatctatacagaagtcgacattggagagctgctgatgctgaagctcaagtggaaatcagacagctacttctcctggagcgattggtggagcagccccggattcgccattcagaagatcagagtcaaggccggtgaaacccagaaaaaagtgatcttttgttccagagagaaagtcagtcacttgcagaagggaaaagcccctgcggtcttcgtaaaatgtcacgataagagcctgaacaaaaaaagtgggtag

SEQ ID NO: 4521 - DNA, 348 bp, Artificial Sequence
  Description of Artificial Sequence: Synthetic coding sequence
atggttattcacggatggactgtgactggtatgtacgagtcatgggttcccaaactcgtcgcggcactgtacaagcgagagccagattcaaacgtgatcgttgtggattggctgagcagggctcaagagcattaccccgtttctgctggctacaccaaacttgtcggccaagatgtagcgaggtttatcaactggatggaggaggaatttaactaccctttggacaatgtccaccttctgggctactctttaggcgcacatgcagccggaattgccggaagcctcaccaataagaaggttaacaggatcaccggcttggaccccgctgggccaaattttgaatactag

SEQ ID NO: 4522 - DNA, 321 bp, Artificial Sequence
  Description of Artificial Sequence: Synthetic coding sequence
atggagagcaaggcactcctcgtcttgactctggccgtgtggctgcagtccctcaccgccagtcggggtggggttgcagccgctgaccagcgtcgcgactttattgacatcgaatcaaagttcgcccttcgcacccccgaagacacagctgaggacacctgccatctgatacccggagtagctgagagtgtcgccacttgtcacttcaatcactccagcaagactttcatggtgatccacggatggacggtaaccggaatgtatgagagctgggtgcccaagttagtagccgcactgtacaagagagagccggattcctag

SEQ ID NO: 4523 - DNA, 393 bp, Artificial Sequence
  Description of Artificial Sequence: Synthetic coding sequence
atggaaagcaaagccctgcttgtgctgactctggccgtgtggttgcagagtctgaccgcctccaggggcggtgttgcagcggcagaccaaaggagagactttattgatatcgaatcaaaatttgctctgagaactccagaggataccgccgaggacacctgccaccttattccgggtgtcgccgaatccgtggccacttgccacttcaaccatagttcaaagactttcatggtgatacacggctggactgtcacaggcatgtacgagagttgggtgccaaagctggtcgctgcactgtataagagggagcccgactccaacgtcattgtggtggactggctgtctcgggcacaggagcattatcccgtttctgctgggtacaccaaactctag

SEQ ID NO: 4524 - DNA, 1386 bp, Artificial Sequence
  Description of Artificial Sequence: Synthetic coding sequence
atggaatccaaagcactgctggtgctgacgctggccgctgcagatcagcgccgtgactttatcgatatagagtccaaatttgctctgcgcacccctgaggatactgcggaggacacctgccatctgataccaggagtggccgagagcgtggctacctgccactttaaccatagctctaagacttttatggtcatccacggatggacagtgaccggcatgtatgaaagttgggttccaaaattggttgccgctttgtacaaacgggaacccgattctaacgtgatcgttgttgactggctctcaagggctcaggaacactaccccgtgtccgcagggtatacgaagttggtgggacaagatgttgctagatttataaactggatggaggaggagtttaattaccccctggataacgtccatttattggggtattctttaggggcacacgctgcgggtatcgctgggtccttaaccaataagaaggtgaaccggatcaccggattggatccagccggaccgaacttcgagtacgcggaagctccatccaggctgtcacctgacgatgctgactttgtggacgttctccataccttcacacgcggaagcccgggtcggtcaatcggaattcagaagcctgtcggccacgtggatatctatccaaacgggggaacctttcagcccggatgtaacatcggggaggccatcagagttatcgccgaacgcggactgggggatgtggatcagctggtgaagtgtagccatgagcggagtatacatctgtttattgactctctgctaaatgaagagaatccatccaaagcatatcggtgtagcagtaaggaagcctttgagaagggcctgtgtttgagctgtcgcaaaaaccgttgcaacaacctcggatatgagattaacaaagtccgcgctaaaaggtctagtaagatgtatctcaaaacgagaagtcagatgccttacaaggtgttccattaccaagtgaaaatacacttcagcggaactgagtctgagacccacacaaaccaggcgttcgaaatcagcctctacggcacggtcgctgaatctgagaacatccccttcactctgcctgaagtctcaacaaacaagacatactccttcctcatttacacggaggtggacattggagaactgctgatgctgaagctgaaatggaaatcagacagctatttcagctggtctgattggtggtcttcaccaggctttgccattcagaaaattagggttaaggccggtgagacacagaagaaagtcattttttgctcgcgcgagaaagtttctcacctccaaaaaggcaaggctcctgctgtgtttgtcaaatgccacgacaagagcttaaataagaaatctggctag

SEQ ID NO: 4525 - DNA, 828 bp, Artificial Sequence
  Description of Artificial Sequence: Synthetic coding sequence
atggttattcatgggtggaccgtcactgggatgtatgaaagctgggtgccgaaacttgtcgcagccttatacaagagagaaccggattccaacgttatagtggtcgactggctatctcgtgcccaggaacattaccctgtgtccgcaggttatactaagctggttggacaggacgtggcccgattcatcaactggatggaggaggaattcaactatccactggacaacgtgcacctactgggatactccctgggtgcccacgccgctggaattgcaggatctctgacaaataagaaagttaacagaattaccggcctggatccagcaggacccaacttcgagtacgcggaagcaccatctcggctgagccccgatgacgcagatttcgtggacgttctgcatacctttacaaggggaagtccagggcgttctattggcattcagaaaccggtcggtcatgtggacatttatccaaacggcggtacgtttcagccaggctgtaacatcggcgaggctatccgagtgattgcagaaagaggcttgggagatgtggatcagttggtaaagtgctcccacgagcgctctatccacctttttatcgactctctgctcaacgaggaaaaccccagcaaagcttatcgctgctcttctaaggaagcgttcgaaaaggggctctgcttgagttgccgcaagaatcggtgtaataatttgggttatgaaatcaacaaagtgcgagccaagaggtctagcaaaatgtatgaggattcattttcagatgcactgcaaagcctgcctctgccttctaaggactccttcttctgggactag

SEQ ID NO: 4526 - DNA, 2079 bp, Artificial Sequence
  Description of Artificial Sequence: Synthetic coding sequence
atgggcccttggggctggaagctcaggtggactgtcgccctcctgctggcagctgccggaaccgctgtgggagatcggtgtgagcgcaacgaattccaatgtcaagatggcaaatgtatcagctacaagtgggtgtgtgatggctcagctgagtgtcaggacggcagcgacgagagccaggagacatgcctgtccgtcacttgcaagagtggagatttttcctgcggcggacgggtgaacaggtgcatccctcagttctggagatgcgatggccaagtggattgcgacaatggaagtgacgagcagggatgtctgaccctgtgcgaaggccctaataagtttaaatgccacagcggggagtgtattaccctggataaagtgtgcaacatggcacgagactgtcgggactggagcgacgaacccataaaggaatgtggcaccaacgaatgcctggacaacaatggtggctgttcccacgtctgtaatgacctaaagattggctacgaatgcctgtgccctgatgggttccagttggtggcccaacgcagatgtgaggatatagacgagtgtcaggaccccgacacctgctcccaactctgcgtcaacttggagggcggatataagtgtcagtgtgaagagggcttccaactcgacccacatacaaaggcttgcaaggccgtgggcagcatcgcctatctctttttcactaatcgacacgaagtgcggaagatgacgttagatcgatcggaatacaccagcttgatacccaaccttcggaacgtggtggccttagatacagaggtggcatccaacagaatctactggtccgatctgagtcagagaatgatctgtagcacgcaactcgatcgcgcacacggcgtgtcatcttatgatactgtcattagtcgcgatatacaggccccagacggccttgccgtcgactggatccactcaaatatctattggaccgacagtgtgcttggcaccgtgagtgtggccgacacaaaaggggtgaagcgaaagaccttatttcgggaaaacgggtctaagccgagggctatcgtcgtcgatcccgtgcacggcttcatgtactggactgattggggcacacctgcaaaaattaagaaaggaggactgaatggcgttgacatttactcactggtgactgaaaacatccagtggcctaacggcataaccctggatctactgagcggcaggttatactgggtcgattcaaagctgcactcaatcagtagtattgatgtaaatggtggaaatcgcaaaaccatcctggaagatgagaagaggcttgcccatccttttagcctggccgtgtttgaggataaggtgttctggacagatataataaacgaggcaatcttctctgccaacaggctgaccgggtccgatgtgaacctcttagcagagaatctcctgtcacccgaggacatggtgctatttcataacttaacacagcccaggggagtcaactggtgtgagcggaccactctcagcaacggaggatgccagtatctctgtctccccgctccgcaaattaatccacattctcctaagttcacatgcgcatgcccggatggaatgctgctggccagggatatgaggtcctgtttgactgaagccgaagctgccgtggcaacccaggagactagcaccgtgcgtctcaaggtttcttccacggcagtacggacgcaacatactaccacgcggcctgtgccggatacgtcacgcctgccaggtgccacgcctgggctcactactgtggaaatcgtcactatgagccatcaggcgttaggggatgtggcgggtcggggaaatgagaagaagccaagctccgtgagagcactttctattgtcttacccattgttctgctagtgttcctgtgcttaggtgtgtttctcctgtggaagaattggcgtctgaaaaacattaactccattaactttgataatcctgtgtatcaaaaaacaacagaggatgaagtgcacatttgccataaccaggatggctacagttatcctagcagacaaatggtatccctggaggacgacgtggcctag

SEQ ID NO: 4527 - DNA, 2460 bp, Artificial Sequence
  Description of Artificial Sequence: Synthetic coding sequence
atgggaccgtggggctggaaactgaggtggaccgtggctctgcttctggccgcagccggaacagccgtgggcgaccgctgcgagaggaacgagttccagtgccaggacgggaagtgcataagttataaatgggtctgcgacgggagtgcagaatgtcaggatggttcggatgaaagtcaggagacttgttctcccaaaacatgtagccaggacgagtttaggtgccacgatggcaaatgcatctcgaggcagtttgtgtgcgactccgaccgcgattgtttggatgggagtgacgaggcctcttgccctgttctgacttgtgggccagcctccttccagtgcaattctagcacctgcatcccccaactgtgggcctgcgacaatgatccagactgtgaggatggcagtgacgagtggccacaacggtgtcgcggtctgtacgtcttccagggcgactcctcaccctgctcagcgtttgaattccactgtctctctggtgagtgcattcactccagttggagatgcgatgggggacccgattgcaaggataaatccgatgaggagaattgtgccgtggctacttgccggccagacgagttccaatgctcagacggaaactgcatccacggatcccgccagtgcgaccgggagtacgactgtaaagatatgtcggatgaagtgggatgtgtgaacgtgacgctgtgcgagggcccaaataaattcaaatgccattccggtgagtgcatcacattagataaagtgtgcaacatggccagagattgtcgtgattggagcgatgaacccataaaggaatgtgggaccaacgaatgcctagataataatggtggttgttcccacgtctgtaacgatctaaagatcggttacgagtgcctgtgtccagacgggtttcagttagttgcacaacgcagatgtgaggacatcgacgaatgtcaggaccccgatacctgttcacaactctgtgtcaacctggaaggcggatataagtgccagtgtgaggagggttttcagctcgatcctcacactaaggcatgtaaagcagtgggaagcatcgcgtatctttttttcaccaaccgtcatgaggtgaggaagatgacactcgatagatcggaatacacgtccctcattccaaacctaaggaatgtggtggccttagataccgaggtggccagcaatcgtatctattggtctgatctgtcacagcggatgatttgctctacgcaactggacagagcacacggagtgtcctcatacgacaccgttattagtcgcgacattcaggctcctgacggtctggccgtcgactggatacacagcaatatttattggacagactcagttctgggcactgtaagcgtggccgacacaaaaggggtaaaacggaagaccttgtttcgggaaaacggtagtaaaccccgtgctatagtcgttgatcccgtccacggcttcatgtactggactgactgggggactcctgctaagatcaaaaaaggcggattaaatggagtagatatctactctctagtaacagagaacattcaatggcccaacgggatcaccctggacctgttgtcgggtcgtctgtactgggtggattctaagctgcatagcatctccagcattgatgtgaacggaggtaacagaaagaccatcttggaagacgagaagaggctcgctcacccattcagcctggctgtctttgaagataaagtattctggactgacataattaacgaagcgattttcagtgccaacaggcttacgggatctgatgtcaatctgctggccgagaacctgctctcccctgaggacatggtgctgtttcataatctcactcaacctaggggggtgaactggtgtgagaggaccaccttatccaatggcggttgtcaatacttgtgtctgcccgcaccgcagatcaatccgcactcacctaagttcacttgtgcctgccccgacggaatgttgcttgcgagggatatgagatcctgccttaccgaggctgaggccgcagtcgctacacaagaaacatcgacggtaaggttaaaggtgagtagtaccgcagtcaggacccaacacaccacgacgcgccctgttcctgatacctcccgtctgccaggggcaaccccaggcctcaccaccgtcgaaattgtgaccatgtcccaccaagcactcggtgatgtggccggacgaggtaacgaaaagaagccctcaagtgtcagagcactgtcgatcgtgctgcctattgtcctgctcgtgttcctgtgtctgggggtcttcctgctctggaaaaattggagattgaagaacatcaattctatcaacttcgacaatcctgtctaccagaaaacaacagaagacgaggttcacatctgccataatcaagacggttatagttatcctagcagacagatggtcagtcttgaggatgacgtcgcctag

SEQ ID NO: 4528 - DNA, 2049 bp, Artificial Sequence
  Description of Artificial Sequence: Synthetic coding sequence
atgggcccttggggctggaaactacgctggaccgtggccctgctgctcgctgccgcagggaccgcagtgggtgatcggtgtgagcgcaatgaatttcagtgccaggacggaaaatgtatttcatacaagtgggtttgtgacggcagcgccgagtgtcaggatggaagcgatgagtctcaggaaacctgcctatccgtgacatgtaagtcaggggatttctcctgtggcggacgggttaatcggtgcataccccagttttggcgttgcgatgggcaggtggattgcgacaacggcagtgacgaacaaggctgtcccgttgccacatgcaggcctgacgaatttcagtgcagcgatggaaactgcattcacggatcccgccagtgcgatcgcgaatacgactgcaaggatatgagcgatgaagtcggatgtgtgaatgtaactctgtgcgagggtccaaataaatttaagtgtcatagcggcgagtgtatcaccctcgataaagtttgtaatatggcgcgtgattgcagagattggagcgacgagcctattaaggagtgcggaacaaatgagtgcctggataacaatggaggctgctcacatgtgtgcaatgacctcaagattggctacgagtgcctgtgcccagatggtttccaactggtagcgcagagaaggtgcgaagacatcgacgaatgtcaagaccctgacacctgctcccaactgtgcgttaatctggagggcggatacaagtgccagtgcgaggaaggctttcaactggaccctcatacaaaggcatgtaaggcggtaggcagcatcgcttatctgtttttcaccaaccgtcacgaagttcggaaaatgaccctcgaccgatccgagtacaccagcctaatccccaatctcagaaatgtggtcgctctggacaccgaggtcgcatcaaataggatttactggagcgatctgagccagcgcatgatctgctctactcagctggatcgggctcatggggtatcctcgtatgatacagtcatctcgcgagatattcaggcgcctgacggccttgctgttgactggatacacagcaacatatactggactgatagcgtgctgggcaccgtgagtgtggccgatacgaagggtgtgaagaggaaaacactgtttagagagaacggtagcaaacctcgcgctatcgtcgtggacccagtgcatggattcatgtattggaccgactgggggacccccgctaaaatcaagaaaggaggactcaacggcgtggacatctacagcttggttactgaaaatatccagtggcccaacggcatcaccctggatctgttaagtggccgtctgtactgggttgactctaaactccatagcatatcttccatcgacgttaatggtggcaatagaaagacaatcctggaggacgaaaagcggcttgctcatcccttttccctcgccgtgttcgaggacaaggttttttggacggatatcattaatgaagctatcttctccgccaatcgtcttacggggtccgacgttaaccttctcgcagaaaatctgctgtcaccagaagacatggtgctgtttcacaatctcacacaacccagagaagccgaagccgcagttgccacgcaggaaacctctacagttcgtttgaaagtttcctctaccgccgtgcgcactcagcacacaaccacaagacccgtgccggacacttcacgactgccaggcgctactccaggacttacaacagtggagatcgtcaccatgtcccatcaggccctgggcgatgttgccggtcgcggaaatgagaaaaaaccaagctccgtccgagcactatctatcgtgcttcccatcgtgctgctggtgtttctgtgtctgggcgttttcctcctgtggaagaactggagactgaagaacatcaacagtattaacttcgataacccggtctaccagaaaaccaccgaggatgaggtgcacatttgccacaaccaagacggatactcttacccaagtcgccaaatggtgtctctggaagacgacgtcgcgtag

SEQ ID NO: 4529 - DNA, 2577 bp, Artificial Sequence
  Description of Artificial Sequence: Synthetic coding sequence
atgggaccctgggggtggaaacttagatggactgttgctctcctgctcgccgcagctggaaccgctgttggagacagatgcgaacggaacgaatttcagtgccaggacgggaagtgtatctcttacaagtgggtctgcgatggctccgcagagtgccaggatggatccgatgagagccaggagacctgcttgtcagtcacgtgtaagagcggtgacttctcatgtgggggacgggtaaaccgctgtatacctcagttctggcggtgcgacggccaagtagattgcgacaatggcagtgacgaacaaggctgccccccaaaaacctgcagccaagatgaatttcggtgccatgacggtaagtgcatttcgagacagtttgtgtgtgacagtgacagagactgtctggatggttctgacgaagcctcctgcccggtcctgacatgcggaccggcatcgtttcaatgtaatagttctacatgcataccgcagctatgggcttgcgacaacgatcctgattgcgaagacggttccgacgagtggcctcagcgatgtcgaggactgtacgtattccagggagactctagtccatgttccgcttttgaatttcactgtttgagtggggaatgcattcatagctcttggagatgtgatggaggcccagattgcaaggataagagcgacgaggagaattgtgctgtggctacctgccgacctgatgagttccagtgttcggatggaaattgcattcacggaagcagacaatgcgaccgcgagtatgactgtaaggatatgagcgacgaggtggggtgcgtcaacgtaaccctttgtgagggccctaataaattcaagtgccattccggcgagtgtatcaccctggacaaggtgtgtaacatggcccgagactgcagggattggtctgatgaacctatcaaggagtgcggaaccaacgaatgcctggataacaacggaggctgcagccacgtttgtaacgacctgaagatcggctacgagtgtttgtgccccgacgggttccaactcgttgcccaaagaagatgcgaggatattgatgaatgtcaggatcccgatacctgttctcagctgtgtgtgaatctggagggaggatacaagtgccagtgcgaagaagggtttcaactcgacccccatacaaaggcgtgtaaggcagtcggcagtatcgcctatctttttttcactaataggcatgaagtgcgaaaaatgaccctagaccggagcgagtacacctcgctgatccctaatttacgtaacgtcgttgcccttgacaccgaggtcgcatccaacaggatctattggagcgatcttagccagcgaatgatttgtagcacgcaactggatagggctcacggagtcagtagttacgacactgtgatcagtcgagatattcaggccccagatggccttgccgtggattggattcattccaacatatactggaccgactcagtgttggggactgtgagcgtggctgacactaaaggagtcaagcgcaagacactattcagagaaaacgggtctaagccgagagctatagtggttgatcctgttcatgggttcatgtactggacggactggggcactccggcaaagatcaagaagggaggacttaatggagtggatatatattcactggtaacggagaacatacagtggcccaatggcatcactcttgatttactctccgggcgtctgtactgggtcgatagcaagctgcattccattagtagtatcgacgtgaatggtggcaatagaaagactattttagaagatgaaaagcgcctcgcccatccgtttagcttggctgtgtttgaggacaaggtcttctggacagacattattaacgaggccattttttccgcaaatcgtctcaccggcagcgatgtgaacctcctggccgagaaccttttgagccccgaggatatggtcctgttccataatctgactcagcctcgaggagttaattggtgcgaacgtactacacttagtaacggcggttgccaatatctgtgcctcccagctccacagattaatccacactcacctaaattcacatgcgcctgtccagacggtatgttactagccagagatatgagatcttgccttaccgaggccgaggccgctgttgctacccaagagacctcaaccgtgaggctaaaggtttctagtactgctgtgaggactcagcataccaccacccggccagtcccagacactagtcggctgcccggagcaaccccagggctgacaaccgttgagatcgttaccatgtcccaccaggcacttggagacgttgcgggacgagggaatgagaaaaagccgagtagtgttagggctctcagcattgttctgcccattgtgctcttggtgttcttgtgcctgggcgtattcctgttgtggaaaaactggcgactaaaaaatattaatagcattaactttgacaatccagtctaccagaagactactgaagatgaggtccacatctgccataatcaggatggctattcttatccttccatggtgtccctggaggacgacgtcgcttag

SEQ ID NO: 4530 - DNA, 2583 bp, Artificial Sequence
  Description of Artificial Sequence: Synthetic coding sequence
atgggaccctgggggtggaaactgcgctggactgtcgccctgctgttagccgctgctgggaccgcagtaggcgatcgatgtgaacggaatgaatttcagtgccaggacggtaaatgtatctcctataagtgggtctgcgatggtagcgccgaatgtcaagacgggagtgatgaatctcaggagacttgtttatctgtgacatgcaagtccggcgacttttcttgtggcggaagagtgaaccggtgtatcccccagttctggaggtgcgatggacaggtagattgcgataacgggtcggatgaacagggctgtcctcccaagacatgtagccaggatgaattccgatgccacgacggcaagtgtatttcacggcagtttgtgtgtgactctgatcgcgattgtcttgatggttctgacgaagcaagctgccccgtgctaacttgcggccctgcaagtttccagtgcaattcctctacatgtatcccccagctgtgggcttgtgataacgatccagactgtgaggacggatctgatgaatggccccagcgatgtagggggctgtacgtgtttcagggtgattcaagtccatgctctgcgtttgaattccattgccttagtggtgagtgcatccactcatcgtggcggtgtgacgggggaccagattgcaaggataagtcggatgaggaaaactgtgccgtggcaacttgccgtcccgatgaatttcagtgtagcgatggaaactgcattcatggatccaggcagtgtgatcgcgaatacgactgcaaagacatgagtgatgaggtgggttgtgtcaacgtgactctttgcgagggtccaaataagtttaaatgccattccggcgagtgtataacactggataaagtgtgcaacatggcacgggactgccgcgattggtccgatgagccaattaaggagtgcggcaccaatgagtgtctcgacaacaacggaggttgttcccatgtctgcaacgacctcaagataggttacgaatgtttatgccctgatggctttcagctggtggcacagcgaaggtgcgaagacatcgatgagtgtcaagaccctgacacctgcagccaactgtgtgttaacctcgaaggaggctacaagtgtcagtgcgaagaggggttccagctggaccctcacacaaaggcctgcaaggccgtgggaagtatcgcgtatttgtttttcactaaccgccacgaggtgcggaagatgactctcgaccgtagcgagtatacttcattgatccccaacctcaggaacgtagtcgccttagatactgaagttgcttccaacagaatatactggagtgatctttcacagcgtatgatttgcagcacgcagttagatcgtgcacacggagtgagctcatacgatactgtgatcagtcgtgatatccaggccccagacggactagcggtggactggatccattcaaacatctattggacagacagtgtgttaggcacggtcagcgttgctgacaccaaaggcgtcaagaggaagactttgttccgcgaaaacggaagcaaaccgagggctatcgtggttgaccccgtgcatggtttcatgtattggacggactggggaacccctgctaagatcaagaaagggggactgaacggcgtggacatctatagtttggtaaccgaaaacattcagtggccaaatggcattacgctcgatcttctgtccggccgattatattgggtggattccaagctgcattctatttcaagcattgatgtcaatggtggtaatcgcaagactatcctggaggacgaaaagaggctggcacatccctttagcctggccgtgtttgaggataaggtcttttggacagacatcattaatgaggcgatcttcagcgctaatcgcctgactggatcagatgtcaacctgctagccgagaacctcctgtctcccgaagacatggtactgtttcacaacctgacccaacctagaggcgtgaactggtgtgagcgcaccacgctctccaacgggggatgccagtacctgtgtcttccagctccgcagatcaaccctcattctcccaaattcacatgcgcgtgccccgacggcatgttactcgcccgagatatgagatcttgtctgaccgaggccgaggctgccgtcgccacccaagagacatctaccgtgcgactgaaggtgtcttctacagcggtgcggacacagcacacaacaacgagacccgtgcccgatacctccagattgcccggagcaacccccggtctgacaaccgtagagatcgtgacaatgtcccaccaggccctgggagacgtggctggcagaggaaacgaaaagaagcctagtagtgttcgtgccctgtccatcgtccttccaattgttctgctggtattcctctgtctcggggtgtttctgctttggaaaaactggaggctgaagaatataaactccattaattttgataatccagtctatcagaagaccactgaggacgaagtccacatctgccataaccaggatggctattcctaccctagcagacaaatggtgtctctggaagatgatgtggcttag

SEQ ID NO: 4531 - DNA, 2220 bp, Artificial Sequence
  Description of Artificial Sequence: Synthetic coding sequence
atgggaccttgggggtggaagctgcggtggactgttgccctcctactggccgctgctgggactgccgtaggtgacagatgcgagcgaaacgactttcagtgcaattcatccacttgtataccccagctttgggcatgcgataatgacccagattgcgaagatgggagtgacgagtggccacaacgatgcaggggcttgtacgtgttccagggagacagcagcccctgctccgccttcgagtttcattgcttgagtggcgagtgcatccactccagctggagatgtgacggaggtccggactgcaaggacaaaagtgacgaagaaaactgtgcagtggccacatgccggccagacgaattccagtgctcggatggtaattgcatccacggaagcagacaatgtgaccgggagtacgactgcaaggatatgtctgatgaagtgggttgcgtgaacgtcactctgtgtgaaggacctaacaagtttaagtgccattcaggggagtgcattacccttgataaggtgtgcaatatggctcgggactgtagagactggtccgacgagccgatcaaggagtgtggcacaaatgagtgcctcgataataacggcggatgcagtcacgtatgcaatgacctgaaaatcgggtacgagtgcctgtgtccagatggcttccagttagtcgcacaacgtcgatgtgaggatatcgacgagtgccaggatccagacacgtgctctcagttatgtgttaatttggagggcggttacaagtgccaatgcgaggagggtttccagctggatccccatacgaaggcatgtaaggcagtggggagcatagcctacctgttctttactaatcggcacgaagtgcggaagatgaccttggacagatcagagtacacatcactgattcccaacctccgcaacgtggtcgcgttggatacagaggtggcatcaaaccgcatatactggtcggacctttcgcagagaatgatctgctccacccagctcgatagagcacacggagtctcttcctacgataccgtaatttccagggacattcaggccccagatggtctggcggtggattggatccactctaatatctactggacagacagcgttctcggaacagtcagcgtggccgatactaagggggtaaagagaaaaactctgtttagggagaatgggtctaaaccaagagccatagtagtggatcctgtacacggtttcatgtactggacagactggggaacacctgccaaaattaaaaagggcggattaaatggtgtcgacatctacagtctggttactgagaacatccagtggcctaatggtattactttggacctactcagcggacgcctgtactgggttgattccaaactccactccatatcttcgatagacgtgaatggagggaatagaaagaccattttggaggatgagaagagacttgcccacccattctcactcgctgtgttcgaagataaagtgttttggacagatatcattaacgaggctattttcagcgcaaatcggttaacagggtctgatgtcaacctgctggcagaaaatctcctttcgccggaagatatggtactctttcacaacctaacacagccaagaggagtaaactggtgcgagcggacgacgcttagcaacggaggttgccagtacttgtgtctccccgctccacagatcaaccctcattctccaaaattcacctgcgcatgtcccgacggcatgctgctggccagagacatgcggagctgtctgacagaagctgaagcggcagtggccacccaagagacctcgactgttaggttgaaagtatcttctacggctgtgaggacacagcacaccaccaccaggcctgtaccagatacttccagactacccggagctactccaggcctaacaaccgttgaaattgttacgatgtcacaccaagcacttggagacgtggctggtcgcggtaacgagaagaaaccatcctctgtgcgagccctgtcaatagtgctccccatcgtcctgctggtgttcctgtgtctgggcgttttcctactgtggaagaattggaggctcaaaaatataaattccatcaactttgacaatcctgtataccagaagactactgaggatgaagtacatatctgtcataatcaggatggatactcctaccctagccgtcagatggtttcactcgaggacgatgttgcttag

SEQ ID NO: 4532 - DNA, 2838 bp, Artificial Sequence
  Description of Artificial Sequence: Synthetic coding sequence
tgaggtaggccaggcgtacctccgaggttcttatcacaacgcagacggcaggtaccagggcctcgctctcgactaagggacattcatgaaagccctagtgtcatcctggggcctcctggagaagtacccggattccggtgtgcactgtggagacacctaaggccgcatttggtcttaggtggtgccctagcacccccagcaccaatcaagtttaccgagggtcctccagctacattaaaggcctccgttccttatgaagtagagacactgccacaaaatctgcccgcaccaccatggtcagcagccgagatcttctcgcacgtcggtgaccgttgtgagcggaacgagtttcagtgccaagacgggaagtgcatctcttataagtgggtttgcgatgggagcgccgaatgccaggatggttcagatgaatctcaggagacctgcctcagcgtaacctgcaagagcggcgacttcagctgtgggggtcgagttaacaggtgcattccacaattctggcgttgcgatgggcaagtggattgcgacaatggatccgacgagcaaggatgcccacccaagacgtgctcccaggatgagtttaggtgccatgatggaaagtgcatcagcaggcagttcgtctgcgactccgacagggactgtctggacggctccgacgaggcctcctgcccggtcctgacctgcggacccgcatcatttcagtgtaacagcagtacctgtattccgcagctctgggcttgcgataacgaccccgattgcgaagatgggtctgacgagtggccgcaaagatgtcgcggtttgtacgtctttcagggcgattctagtccctgtagcgcctttgagttccattgtctatcgggcgaatgtatccactccagttggagatgcgacgggggtcctgactgcaaggacaaatccgatgaagaaaactgtgcggtggcaacttgtaggccagatgaatttcagtgttcggatgggaattgtattcatggatcaagacagtgtgaccgggagtatgattgcaaagacatgtctgacgaagtgggttgcgttaatgttacattatgcgaaggtcccaataaattcaagtgtcactctggagagtgtattaccctcgataaagtgtgcaacatggcccgtgactgtcgggactggtcggatgagccaatcaaggagtgtggtacaaatgagtgccttgacaataacggcggatgttcccatgtgtgcaacgacttgaaaattggttatgagtgcctgtgccccgacgggttccagttggtagcacagcggaggtgcgaggatatagacgagtgccaggatcccgatacctgcagtcagctttgtgtgaacctcgaagggggttataaatgccagtgcgaggaagggtttcaacttgatccacatactaaagcatgtaaagctgtgggttctatcgcctatttgttcttcacaaaccggcatgaggtacggaaaatgacccttgaccggtccgagtatactagcctgattcccaacctcagaaatgtggtggcactagataccgaagttgctagcaacaggatctactggagtgatctcagtcagagaatgatatgcagcacacagttagatagggcacacggcgtgagttcgtacgacaccgtgatttctagagatatccaagcccctgatggactcgcagttgactggatccactcaaacatttactggaccgactccgtgctgggaacggtgagtgtggctgacacaaagggagttaagaggaaaaccctattcagggagaatggctctaaacccagggccatcgtagtggaccccgttcatggctttatgtactggactgactgggggacacctgccaagataaagaagggaggcctgaacggcgttgatatttactccctcgtgacggagaatatccagtggcccaacgggatcaccctggatctgttaagcggaaggttgtactgggtagacagcaaacttcattccatctcaagcattgacgtcaacggcggaaatagaaagactatccttgaggatgagaaacgcctcgcacacccattcagcctcgctgtctttgaagataaagttttttggaccgatatcatcaatgaagcgatcttctccgccaaccgcttaactggttctgatgttaatttgctggcggagaatctgctctctcctgaggacatggtactcttccacaatctgacccagccccgaggggttaattggtgcgaacggaccactctgtctaacggcggttgtcagtacttatgcctgcctgcgccacagataaatcctcatagccccaaatttacctgcgcttgcccagacggtatgcttctggccagggatatgaggagttgtttaactgaagcggaggccgctgtagccacccaagagaccagcacagtgcggctgaaggtgtcctccacagcagtgcggactcagcatacaacgactcggccagtgccagacacgtccagattaccaggtgccacacccggattgaccactgtcgagattgttaccatgagccatcaagctctgggggacgtggcagggaggggcaatgaaaaaaagccgtcttccgtcagagccctctcgattgtgctaccaattgtgctgctggttttcctgtgtcttggagtgtttctcctgtggaagaactggcgactgaagaacatcaactcaattaacttcgataaccccgtgtaccaaaaaactactgaggacgaagtccacatctgtcataaccaggacggctacagctatccaagtaggcagatggttagtctcgaagatgacgttgcatag

SEQ ID NO: 4533 - DNA, 1770 bp, Artificial Sequence
  Description of Artificial Sequence: Synthetic coding sequence
atgtcacgacgactgctgcccagggctgagaaacgcagacgcaggctggagcaaagacagcagcccgatgaacagcgtcggcgttccggggcaatggttaagatggccgctgcaggaggcggaggcggagggggtaggtattacggtggaggcagcgaaggtggcagagcgcctaaaagactcaaaaccgataacgctggcgatcagcacggaggcggaggcggaggcggtgggggagcgggagccgctggaggtggaggcggaggcgaaaactacgatgaccctcataagacacccgcaagcccggtggtgcatatccggggattgattgatggcgtcgtggaggccgacctcgtggaagcactccaggagttcgggccaatcagctacgtagtggtgatgccaaagaaaagacaggccttggtcgaattcgaagatgtgctcggagcctgcaacgccgtaaactacgccgctgataatcagatctatatagccggacatccagccttcgtcaattattcaacctcacagaagatatccagacctggagactctgacgactctaggtcagtgaacagcgtgctcctgttcactatcctgaatccaatctactcaatcactacagacgtcctgtatacgatctgcaatccgtgcggcccagtgcagcgcatcgtgatctttcggaagaacggtgtccaggctatggtagagttcgactctgtgcagtctgcgcagcgagccaaagcctctctaaatggggcagatatctactccgggtgttgtacattaaaaatcgaatatgccaagcccaccaggctgaatgtctttaaaaatgaccaagacacctgggattatactaatcctaatctctccgggcaaggggacccaggctcaaaccctaacaagagacagcgccaacctcctctcttgggagatcaccctgcagaatacggaggtcctcacggtggctatcacagccactatcatgacgaaggctacgggcctccaccaccccactatgagggacggcgtatgggcccacccgtgggaggacaccgtcggggaccatcgcggtacgggccacagtatgggcacccccctcctccacctcctccgccagagtacgggccacatgccgactctcccgttttaatggtgtacggcctggatcaaagtaaaatgaactgtgatcgggtgtttaacgtgttttgtttgtacggcaacgtggaaaaagttaaattcatgaaatcaaagcccggagcagctatggtcgagatggccgacggatacgccgtggatcgagccatcacccacctgaataacaatttcatgttcggacagaaactcaacgtctgtgtgtccaaacagcctgcgatcatgcctgggcagagttacggattggaggacgggagttgctcatacaaagatttcagcgagagcagaaacaataggttctccactcccgagcaggccgcaaagaaccgcatccaacacccgtccaacgtgctgcattttttcaacgctcctctggaagttacagaagagaacttcttcgagatctgcgatgaactgggggtgaaacgccctagctccgtgaaggttttcagcggaaaaagcgaacgatccagcagtggccttctcgagtgggaaagcaagtccgacgccttagagactctggggtttttgaatcactatcagatgaagaaccccaatggaccttacccttacaccttgaagctttgtttttccacagcccagcacgcttcctag

SEQ ID NO: 4534 - DNA, 540 bp, Artificial Sequence
  Description of Artificial Sequence: Synthetic coding sequence
atgggtcgtcccggattgggagccgctgttagcgatctgggagaagctgtgagtctgagtcaaggcttgttgttgttactattattgtcgatgggcggtgcgtgggcatcacgtgagcccctgcgtccatggtgtcaccctattaatgcaattctggctgtcgagaaggaaggatgtccagtctgtatcaccgtgaacactaccatctgtgctggctactgcccaactatgatgcgagtgttacaggccgtgcttccccctcttccccaggtggtgtgcacataccgggacgtcaggtttgagagcatcagactcccaggatgcccacggggagtcgaccccgtagtgagctttccggtggccctaagttgcagatgcggcccttgtagacggagtaccagcgattgcggcggacctaaagaccacccattgacgtgtgatcaccctcagcaggcctcgagctcttctaaggatcccccacgctcactcccttcgccttccaggttgctcgaacctgatacgccaatactcccgcagtag

SEQ ID NO: 4535 - DNA, 294 bp, Artificial Sequence
  Description of Artificial Sequence: Synthetic coding sequence
atgcaattgggtacagggttactgttggccgcagtgttgagtctgcagttagctgcagcggaagccatctggtgccaccagtgcaccggattcggcggatgtagccatgggtcccgctgcctgagggactccacacattgtgtgacaacagcaacgagggtcctgtcgaatacagaggatctgcccttggtaacaaagatgtgtcatataggctgtccagacatcccgtcattggggctgggcccatacgtgagcattgcttgctgccagacctccctttgtaaccacgactag

SEQ ID NO: 4536 - DNA, 2058 bp, Artificial Sequence
  Description of Artificial Sequence: Synthetic coding sequence
atgcccgcatacactcatgcgagtcccatacataacacgcacaaaccctatgagtgcaaggaatgtggtaaatactttagttgtggaagcaatctgatacagcatcagagtattcataccggtgagaaaccttacaaatgcaaagaatgtggaaaggccttccaactccacattcagctcactcggcaccagaagtttcataccggggagaagacatttgagtgcaaagaatgtggaaaggcctttaacctacccacccaactgaacagacataagaacatacatactgtcaagaaactctttgagtgcaaggaatgtggcaaatcctttaatcgaagttctaacctgacacaacaccagagcatccacgcaggagtgaagccctaccaatgcaaggaatgtggaaaagcattcaaccgtggctctaatctgattcagcaccagaagatccacagcaacgagaagccgttcgtctgcagggagtgcgaaatggcgttccggtaccactatcagcttattgagcactgccgtattcacactggcgagaagcctttcgagtgcaaagagtgtcgaaaagctttcaccctgctgactaagctggtacgtcaccagaaaatacacatgggagaaaaaccctttgaatgcagggaatgtggaaaagccttctccctcctgaatcaactgaatcgccacaagaatatccatactggagaaaaacccttcgagtgcaaggagtgcggaaagagtttcaacagaagcagcaacctgatccagcatcagagcattcatgctgatgtgaagccatacgaatgtaaagaatgtggtaagggattcaaccgaggcgctaatttaatccagcatcagaaaatccattccaacgaaaaaccttttgtgtgccgtgagtgtgagatggccttccgatatcactaccaactgatccagcattgccagatccacactggcggaaagcccttcgaatgtaaggagtgcggaaaagcattctctctgctgactcaactcgctaggcacaaaaacattcacacgggggaaaagcccttcgagtgtaaagactgcggcaaggcctttaaccgcggaagcaacctggtccaacaccaaagtatccatactggggagaaaccatatgaatgcaaagagtgcggtaaagccttcaggctgcacctacagctcagtcagcatgagaaaacccatactggtgagaagcctttcgagtgtaaggagtgtggtaaattcttcaggcgcggatccaatcttaaccagcaccgcagcattcataccggcaagaagccgttcgagtgcaaagaatgcggcaaagctttcaggctgcacatgcacctgatccgtcaccagaagtttcacaccggtgagaagccctttgaatgcaaggagtgcggcaaagccttcagtctacatactcaactaaatcatcataaaaatattcacacaggagaaaagcccttcaagtgcaaggagtgtggtaaatcttttaacagggtcagcaacctggtgcagcaccagtccatccacgcaggggtgaaaccgtatgaatgcaaagagtgcggcaaaggattcagccgcgtttctaatctcatacagcatcagaagacacattcctctgccaaaccgttcgtgtgtaaggagtgcaggaagacattccgctaccactaccaacttactgaacactaccgtattcatacaggagaaaagccattcgagtgtaaagaatgtgggaaggcctttgggttgcttacacagctggcccaacatcagataatacacactggcgagaaaccttttaaatgcaaggaatgcggtaaagcctttaatcgcggatccaaccttgtccaaccacagtcgattcacaccggtgagaagccctatgagtgtaaggagtgtggcaaagcctttcggctgcacctccagctatcgctgcaccagaaactggtccaggtgcgcaatccgctgaatgtcagaaatgttggccagccatcagacatttctagtaacctcttgaatatccggaagttcatcctcggttag

SEQ ID NO: 4537 - DNA, 564 bp, Artificial Sequence
  Description of Artificial Sequence: Synthetic coding sequence
taacggggaggaggggatagctatggcgttctgctgtcaaacgcacttgccaggctgcgcggattcaaggatcacttcactttctgtcagcaactgaatatttcgatctgtccactgtcacagacagctgcacgatttcaagtaatcgtttacaaccccctgggaaggaaggttaactggatggtgcggctccctgtctccgaaggcgtgtttgttgtcaaggacccgaatgggcgaactgttcctagtgacgtggttattttcccatccagcgatagtcaagcccatcccccagaactgctgttctctgcatcactgccggcattggggttctctacgtactccgtggcccaggtgccacgctggaagccgcaggccagagcccctcagcccatcccgaggcggtcctggtccccagcgctgacaatcgaaaacgagcacatccgggctacctttgaccccgacacagggctcttgatggaaatcatgaacatgaaccagcagctgctgctgccagtaagacagacattcttttggtataacgcttcgatcggcgataattag

SEQ ID NO: 4538 - DNA, 3036 bp, Artificial Sequence
  Description of Artificial Sequence: Synthetic coding sequence
atgggggcatatgctagagcctccggcgtgtgtgcgcgtggatgcttggattctgccggaccgtggaccatgagcagagcgttaagaccgccactcccgcctttgtgtttttttctgttgctgcttgctgccgcaggtgcccgagcaggaggatatgagacttgtcctaccgtgcagcctaacatgctcaacgtgcatctgctgccgcatacccacgatgatgtggggtggctgaaaactgtggaccagtacttttatgggattaaaaatgacattcagcacgccggtgttcaatatattcttgattctgtgatttccgccctcttagcagatcccactcgaaggtttatatacgttgagatcgctttcttctcaaggtggtggcaccagcagacaaacgctacacaggaggtggtaagggacttggtgcgccagggacgcctagagttcgctaatggtggatgggttatgaatgatgaagcagcaacccactacggggctattgtagaccagatgacactggggctgaggttccttgaagatacctttggaaatgacggtcgaccgagggtggcctggcacattgacccatttgggcactctagagagcaagcaagcttgttcgctcaaatgggctttgacggctttttctttgggaggctggattatcaggataaatgggtcaggatgcagaagctggagatggagcaggtgtggcgcgcttcaacatcactcaagccgcctacagccgacctgttcaccggcgttctgcccaatggttacaacccacccaggaacctttgttgggatgtcctttgtgtagatcagcctcttgtggaggatcccagaagccccgagtacaacgccaaggagctggtcgactactttctgaacgttgccacagcgcagggcagatactaccggaccaatcacacggtgatgaccatgggcagcgacttccagtatgagaacgccaatatgtggtttaagaacttggacaaattgattcgcctggtgaacgcacagcaggctaaggggtcgagcgtccatgtgctctactcaactcccgcatgttatctatgggagttaaacaaggccaacctaacatggagcgtaaagcatgatgatttctttccatatgccgatgggccacatcaattttggacaggctatttttctagcagaccagcactcaagcggtacgagagactgagttataatttcttgcaagtatgtaaccagttggaggccttggtgggattagccgctaacgtgggcccatatggatctggagattctgctcccctgaacgaagccatggcggtgctgcagcaccatgacgctgttagtgggacctcgcgtcaacatgtggccaatgactatgccagacagcttgcagcaggctggggcccatgtgaggtcttgctttcaaatgctctggccagactccgcggtttcaaggaccacttcacattttgccagcagctgaatatctctatatgccccctctcacagaccgccgctaggttccaggtcattgtgtataatcccctcgggaggaaggtcaactggatggtgcggctgccagtgagcgaaggagtatttgtagtgaaggacccaaacggaaggacagtgcccagcgatgtagtcatctttccgtctagcgatagtcaggctcatcccccagagctgctgttctcagcctcgctccctgccttgggcttctccacttattcagtggcacaggttcctagatggaaacctcaggcaagggctccacagccaattccaagacgatcatggagccctgctctcaccatcgaaaacgaacacatacgggctacattcgaccctgacaccggccttcttatggagattatgaacatgaaccagcagttgctgctgccagttcgtcagaccttcttttggtataatgcctccatcggggataatgaatcggaccaggcttccggagcttacatctttcgtcccaatcagcagaaacccctgccggtatctcggtgggctcagatacaccttgttaaaacacccctggtgcaggaggtccaccaaaacttcagtgcatggtgttcacaggtcgtacgcctgtacccgggtcagcgacacctggagctggagtggagtgtgggaccgatccccgtaggcgacacttgggggaaggaggtcatttccaggtttgacacaccactggagaccaaaggacgattttacacagatagtaacggtagggagatactggaaaggcgacgcgattaccgtccgacatggaagctgaatcaaacagaacccgttgctggcaattattatcccgtcaacactaggatttacatcacagacggcaatatgcagctcacagtgttaacagaccggagccagggtggctcctccttgcgtgatggatctctcgagctgatggtacaccgcagactgctcaaagacgatggaaggggcgtttccgagcctctgatggagaatgggtctggcgcatgggtgcgtgggaggcatctggtgctattggatacagctcaggcagccgctgccggacataggctcttggccgaacaggaggttctggccccacaggttgtgttagcaccgggtggcggagccgcttacaacttaggcgctcccccaagaacgcagttttcaggactacgccgtgaccttccgccttccgtccatcttctgaccctggcatcttggggccctgagatggtgctcttacgccttgagcatcagtttgcggtgggagaggactctggcagaaatctgtcggctcccgtgactctgaatctcagagatctgttcagcactttcacgattacacgccttcaggagaccactctggtggcgaaccagctgcgggaggcggctagtaggctgaaatggacaactaacaccggccctacacctcaccagaccccctaccagctggatccagctaacatcacactagagccgatggaaattcgcacatttctcgcttctgtgcagtggaaagaggtggacggttag

SEQ ID NO: 4539 - DNA, 2853 bp, Artificial Sequence
  Description of Artificial Sequence: Synthetic coding sequence
atgctaaatgtacacctcctgcctcacactcacgacgacgtgggctggctgaaaactgtcgatcagtacttttatgggatcaaaaacgacattcagcacgctggcgtccaatacatactggacagtgtgatttccgcactgcttgccgatccgacacgaagatttatttatgtggaaatcgccttttttagccgttggtggcatcaacagacaaatgccacgcaagaggttgtccgggacctggtgcgacaaggacggctagaattcgctaatggcggttgggtaatgaatgacgaagctgctactcattacggggcaattgtggatcagatgactcttggactgaggtttctcgaggataccttcggcaatgatggtcgccctcgagtggcatggcatatagatccgtttgggcacagtcgcgaacaagcgtcactgttcgcccagatgggttttgacggattcttttttggtcgattagactatcaggacaaatgggttcgcatgcagaagttggaaatggagcaggtgtggcgcgcatcgacttcactgaagcccccaacagcagatttgttcaccggcgtgctgcccaatggctataacccacctagaaatctgtgttgggatgtgctctgcgtagaccagccactcgtggaagatcctcggtcccccgaatataatgccaaagaactggtggattatttcctgaacgtcgctacagctcagggacggtactatcgcacgaatcacacggtgatgaccatgggaagtgattttcagtacgaaaacgccaatatgtggtttaagaatctggacaaactgatcagactggtgaacgcacagcaggcaaagggaagctcggtccacgttttgtattccactcccgcttgttacttgtgggaactgaacaaagcaaacttgacttggtccgttaagcacgacgatttctttccatatgccgacggcccacaccagttttggactggctactttagttctcgcccagctctgaaacgctatgagcgcctgagttacaactttctgcaagtttgcaatcagttggaggcccttgtcggactggcggcaaatgtgggcccttatggatcgggcgacagtgccccactgaacgaggctatggctgtgttacagcatcacgacgctgtgtctgggacaagccgacaacacgtggctaacgactacgcccgtcagctggccgctggttggggcccatgtgaggtccttctaagcaacgcactcgcacgcctcaggggcttcaaggaccacttcacattctgccagcaattaaacatatcaatatgtccgctcagccagactgccgcacgttttcaagtgatcgtatacaaccctttgggtcgcaaggtgaattggatggtccgcctgcccgtcagtgagggtgtctttgtggtgaaggatccaaatggcaggactgtgccaagcgacgtggtgatctttccgtcctccgattcccaggcccacccgcctgagttactgttttccgcttcactacccgcactggggttttccacctacagcgtggcgcaggtgcccaggtggaagccccaggctagagcccctcaacctatccccagacgatcttggagcccagccctgaccattgaaaatgaacacatccgcgcaactttcgaccccgacacaggcctactgatggaaataatgaatatgaaccagcaactccttctcccagtgcggcagacttttttttggtacaatgcgagcattggagacaatgaaagcgaccaagcctccggagcttacatttttagaccaaatcagcaaaagcccctaccagttagtcgttgggctcagattcatcttgtcaaaaccccattagtccaggaggtacatcaaaatttctccgcttggtgctcccaggttgttagactatatcctggacagcggcatcttgaactggagtggagcgtggggccaatccctgttggggatacgtgggggaaggaagttattagtcgctttgatacacctctggaaacaaagggacggttttacaccgattctaacgggagggaaatactcgaacgtaggcgcgactatcgacctacgtggaagcttaaccagaccgagccagtcgccggaaattactatcctgtcaacacccgcatttacatcacagatgggaacatgcaactcacagtgctgactgatagaagccaaggtggcagctcgctgcgggacgggagcctcgagttaatggtacaccgcagacttcttaaggatgacggaagaggagtgtccgagccactgatggagaatggatccggagcttgggtacgtggtcgacatctggttctgctggatacggcacaggccgcagcagcaggccacaggttgctcgccgaacaggaggtcttagcccctcaggtcgtgttagctcctggcggaggagctgcctataatctgggcgctcctccaagaactcaattcagcgggctgcgacgcgacctgccaccctctgtgcacctgctgacattggcctcgtggggcccagaaatggttctgctgagactagagcatcaatttgccgtgggggaggatagcggcaggaacctgtctgccccagtaactctgaatctcagggacctgttctcaactttcactatcactcgcctccaagaaacaacattggtggcgaatcaattgcgggaggccgcttctcgactgaaatggacaacgaatactggcccaactccccatcagaccccctatcagctggaccccgcaaatattacgctggagcccatggaaatccgaacttttctggctagcgttcagtggaaggaagtcgatgggtag

SEQ ID NO: 4540 - DNA, 882 bp, Artificial Sequence
  Description of Artificial Sequence: Synthetic coding sequence
atgggattcccagccgcagcactcctctgcgcactctgctgcggacttctggccccagcagctagggccggatacagcgaagaacgctgtagctggcgcggatcgggtctaactcaagaaccaggcagcgtaggacagttagctttagcttgcgctgaaggtgcggtcgaatggttgtacccggctggcgcattgagattaacactgggcggacctgatcccagagcaagaccaggtatagcctgccttagacctgtgcgcccatttgcaggggcacaggttttcgccgagcgggcaggcggagcccttgagctcctcctggcagaagggccaggcccagctggagggaggtgtgtgcgatggggacctcgtgaaaggcgagcattgtttctgcaggccacaccccatcaggatatttcgagacgtgtggcagcctttcgtttcgaattacgtgaggacggtagacccgagctaccacctcaggcacacggcctcggggtagacggggcttgcagaccttgttccgatgccgagctgctgctggccgcttgtacgagcgacttcgtcattcacgggattatccacggagtgacccatgacgttgagctccaggagagcgtgattactgttgtggctgccagggtcttgagacagacaccgccattgttccaggcagggaggtccggtgaccaaggactgacctccattcgaacccccctgcgctgcggcgttcatccagggccagggaccttcctctttatggggtggtcgcgttttggtgaagctcggctaggatgcgcaccgcgatttcaggaatttcgtcgcgcatacgaggcggcaagggctgcccacctgcacccttgtgaggtcgcattgcattag

SEQ ID NO: 4541 - DNA, 708 bp, Artificial Sequence
  Description of Artificial Sequence: Synthetic coding sequence
atggagcaggatgatccagtggaggcactcaccgagctgagggaacgacgcttgggcgctctggagctactgcaggcagctgccggatcagggctcgccgcttacgccgtgtgggcactgctgctacagcccggattccgcagggttccgctccggttgcaagtgccatatgtaggagcctcagcgagacaggtggagcatgtgctgtcactgctccgaggacgcccaggcaagaccgtggacctcggatccggagatggaagaatcgtgctcgccgctcacaggtgtggcctccgcccagccgttggctatgaactgaacccttggttggtggcgctggcgagactgcatgcctggcgggctggatgtgccggttcagtgtgctacaggaggaaggacctctggaaggtgagcctcagggattgcagaaacgtgtccgtttttctggctccctccgtcctacctttgctcgaagacaaactgcggaccgaattgccggctggtgctagagtggtgtcaggcaggtttcccttaccaacgtggcagcctgtgactgcggtgggagaaggattggatcgggtctgggcttatgatgttcctgagggaggccaggctggcgaagccgcttccagcaggatccccatccaggcagctccaggtccctctagcgctccgatccctggaggattaatttcacaagcgtcttag

SEQ ID NO: 4542 - DNA, 2253 bp, Artificial Sequence
  Description of Artificial Sequence: Synthetic coding sequence
atgttacgggctaagaaccagctattcctattatctcctcactacctgcgccaggttaaggaatcatccggatcacgactaatccagcaaagacttttacatcaacagcagccactgcatccggaatgggcggcactggctaaaaaacagttaaagggcaagaaccctgaagacctaatttggcatactccagaaggtatatcaatcaagcctctatattccaagcgcgacaccatggatctcccagaggaactgcccggtgtgaagccctttaccagaggtccctatccaactatgtatacgtttaggccttggaccattaggcagtacgcagggttttccaccgtcgaggaatcgaataaattctacaaagataatataaaagcgggacagcaggggctctccgtggccttcgacctggcgactcacaggggctacgatagcgacaaccccagggtgagaggagacgtagggatggcaggggtcgctatcgacaccgtggaagacacaaagatcctgtttgatggcattcccttagaaaagatgtctgtgagcatgacaatgaatggggcagtcatacctgttcttgccaacttcatcgttactggtgaggagcagggagtgcctaaagaaaagctcaccggtacaatccaaaatgacattctaaaggagtttatggtcagaaacacatacatatttccacctgagccttccatgaaaatcatcgccgatatattcgagtacaccgccaagcacatgcctaagtttaacagcatctccataagtggctaccacatgcaggaagctggagcagatgccattttggagctcgcttatactctagcagacggcctggagtacagtagaactgggctgcaggcgggtctgactattgatgagttcgcaccccgtcttagttttttctggggcataggcatgaacttctacatggaaatcgcaaagatgagggccggacggagactgtgggctcatctcattgaaaagatgtttcaacctaaaaactcaaagtctttgctcctcagagctcactgccagaccagtggttggagcctgaccgaacaagacccctataacaatattgtgcggacagccatcgaagcaatggccgcagtgtttggcggaactcagagcctacataccaatagcttcgatgaagccctgggcctgccaacagtcaagtccgcacggatcgcgagaaatacccagattatcatccaggaagagagcggaatacctaaggtagcagatccctggggcggatcgtacatgatggagtgcctgacaaatgatgtgtacgacgccgctctgaaacttattaatgagatagaagaaatgggaggaatggcaaaggccgttgcggagggaatacctaagctcaggatagaagaatgcgccgcaaggcgccaagcacgcattgattcaggctctgaggtgatcgtgggcgtcaataagtaccagctcgaaaaggaggatgctgtggaagtgcttgctatcgacaacacatccgtgcgcaatcgtcagatcgagaagctgaagaaaataaagagtagtcgggatcaggcgctggccgaaaggtgcctggctgcactgactgagtgcgcagctagcggtgacggcaatatcctggcgcttgccgtggacgccagccgggcacgctgtacggtcggcgagattacggatgccctgaaaaaagttttcggcgagcataaggccaatgacagaatggtgagcggcgcatatcgtcaggagtttggtgagagcaaggaaatcactagcgcgatcaagagggtccacaagttcatggaaagagaggggcgacggcctaggctcctagtcgcgaagatgggacaggacgggcatgacaggggtgccaaggtcattgcaaccggctttgcagaccttgggttcgacgtggacatcggccctctctttcaaaccccaagagaggtcgctcagcaggcagttgatgcagatgtgcacgcagtaggaatatccaccctggccgcagggcacaagactttagtgcccgagctcattaaagagctaaacagtttaggccgacctgacattctagtgatgtgcggcggtgtgattcctcctcaggactacgaatttctgttcgaagtgggagtatcaaacgtgtttggcccaggtactaggatccccaaggctgcagtgcaagtactggatgacatagagaaatgcctggagaaaaaacaacaatctgtttag

SEQ ID NO: 4543 - DNA, 594 bp, Artificial Sequence
  Description of Artificial Sequence: Synthetic coding sequence
accaggtacctcgccagatgcacagtcggcgagataactgatgcacttaaaaaggtcttcggtgagcacaaggccaacgatagaatggtgtcaggggcataccggcaggagttcggcgagagtaaagagattaccagcgctatcaaaagggtccacaaatttatggagagggaaggcaggcggccacgacttctcgtggctaaaatgggccaggatggtcatgacagaggtgccaaggtaatcgcaacagggtttgcggatctggggttcgacgtcgacatcgggcctctcttccaaaccccgagggaggtggcccaacaggcagtcgacgctgacgtccacgctgttggcattagcactctggcagccggacacaagacactagttcctgaactcatcaaggagttgaactcgctgggcagacccgatatcctagttatgtgtggtggggtgattcctccccaggactacgagtttctcttcgaggtcggagtcagcaatgttttcgggccaggcacaagaattccaaaagctgccgtgcaggtgctggatgacatagagaaatgcctggagaaaaaacagcagtccgtgtag

SEQ ID NO: 4544 - DNA, 2685 bp, Artificial Sequence
  Description of Artificial Sequence: Synthetic coding sequence
atgattctcctagccgtattgttcctgtgtttcattagctcttattcagctagtgtcaaaggccacacaacaggcctatcactcaacaacgacaggctgtacaaactgacttatagcactgaggtgctcctagaccgcggaaagggaaagttacaggattctgtggggtacagaatatcaagcaacgtggatgtggcgctcctgtggaggaaccccgacggagacgatgaccaactgattcaaatcactatgaaagacgtgaatgttgagaacgtgaaccaacaaagaggagagaaatctatctttaagggcaagagcccttcaaagattatgggcaaggagaatctcgaagctctgcagaggccgactttgctccacttaatacacggcaaggtgaaggaattctacagttaccagaacgaggcagttgcgattgagaacattaagagaggactcgcctcacttttccaaacgcagcttagcagtggcaccaccaacgaggtagacatctctggtaattgcaaagtgacttatcaagctcaccaggataaagtgataaagatcaaagccctggattcgtgtaaaattgcacgcagtggttttactacccccaaccaagtgctgggggtgtcctccaaagccaccagcgttacaacctataagatagaagattcctttgtgatcgccgtgctcgctgaggaaacgcataattttggcctgaatttcctgcaaaccattaaaggaaaaatcgtctctaagcagaaactggaactaaaaaccacagaagctgggcctaggctgatgagtgggaaacaggctgcagccataataaaggccgtcgactcaaagtatacagcaatccccatcgtaggtcaggtgtttcagtcccattgcaagggctgtccttcccttagtgagctgtggagaagcaccagaaaataccttcagcctgacaatttgtcaaaagctgaggccgtgagaaacttcctggcgttcatacaacatctcagaaccgccaagaaggaagagatattgcagattttaaagatggagaataaggaagtgttgccgcagctagtcgacgccgtaacctcggcccagacctctgatagtttggaagctatcttggattttctggattttaagtccgacagtagcatcatccttcaggagcggtttctttacgcttgcggtttcgcctcacacccaaatgaagaactcctcagggcacttatcagtaaatttaaagggtccatcggttccagcgatattcgagaaacggtgatgatcatcaccggcacattggtcagaaagctgtgccagaacgaggggtgcaagttaaaggcggtggtggaggccaagaaactgatattgggtggcctggaaaaagcggagaaaaaggaggacaccagaatgtatctcctcgccctaaaaaacgcactgctgcctgagggcattccttccctgctgaaatatgcagaagcgggagagggccctatttcacacctcgccaccactgctctgcaaagatacgatctgccgttcatcaccgacgaggtgaaaaaaaccctcaatcgaatctaccatcaaaacaggaaggtgcatgagaaaaccgttagaacggccgctgccgcaatcattttgaacaataacccatcctatatggacgttaagaatattttgctatcaatcggtgagctgcctcaggagatgaataagtacatgctggctattgtgcaagacattctccgcttcgagatgccggcatccaaaatcgtgcgcagggttctgaaggagatggttgcccacaattacgatagattctcgcggtctgggtccagctcagcttatacgggctatattgagcgctcccccaggagtgctagcacgtacagcctggatatactgtactctggatccgggatactccgtcgctcgaacctaaacatatttcagtacataggtaaggccggactgcatggtagccaagtcgttattgaggcccaggggcttgaggctctcattgccgcaaccccggacgaaggagaagagaatctggattcctatgctggaatgagcgctattctttttgacgtgcagttgagacccgtaactttttttaacggatacagcgatctcatgtcaaaaatgctctccgcctctggagaccctatatctgttgttaagggactgattttactgatcgatcacagccaggaattgcagcttcaaagcggcctcaaggccaacatcgaggtccagggaggtctcgcaattgacatctccggagccatggagttttctctttggtatagggaaagtaaaactcgtgttaagaatagggtaacggttgtgattacaaccgatataaccgtcgatagctcttttgtcaaggccggacttgagacctccaccgagaccgaggcaggactggagtttattagcacggtgcagttcagtcagtatccattccttgtgtgcatgcagatggataaggatgaagctccctttcgccagtttgagaagaaatacgagaggctgagcacagggcgagggtatgtgagtcaaaagcggaaggagagtgtactcgccggatgtgaattccctcttcatcaggagaatagcgaaatgtgcaaggtggtgttcgcgcctcagcccgatagtacttcgagcggttggttttag

SEQ ID NO: 4545 - DNA, 2685 bp, Artificial Sequence
  Description of Artificial Sequence: Synthetic coding sequence
atgatcctcctggcagtcctgtttctgtgcttcatcagctcatactcagcttctgtgaaaggtcacaccactggactcagcctcaacaatgataggctctacaaattgacatactcaactgaggtgctgctcgacagaggcaagggcaagctacaggacagcgtgggttatagaatctcatcaaacgttgatgtcgccctgctgtggcgcaacccagacggcgatgatgaccagctgatccagataactatgaaggacgtaaacgtggagaatgttaaccagcagaggggagagaaaagcatattcaaaggaaagagtccttcaaagattatgggaaaggagaaccttgaggctctccaaagaccaactttacttcatctgattcatggcaaagtgaaagagttttacagctatcagaatgaagccgtggctattgaaaatattaagagggggctggcttccctcttccagactcaactttcctccggcaccacaaatgaagtggacataagtggcaactgcaaagtgacttatcaggcccatcaggacaaggttattaagatcaaagctcttgacagctgcaaaatagctcgtagcggctttaccactcccaaccaggtgctgggggttagttccaaagcaaccagcgtaacaacttacaagattgaagactctttcgtgatcgcagtactggcagaagagacacacaacttcggtctgaattttttacaaactattaaagggaagatcgtgagcaaacaaaagctagagctgaagacgacggaagccggtcctaggctcatgagcggaaagcaggcagccgcaatcattaaggcagtggactccaaatacactgccatacccatcgttggacaagtgttccagtcccactgtaagggctgcccttctctgtcggaactgtggcgcagcaccagaaagtatctccagccggataatctcagtaaggcagaagcagtccgaaactttcttgcattcatccagcacttgcgcactgccaaaaaagaggaaatcttgcagattttgaagatggaaaataaggaagtacttccgcagctcgttgacgccgtgacgagcgcgcagacatccgattctcttgaggccatcttggatttccttgactttaagtctgactcatccatcatcctgcaggaacgatttctttacgcttgtggttttgcctctcatcctaacgaggaactgttacgcgctctgattagtaagtttaaagggagcattgggtcatctgacattcgcgagacagtcatgatcatcactgggaccttggtgcgtaagctttgtcagaatgagggctgcaaactcaaagctgtggtcgaggccaaaaaactgatccttggcggattggaaaaggccgaaaagaaggaggacacccgtatgtatctgctggccctgaaaaatgcattgttacccgaggggataccatctctgctcaaatacgctgaagccggagaggggccaatttcccacctcgccaccacagcccttcagaggtatgacctgccctttattaccgatgaggtcaagaagacccttaacagaatttaccaccagaaccggaaggtgcatgaaaaaacggtgaggaccgctgccgcagccattattctcaataataatcctagctacatggatgtgaaaaatatcttactctccatcggggaacttccacaggagatgaacaaatatatgctcgctatagtccaggacattctgagatttgagatgccagcatccaaaatcgtccggagagttctcaaggaaatggtcgcacacaactatgacagattctcaagatcaggctccagcagcgcctatacaggttatatcgaacggagccctcggtccgcctcgacctactctctggatatcctctattcgggtagcggcattctgagaaggagtaatctcaacattttccaatacataggcaaagctggcctgcacggctcccaagtagttatagaggctcagggcctggaggcgctgatcgccgctacccctgatgaaggggaagagaacctggattcctatgctggtatgtcagccatcctatttgatgtacagcttcgccctgtcacattcttcaatggttacagtgacctcatgagcaaaatgctttctgccagcggggaccccattagcgtggtgaagggtctgatcctgttgatcgatcacagccaagagctgcagctgcagtccgggctgaaagctaacatcgaggtccaagggggattggcgattgacatttccggggctatggagttcagcctatggtatagggagtctaaaacccgcgttaaaaaccgagtaaccgtcgtcatcaccacagacatcacagttgacagctctttcgtgaaagcagggcttgagaccagcaccgaaaccgaggcagggctggagtttatttcgaccgtccaattctcacaatacccatttctagtttgcatgcagatggataaggatgaagcccctttcaggcagtttgagaaaaaatacgaaagactgtctaccggaaggggatacgtgtcccagaaaaggaaggaatcagtcctcgctggttgtgagttccctctccaccaggagaatagcgaaatgtgtaaagtcgtctttgcgcctcagcctgactctacttctagtggctggttctag

SEQ ID NO: 4546 - DNA, 537 bp, Artificial Sequence
  Description of Artificial Sequence: Synthetic coding sequence
atggcaagggctccattgcgaccagagaatactatcgtccggggttccgcaaaccagtgtcaagatacctaccgagcagaggagctgactgggcacaccacaggcctctcccttaacaacgacaggttatataagctcacttattccacagaagttctcctcgatcggggaaaggggaagctccaggactctgtcggatatcgaatctctagcaacgtggacgtggcccttctctggcgcaatcccgacggagatgatgatcagttgattcagatcaccatgaaagatgtcaacgtcgagaacgtgaatcagcagagaggtgaaaagtcaatttttaaaggcaaatctccaagtaaaattatgggtaaagaaaacctggaggctctgcagcgccctaccctgctgcatctgatacatgggaaagtcaaagaattctatagttatcagaacgaggccgtggccattgagaacatcaaaaggggactcgcatctttgttccagacacagctttcctctgggaccacaaatgaggtctag

SEQ ID NO: 4547 - DNA, 1551 bp, Artificial Sequence
  Description of Artificial Sequence: Synthetic coding sequence
atgattctgctggctgtgcttttcctgtgcttcattagctcctactcagccagtgtgaagggccatacaacagggctgagtcttaataacgacagactgtataaactcacctactccaccgaggtgttactcgaccgaggtaagggaaagcttcaagactccgtcgggtaccgcatctcctcaaatgtcgatgtggcgcttttatggcggaatcccgacggcgatgacgaccagctcattcagattactatgaaggatgttaatgtcgagaacgtgaaccagcagcgcggagagaaaagcatcttcaagggcaagtctcccagcaagatcatgggcaaagaaaatttggaagcgctgcaaaggccaacacttctccacctgattcatggcaaggttaaagagttctattcttatcagaacgaagctgtggccatcgagaacattaagcgcggactggcgagccttttccagacccagctgtctagtggaactacaaacgaggtggacatttctgggaattgtaaggtaacataccaggctcatcaagataaagtaatcaagatcaaagcgctcgattcatgtaagatcgcccgaagtggatttaccacgcctaaccaggtattgggtgtttcatccaaagccacgagcgtaaccacctacaagattgaggacagttttgttattgcagtgctggcagaggagacccacaactttggtttaaattttttacaaacaatcaaggggaagatcgtgtctaagcaaaaactggagctgaaaaccacagaggctggtccgcgtttaatgtccggaaagcaggccgctgcaattatcaaggcagtggactcgaagtacaccgctatcccaattgtcggccaagtgtttcagtcgcattgcaaaggatgcccctctctgtcggagctgtggaggtccactagaaagtatctgcagccggacaatctctccaaagctgaggccgtgagaaacttcctggccttcatccagcacctccgcacagcgaagaaagaagaaatcctgcagatcctgaaaatggagaacaaggaagtcctaccacagctggtggatgcagttacctccgcccagacttcggacagtttggaagcaattttggacttccttgattttaaatccgactctagcatcattttgcaggagcggtttctttatgcctgcggttttgcttcgcaccctaatgaagagctactcagagctctgatctctaagtttaagggctcaattggtagcagtgatatccgggaaaccgttatgattattacaggaacattggtgagaaaactctgtcagaatgaaggatgtaaactgaaagccgtggtggaggcaaaaaaactgatcttgggcggactcgaaaaagccgaaaagaaagaagatacacggatgtatctcctggctctgaagaatgctcttctcccggagggcataccctctttactaaagtatgccgaagctggtgaagggccaataagccatcttgcgacgactgctctccagaggtacgacctgttccacaattag

SEQ ID NO: 4548 - DNA, 3771 bp, Artificial Sequence
  Description of Artificial Sequence: Synthetic coding sequence
atgctgttcaagcttcttcagcgacagacttacacatgtctgtctcatcgctacggtttatacgtctgcttcctcggagtggttgtgactattgtgagcgccttccagtttggggaggtggtcttagagtggtcacgggatcaataccatgtactgtttgactcctatagggacaacatcgctgggaagagctttcaaaacagactgtgcttacccatgcccatcgacgttgtgtatacatgggtgaatggaactgatctggagctgctaaaagaactgcagcaggtccgcgaacagatggaagaggagcaaaaagccatgcgcgaaatacttggaaaaaatacgactgaacccacaaaaaagtccgagaagcagttagagtgtctcctgacccattgtatcaaggtccctatgttggtgctcgacccagcgctgcccgcaaatattacacttaaggacttgccctccttgtatccatcattccactcggcgtccgatatattcaatgttgctaagccaaaaaatccctcaaccaatgtgtccgtggttgtgtttgacagtaccaaagatgtcgaagacgcccactccggattgctgaaagggaattctaggcagactgtttggcggggataccttactacagataaggaagtgccagggctggtgttgatgcaagacctggcattcctgagcgggttcccaccaaccttcaaagaaacaaatcaattaaagacgaagctaccagaaaacctttcaagcaaagtgaagctcctccaactgtatagcgaagcctccgtggccctgctcaagctaaataatccaaaagatttccaggagctgaataagcagacgaagaagaacatgactatcgacggcaaggaactgactatttcaccagcttatctgttgtgggaccttagcgcaatttcccagtcaaagcaggatgaggacatatccgcgtcccgatttgaagacaacgaggagctgaggtattcactgcgcagcattgagcgacacgcaccctgggtcaggaacatatttatcgtgactaatggtcagatccccagctggctgaatcttgataaccctagggtaaccatcgtcactcaccaggacgttttcaggaatctgtcacacctgccgacgttcagtagcccagccatcgaatcccatatccaccggattgaaggtctatcccagaagttcatctacttaaacgatgacgtaatgttcggtaaggacgtgtggcctgacgacttctactcccacagtaaggggcagaaagtgtatttgacatggccggtacccaactgtgcagaaggctgtcctggcagttggattaaagacggttattgcgacaaggcttgtaataattccgcttgtgactgggatggcggtgactgtagcggcaacagcggaggtagccggtatatcgccggtggaggaggaaccgggagcatcggggtcggccagccctggcagtttggtggtggcatcaacagcgtcagctactgtaatcagggctgtgcgaacagttggttagccgataaattttgtgaccaggcctgtaacgtgttgtcttgtggctttgacgccggagactgtggccaggaccacttccacgaattgtataaagtcatcttactaccaaatcagacccattacattatccctaagggggaatgcctgccatactttagctttgcggaagttgcaaagaggggcgtggaaggtgcgtacagtgataatccgataatccggcacgccagcattgcgaataaatggaagactattcacttaatcatgcattctgggatgaatgctacaacgattcattttaacctgacctttcagaatactaacgatgaggagttcaaaatgcagatcactgtggaagtcgacacaagggaaggtcccaaattgaattcaacagctcagaagggctatgagaatctcgtgtcccccatcactttgctccccgaggccgagatcttgttcgaggatatccccaaggaaaagcgttttcccaagtttaagcgccatgacgtgaacagcacccggcgtgcccaggaggaggttaaaattccactggtgaatattagcctcctgccgaaagacgcccagctgtccctgaacacattggatctccagctcgagcatggagacatcaccttgaaaggctataacctgagtaaatctgcactgctacggtcctttctcatgaattcacagcacgcaaaaatcaaaaatcaggcaattatcaccgatgaaactaacgactctcttgtcgccccacaggagaaacaggtgcataagtccattttacccaactccctgggtgttagcgagcggctgcagcgcctgacgttccccgctgtgtcggtgaaagtcaatggacatgaccagggacagaaccctccactggaccttgagactacagcgcgattccgagtcgagactcacacccagaaaactataggtggcaatgttaccaaggaaaaacctccatctctgatcgttcccctggaaagtcaaatgaccaaagagaagaaaatcacaggtaaagaaaaggaaaatagcagaatggaagaaaacgccgagaaccacatcggggttaccgaagtgctcctcggtagaaagctacagcactacacagattcatacctgggcttcctcccatgggagaaaaagaagtatttccaagacctgttggacgaggaagaatcgcttaagacgcagctagcttactttaccgacagtaagaacactgggagacagctgaaggacacattcgcagacagcctgcgctatgtcaataagattctcaattctaagtttggcttcacctccagaaaggtcccagcccacatgcctcacatgattgataggattgtgatgcaagaattacaggacatgtttcccgaggagttcgacaagacaagctttcacaaagtgcggcattctgaagacatgcaatttgccttctcctatttctattacctcatgtcagctgtgcagccccttaatattagtcaagtcttcgatgaggttgacacggatcagtcaggcgtcttatccgatcgtgagatccggacgctcgctactagaatacacgaactgccgctgagtcttcaggacctcactggacttgagcacatgctgataaattgctccaagatgctgcccgctgatataacccagctcaacaatatacctccgacacaagagtcttactacgatccaaatctgccccctgtaacaaaaagtctcgtcactaattgtaagcccgttacagacaagattcataaggcatataaggataaaaacaaatatagatttgagatcatgggcgaagaggagatcgcctttaagatgattaggacaaacgtatcccacgttgtgggacagctggacgacatacgaaagaatcccaggaaattcgtgtgccttaacgacaatatcgatcacaaccataaagatgcgcagaccgttaaggccgttttgagagacttctacgaaagcatgtttcccattcctagtcagtttgagttgcctcgagaatatcgtaatcggttcctgcacatgcatgagctgcaagagtggcgtgcttacagggataagctgaagttctggacccattgcgtgcttgcgaccctcattatgttcaccatcttctccttctttgctgagcagctcatcgctcttaaaagaaaaatctttcctcgtcggagaatacataaggaagcgtcccctaataggattcgggtgtag

SEQ ID NO: 4549 - DNA, 1473 bp, Artificial Sequence
  Description of Artificial Sequence: Synthetic coding sequence
atgctgtttaagctgcttcagcgacagacctacacatgcttaagccaccggtacgggctatacgtatgctttttaggtgtggtcgtcacaattgtgagcgccttccagttcggcgaggtggtacttgaatggtcgcgtgaccagtatcacgtgctgtttgactcttacagggacaatatcgccggaaagtccttccagaatcggttgtgcctgcccatgccaatcgacgttgtgtacacatgggtcaacggaaccgacctggaattattaaaggaactgcagcaggtgcgggagcagatggaagaggagcagaaggcgatgagagaaatccttggcaagaacacaactgaacccactaagaaatcagaaaaacagctcgaatgtcttcttacacattgtatcaaagtgcccatgctggtgctggatccggcattaccagctaacatcactctgaaagatcttccaagtttgtatccttcctttcattccgcatctgatatcttcaatgtggctaaacctaaaaacccgtccaccaatgtatccgtggtggtgtttgactccaccaaagacgtcgaagacgcacattcaggcctgctgaaaggaaactctcgacagactgtgtggcgagggtaccttacaactgataaagaagtcccgggactcgtcctgatgcaggatctggccttcctatctggcttcccaccaacatttaaagaaacaaaccagctaaaaactaagcttccagaaaatctgtcgtccaaggtcaaattgctgcagctttactctgaagccagcgtcgctctgctcaagttgaacaatccaaaggactttcaggagctcaataaacagaccaagaagaacatgacgatcgacgggaaggaactgaccatttcgcctgcatatcttctgtgggacctcagtgctatttcccagagcaaacaagacgaggacatcagtgcaagccggttcgaagataacgaggaacttaggtacagtctgaggagcattgagagacacgccccttgggtccgcaacatcttcattgttaccaatggacaaatcccctcttggttgaacctcgacaaccccagagtgaccattgtcacccaccaggacgttttcagaaacctatcgcatctgccaacattttcttcacccgcaatagaaagtcacattcaccgtattgaaggtctttcccagaagtttatctacctgaatgacgatgttatgttcgggaaggacgtatggcctgatgatttttatagccactccaagggccaaaaagtgtatctgacctggcctgttcctaactgcgcagagggctgcccaggcagctggatcaaggacggctattgcgacaaagcttgcaacaactcagcttgtgattgggacggcggtgattgttctggaaaagatgtgttaaattgtaactctttcatattcatggaatatttcctccttaaccattactag

SEQ ID NO: 4550 - DNA, 1605 bp, Artificial Sequence
  Description of Artificial Sequence: Synthetic coding sequence
atggccacagcactcatggccgtcgtactccgcgctgctgccgtggctccccgactaaggggacgcggaggcaccggcggagccaggagattgtcatgcggagccaggcgcagagccgcaagaggtacttctcctggccgaaggctttctactgcgtggtcacagccccagccaccgccagaagagtacgcgggagctgatgacgttagtcaatcccctgtagctgaagaaccttcctgggtgccctcaccaaggccgccagtgccacatgagagcccagagcccccaagtggccgtagcttagtgcaacgagatatacaggccttcctgaatcagtgtggagcttcgcccggagaagccagacactggttgacccaattccagacttgccaccatagtgccgacaagccgttcgcagtcatcgaggtcgatgaggaggtcctgaaatgtcagcagggagtgtcttcgttggcgtttgccttagcctttttacagcgaatggacatgaaaccgctggtcgtactcggcctaccagccccaacagcacccagcggctgcttgtcattctgggaagcgaaagcccagctggctaagtcctgtaaagtcctggtggatgcccttaggcacaacgccgcagcagcagtgcctttcttcggcggtgggtccgtcttgcgggcagctgaaccagcgcctcacgcatcctacggcggtatcgtcagcgtggaaactgatctgttgcaatggtgcctggagtccggcagcattcctatcctctgtccgatcggtgagacagctgccagaaggtccgtcctgctcgactcactagaggtgacggcatctctcgctaaagcactgcgacctacaaagattatcttccttaacaatacaggaggtctccgtgacagctcccataaagttctttcaaacgtgaacttgcccgcagacctggatcttgtgtgtaatgctgaatgggtgtctactaaggaacgccagcagatgagactaatcgtggacgtactatcaaggctgccccaccattcgtccgccgtcatcacagctgcctccacactgctgactgagctttttagcaataagggcagcggaaccttattcaagaatgccgaacgtatgttaagggtcaggtctctggataagctggaccaagggcgtctagtggaccttgtgaacgccagctttgggaagaaactgcgggatgactaccttgctagtctcaggccgagactccactccatctacgtcagcgagggatacaacgccgcagccattctgacaatggagccagttctggggggaacgccctacctggataagttcgtggtcagctctagccgccaaggccagggctccggtcaaatgctatgggagtgtcttaggcgggatctccagaccctgttttggcggagcagggtgactaaccccattaacccttggtacttcaaacattccgatggatcctttagcaataagcagtggattttcttttggttcggacttgcagatatacgtgactcctacgagctcgtgaatcatgcaaaagggttgcctgactcctttcacaagcctgctagtgaccccggtagctag

SEQ ID NO: 4551 - DNA, 1107 bp, Artificial Sequence
  Description of Artificial Sequence: Synthetic coding sequence
atggacatgaagcctctcgtggttctgggacttcccgctcccacagcgccttccggctgcctgtctttctgggaagctaaagcacagttagccaaatcctgtaaggtgctggttgatgccctcaggcacaacgccgcagctgcagttccctttttcggcggtggttctgtgctgcgggctgccgaaccagcgccacacgcatcctacgggggaattgtgtctgttgagacagatcttctacagtggtgtttggagtcagggagtatccctatcctctgtcctattggagaaaccgctgctagacgttctgtcttgctggacagcctcgaagttacagcatccttagcaaaagccttgagaccaacaaagatcatcttcctaaataatactggcggtctacgtgactcatcccacaaagtgttaagcaatgttaatcttccagcagacctagatcttgtatgcaacgcagagtgggtgagcacaaaagaacggcaacagatgaggctgatagtggatgtactctcccgcctgcctcaccacagttctgcggtgattactgccgcaagcaccctgctcacagagttgttcagcaacaaaggaagcggcacattgtttaagaacgctgagcgtatgctaagagtaagaagcttggataagctcgatcagggacgcctggtagatctagtgaacgctagttttggcaaaaagctgagagacgattatttggcttcccttcgccctcggctccactctatttatgtgtcagaaggttacaatgccgctgccattttgaccatggagccagtgcttggcggtacaccatatctggacaagtttgttgtaagctcttctcgacagggacagggctccggccagatgctgtgggaatgtttgagaagagatctgcagactctgttctggcggtcccgagtgactaatcctatcaacccgtggtactttaagcatagcgatggttcgtttagtaacaagcagtggatctttttttggttcggacttgccgatatacgggatagttacgagctggtcaatcacgctaagggcctgcccgatagtttccataaacccgctagtgatcccggttcttag

SEQ ID NO: 4552 - DNA, 1188 bp, Artificial Sequence
  Description of Artificial Sequence: Synthetic coding sequence
atgcccggacggtcatgtgtcgcattggtactgcttgcagcagctgtgtcctgcgccgtggcccagcacgctcccccttggacggaggattgtcggaagtcaacctaccccccaagtggacccacctatcggggtgctgtcccttggtatactattaacttggacctgcccccatacaaacggtggcatgagttaatgcttgacaaggccccagttctgaaagtaatcgtgaactccctgaaaaatatgatcaatacgtttgtgccttccgggaagattatgcaggtggtggacgaaaagctgccgggtctgctagggaactttcctggtccatttgaagaggagatgaaaggaattgctgcagtgactgatatccctctgggcgagataatcagctttaatattttctatgagctgtttacaatctgtacctccatcgtggccgaggacaaaaagggtcacctgatccacggaaggaacatggacttcggcgtctttcttggctggaacatcaacaacgatacgtgggtgattactgaacagctcaaacccctcaccgtgaaccttgattttcaaaggaacaacaaaacagtgtttaaagcgtcttcgttcgccggttatgtcgggatgctgacgggctttaagcctgggcttttcagtttgactttgaatgaaagatttagtataaatggtgggtatttagggatcctcgagtggatcttgggtaagaaagatgtgatgtggattggcttcttgacccgaacagtcctcgagaattccacgtcctatgaggaggccaagaacctgctgactaagacgaagatcctggcaccagcttatttcatcctgggcggaaaccagtccggtgaaggctgtgtcattacaagagatcgcaaggaaagcttggatgtatacgagctcgacgccaagcaggggcgttggtacgtggtgcagaccaattatgaccggtggaaacatccctttttcctggatgatagacgaacaccggctaaaatgtgtttgaaccgtacatcacaagaaaatatttccttcgagacaatgtacgatgtgttaagcacaaagcctgtactcaacaaactcactgtctatacaaccctgattgacgtcacgaagggacaattcgaaacttacttgcgcgactgcccagatccttgcatcggctggtag

SEQ ID NO: 4553 - DNA, 1170 bp, Artificial Sequence
  Description of Artificial Sequence: Synthetic coding sequence
atgaattgttgtattggacttggcgaaaaggctagaggtagtcacagggcctcctacccttcacttagcgctctcttcacagaggcgagcatcctgggcttcggcagttttgctgtcaaggctcagtggaccgaggattgtcggaaatctacttatccgccaagtggcccaaccgtgtttcctgccgtgattcgctacaggggagccgtgccatggtacaccattaacctggaccttcccccttataagcggtggcacgaactgatgttggacaaagccccagtacctggactcctcggaaattttccagggccatttgaagaagagatgaagggaatcgccgcagtgacagacatcccgctgggcgagatcattagcttcaacatcttttatgaacttttcaccatctgcacaagtatcgtggcagaagataaaaaaggacacctgatccatgggagaaacatggatttcggggtctttctgggttggaacataaataacgacacttgggtcattaccgagcagctaaaaccgctgactgtgaacttggatttccagcggaacaataagaccgtttttaaggcaagctcatttgcaggctacgtgggaatgctcactggttttaaacccggacttttcagcctcaccctcaatgagagattttctatcaatgggggttatctgggtatcctggagtggattttaggtaagaaggatgtaatgtggattggctttcttactaggaccgtgctagaaaacagtactagctacgaggaggcaaagaatctcctgacaaaaacaaagattctcgccccagcgtatttcatcttggggggtaaccaaagtggtgaaggctgcgtcattacaagagacaggaaggaatccttggacgtatatgagctggacgccaagcaagggaggtggtatgtggtgcagactaactacgaccgatggaaacaccctttttttctagacgatcggaggaccccagcaaagatgtgtttaaatcggacttcacaggagaacatttccttcgagaccatgtatgatgtactgagtactaagcctgtgctcaataagctcacggtctataccaccctcattgatgtcactaaaggacagttcgaaacctatttgcgtgattgccctgatccgtgcatcggatggtag

SEQ ID NO: 4554 - DNA, 1236 bp, Artificial Sequence
  Description of Artificial Sequence: Synthetic coding sequence
atgaattgctgcatagggttgggagagaaggcgaggggctcccatcgcgcatcgtaccccagcttgtccgccctctttacggaggccagcatcctcgggttcggatccttcgcagttaaagcccagtggacggaggactgcagaaaaagtacctatccaccatcaggaccaacttatcgaggagcagttccctggtacaccatcaacttagacctgcccccatataagaggtggcatgaactgatgttggataaggctcctgtgcttaaggtgatcgttaatagtttgaagaacatgataaatacatttgtcccatctgggaaaatcatgcaggttgtcgacgagaagttaccgggtttgttaggaaatttccctggaccctttgaagaggaaatgaaaggcattgcggcagttaccgatattcctcttggcgagataatttcctttaacatattttacgagctgtttactatttgtacctctatcgtagcagaagataagaaagggcatctcatccatgggcgtaacatggatttcggtgtctttctggggtggaatatcaacaatgacacatgggtgattactgagcaactcaagcctttgacggtgaacttggatttccagcgcaacaacaagacagtcttcaaggcttctagtttcgccggatatgttgggatgcttacggggttcaaacctggattgttcagcctgacactgaatgaaagattttcaatcaacggaggctatttgggcatacttgagtggattttgggtaaaaaggacgttatgtggataggatttttaacaaggacagtgttggaaaacagcacatcttatgaggaagcaaaaaatcttttaactaagacgaagattctggcgccagcgtactttatcctgggcggaaatcagagcggcgaagggtgtgtgattacgagggacagaaaagagtctctggacgtgtatgagctggacgcgaagcagggccgttggtacgtggttcagacaaactacgatcggtggaagcaccccttcttccttgacgatcgaaggacccccgctaagatgtgcctgaatcgaacgagccaggagaatatctcttttgaaaccatgtatgacgttttatctacaaagcccgtgctgaataagctgacagtgtatactactctgattgacgtaacaaaaggccagttcgagacctacttgagggactgtcccgacccatgtatcggatggtag

SEQ ID NO: 4555 - DNA, 918 bp, Artificial Sequence
  Description of Artificial Sequence: Synthetic coding sequence
atgctcgacaaagcccctgtccttaaggtcatagtcaatagcctcaaaaacatgatcaatacattcgtaccgagcggcaagatcatgcaggtggtggacgaaaaattacctggtttgttgggtaattttcctgggccattcgaggaggagatgaagggcatcgccgctgtgacagacatacctttaggccacctgatccatgggcgtaatatggattttggcgtcttcctgggctggaatatcaataacgatacatgggttataaccgaacagctgaagccacttaccgttaatcttgacttccagagaaataataagacggtctttaaagctagctccttcgcaggttacgtcggcatgctcacgggtttcaagcctggcctctttagcttgaccctgaacgagcgattctcgataaacggcggatacctgggcatcttagaatggatcctagggaagaaagacgttatgtggatcgggtttctgacccgtacagtgttggaaaactcaacatcctatgaagaggcaaagaatcttctgactaaaacgaaaatcctggcgccagcctacttcatactcgggggtaatcagtctggggaaggatgtgtaatcactcgagacaggaaagagtccctggatgtgtacgagcttgatgctaaacagggcagatggtacgtagtccagaccaactatgaccggtggaagcaccctttcttcctggatgatagacggactcctgcaaagatgtgtctgaatagaacgtcccaggagaatatcagcttcgaaaccatgtatgacgtgctatcaactaaacccgtcctgaataaactgactgtttacaccacgctgatcgacgttacaaagggacagttcgagacataccttcgcgactgtcccgacccttgcatcgggtggtag

SEQ ID NO: 4556 - DNA, 1113 bp, Artificial Sequence
  Description of Artificial Sequence: Synthetic coding sequence
atgcctggtaggagctgtgttgccctggttcttctggctgctgccgtcagctgtgccgtggcccaacatgctcccccttggactgaggattgccgtaagagcacctatcctccctctggtccgacctatcgtggagcagttccctggtacacaatcaatctcgacctgccgccttataaaagatggcacgagctaatgctggataaggccccagtgctcaaagtcatcgtaaatagcttgaagaatatgatcaacacctttgttccatctgggaagataatgcaagtggttgacgagaagctccctgggctgctcggcaacttcccgggaccgtttgaagaggagatgaaggggatcgctgccgtcaccgatatcccactgggtcacctaatccacgggaggaatatggacttcggcgtgtttctcgggtggaacataaataacgacacctgggtgattacggaacagttaaaaccgctcacggtcaacttggacttccagagaaacaacaaaaccgtattcaaggcctcctctttcgccggatatgttggtatgctgactggcttcaaaccgggattgttctcattgacactgaatgagcgcttctcaataaacgggggatacctaggcatactcgagtggatcctcgggaaaaaagatgtcatgtggattgggtttctgacacggactgttctggaaaattcaaccagctacgaagaggcaaaaaacctcctgaccaagacgaagatactagctcccgcttactttatactgggtggcaaccagtcaggggagggctgtgtgattacccgcgatagaaaggaatctctggacgtctacgaattggatgccaaacaagggaggtggtatgtcgtacagacgaactacgatagatggaagcaccctttcttcctcgatgaccgcagaacacctgcaaagatgtgcttgaatcgaacctctcaggaaaatatttccttcgagaccatgtatgatgttctgtctaccaaaccagtcctcaacaagttaacggtatacacgaccctcatagacgtgacaaaggggcagtttgaaacctacctaagggactgtccagacccctgcatcggttggtag

SEQ ID NO: 4557 - DNA, 405 bp, Artificial Sequence
  Description of Artificial Sequence: Synthetic coding sequence
atggacccgcagaccgctccctcccgcgcactcctgctcctgctctttttacacctagcttttttgggcggacgaagtcacccattaggaagccctggtagcgcatctgacctggagacgtctggcctccaagaacagcgaaatcacctccagggcaaacttagcgaactccaggtggagcagacgagcctggagccattacaggaaagcccacgacctacaggcgtgtggaagtcacgcgaagttgccacagagggaatccgcggtcacagaaagatggtcctgtacactctgcgggcacccagaagccctaaaatggtgcagggctccgggtgcttcggtagaaagatggaccgcatttcctccagctctgggctgggctgtaaggtgctgaggaggcattag

SEQ ID NO: 4558 - DNA, 726 bp, Artificial Sequence
  Description of Artificial Sequence: Synthetic coding sequence
atgtcgatgctgttttatactctaattacagcctttctcatcgggatccaggccgaacctcattcagagagcaacgtacccgctggccacacaatccctcaggctcactggaccaagttacagcattccctagatacagccctgcgcagggctcggtcagcgcctgccgctgccatagccgctcgggttgcaggacagactcgcaacatcaccgtcgatcctagactgtttaagaaaaggcgtcttaggagtcccagggtcctgttcagtacacagcctcctagggaggcagcagatactcaagaccttgactttgaggtaggtggagccgctcctttcaatcgcacgcatcggtctaagcgctcaagtagccatcccattttccatagaggggaattttccgtgtgcgatagtgttagtgtgtgggtgggggataagacaaccgctaccgacataaaagggaaagaggtaatggtgctgggtgaggtgaatattaataattctgtattcaagcagtacttctttgagacaaaatgtcgagaccctaaccctgtggactcaggctgtcgcggaatagattcaaagcactggaactcatattgcaccaccacccacacttttgtgaaagccctcacaatggatggcaagcaggcggcttggagattcattcgaatcgacactgcctgcgtatgcgtcctctctaggaaggccgtgcggcgagcttag

SEQ ID NO: 4559 - DNA, 1923 bp, Artificial Sequence
  Description of Artificial Sequence: Synthetic coding sequence
atgagtgaaagaaaggaggggcgaggtaaaggcaaaggaaaaaagaaagaaaggggaagcggcaagaagccagagagcgccgcaggaagccagtctcctgccctgccccctagactgaaggaaatgaaatcccaggaaagcgctgccggatcaaagctggtgcttagatgcgaaactagcagcgagtattcgagcctccgtttcaaatggttcaaaaatggtaacgaactaaatcgcaaaaataagccgcagaacattaaaatccaaaaaaagccgggaaaaagtgagctcagaatcaataaagcgtccctcgcagatagcggggagtacatgtgcaaagtgattagtaagctgggaaatgactctgcctcagccaatatcacaattgtcgaatctaacgaaatcatcacaggtatgcccgcttctacagagggtgcttacgtgagcagcgagagcccaatcaggattagtgtttctaccgagggcgctaacacatcatcctccacctccacctctactaccgggactagtcacctcgtaaagtgtgccgagaaagaaaagacattttgtgtcaacggcggagagtgttttatggtgaaggacttgtccaatccgagccggtatctgtgcaagtgccagcccggatttaccggggctcgctgcaccgagaacgtgcccatgaaagtgcagaatcaggaaaaggcagaagaactgtaccagaaacgggtcctgactatcacgggcatatgcattgccctgctcgtggtagggatcatgtgcgtagtggcctactgcaagacaaaaaaacagcgcaaaaaactgcacgaccgcctgaggcaatctctgcgctccgaacgaaacaacatgatgaacatcgcaaacggtccccatcaccccaatcctcccccagaaaacgtgcagttagtaaatcaatacgtgtctaagaatgtgatttcctctgagcacatcgtcgagcgagaggccgaaacaagcttctcgactagtcactacacgtccacagcgcatcactcaaccactgtgacccagaccccatctcatagctggtccaacgggcataccgagtcgattttgagcgaatcccattcagtaatcgtgatgtcatcggtcgagaacagtcgccactcttcccccacaggagggcctcggggaagacttaacggaactggcggaccgagggagtgtaacagctttctgcggcatgctcgagagacccccgacagctaccgtgactctcctcatagcgaaaggtacgtgtccgccatgacgacccctgcccgaatgagtccggttgattttcatactccgtcctcccctaagagcccaccctcagaaatgagccctccagtgagttctatgaccgtatccatgccttcaatggcagtttccccattcatggaagaggaacggccactgctgctggttacgcctccaagacttagggaaaagaagtttgaccatcaccctcagcaattttcatccttccatcataacccagctcatgactcgaatagcctccccgcatcgcctctgagaatcgtggaagacgaggaatatgagactacgcaggaatacgaaccagcacaggagcccgtgaaaaagctggctaattccaggcgggcaaagaggacaaagcccaacggacacatcgcaaaccgactggaggtcgattctaacacctcctctcagtcttctaattctgagtccgaaaccgaggatgaacgggtcggtgaagacacgccatttcttggtatccagaatccactggcggcttctctcgaggctaccccagcctttaggctcgctgattcaaggacaaatcccgctggaagattcagcacccaggaggagatacaggccaggttgtcttctgtgatagcaaaccaagacccaattgccgtctag

SEQ ID NO: 4560 - DNA, 1914 bp, Artificial Sequence
  Description of Artificial Sequence: Synthetic coding sequence
atgagcgagagaaaagagggtaggggtaaaggtaagggaaagaagaaagaacgcggatctggcaaaaaacctgagtctgccgcaggatcccagagcccggctctcccaccaaggctgaaggagatgaaatcgcaagagtccgctgcaggttcaaagctggtgctgcgatgcgaaacttcctctgaatattcttcccttaggtttaagtggttcaagaatgggaacgagctaaatcggaagaacaagccgcagaacatcaagattcagaagaaacccggaaaatccgagctccgaattaataaggccagcttggctgattctggggaatatatgtgtaaggttatcagcaagcttggcaatgactctgcttcggcaaacattaccatagttgaatctaacgagattattacagggatgcctgcatctacagagggagcctatgtgagctccgaatcccccatccgaatttccgtcagcacggaaggtgccaatacatcctcttcgacatcaacttccactaccggtacatcccatctcgtaaagtgcgccgagaaagagaaaacattttgcgtcaatggaggcgagtgttttatggtcaaggatttgagtaatccgtcacgctatctgtgcaagtgccccaatgaattcacgggggacagatgtcaaaactacgttatggcctctttctataaggctgaggagctctatcagaagcgtgtgctcaccattaccggcatctgtatcgcactgctggtcgtgggaattatgtgtgttgttgcttattgcaagactaaaaagcagagaaaaaaactccacgacagactcagacagtctctgagaagtgagcgcaacaatatgatgaacatcgcaaacggtccgcaccaccccaatcctccgccagaaaacgtccagttggtgaaccagtatgtgagtaaaaatgtgatttccagcgaacacatcgttgagagagaggctgagacctctttctccacaagccactacaccagcactgcccaccactctaccaccgtgactcagacacctagccactcctggagcaatgggcataccgagagcatcctgtctgaatcccactctgttatcgtcatgtcctccgtcgagaattcgcggcattcttctcctactggtgggcctcgtggcaggcttaatggaacaggtggtccaagggagtgtaacagctttctcaggcatgctagagaaactcccgacagctacagagactccccacattccgagcgttacgtgtcggccatgaccacaccagcccgtatgagccccgtggattttcacaccccttcaagtcctaagagcccgccatccgagatgagccccccagtctctagcatgaccgtgtccatgcccagtatggccgtaagcccgttcatggaagaagaacggccactactgctggtgaccccgcctcggttgcgagagaaaaagttcgatcatcacccccagcaattttcatcctttcaccacaaccccgctcatgattcaaacagtttgcccgcttctcccctgagaatcgtagaagatgaagagtatgaaacaactcaagaatacgagccagctcaggaaccggttaagaagctagccaacagtcgtagggctaagaggaccaagcccaatgggcatatcgccaacagacttgaagtggatagtaacacaagttctcagagctcaaattctgagtcagaaactgaagatgagagggtcggagaagacaccccattcctgggaattcagaaccccctggccgcatccctcgaagctacgccggcattcagactggctgattcccgcacaaatcccgctggacgcttcagtacccaggaagaaatccaggcccgattatccagtgttatcgccaaccaggacccaatcgcggtttag

SEQ ID NO: 4561 - DNA, 1836 bp, Artificial Sequence
  Description of Artificial Sequence: Synthetic coding sequence
atgtctgaacggaaagaaggaaggggcaagggtaagggtaagaaaaaggagagaggcagcggaaagaaaccagaatctgctgcaggcagccagtcccctgccctgccgccacgcctgaaagaaatgaaatcccaggaaagtgcggcaggttcaaaacttgtgctcaggtgcgagacaagctcagagtatagctctcttcgatttaaatggttcaagaacggaaatgaattgaatagaaagaacaaacctcaaaatattaagatacaaaagaagcctgggaagtccgaactgagaatcaataaagccagcttagccgacagtggcgaatatatgtgtaaagttatctccaaactcggcaatgattctgcatctgctaacattactatcgtggagtctaacgctacatctacctccactacagggactagtcacttggttaaatgtgccgagaaagaaaagactttttgtgtgaacgggggagaatgtttcatggtgaaggacttgagcaacccttcccggtatctgtgcaaatgccctaacgaatttaccggggatcgctgccagaactacgtgatggcaagtttctacaaacacctggggatcgagtttatggaagccgaggaactgtatcagaaacgggtgttgaccatcaccggcatttgtatagccctgctggtggtcggtatcatgtgtgttgtagcctactgtaaaacaaaaaaacagcgtaagaagctgcatgaccgtttacggcagagcctgcgcagcgaacggaacaacatgatgaacatcgcaaacgggccacaccatccaaatcctccgcctgaaaacgtacaactcgttaatcagtatgtatctaagaacgttatcagctccgagcacattgttgagcgagaagctgagacttctttctctaccagccattacacatccaccgcacaccattccaccacagtgacccagaccccttctcactcctggtccaatgggcatacagagtccatcctttctgagtcccattcagtgatagttatgtccagtgtggagaatagccggcactctagtcctacaggcggacctaggggtagactgaatggtacggggggacctagagaatgtaattcctttctgcggcacgctagagagacccctgacagctacagggactcacctcattcggagcgctatgtgtccgcaatgacaactcctgcacggatgagtcccgtggatttccacaccccttctagtcccaagtcccctccaagcgagatgtcacctccagtgtccagcatgacagtgagcatgccctcaatggcggttagcccgttcatggaggaggaacggcctctgttactggtcacaccgcctcgcctacgcgagaagaaattcgaccaccacccccagcaatttagctcatttcaccataaccctgcgcacgatagcaacagcctgcccgcaagccccctgcgaatcgtagaggacgaggagtatgagactactcaagagtacgagcctgcccaagagcctgtcaagaagcttgccaacagtcgtagagctaaacgaaccaagccaaacggccatattgccaatagattagaagtcgactcgaacacctcttctcagtcgtccaattccgagtccgagactgaagacgaaagggttggcgaagacacacctttccttggaatccagaacccgctggccgcatctcttgaagctacccctgcattcaggctcgcagacagcaggacaaaccctgctggtcgattctccactcaggaagagattcaggccagacttagcagcgtgatcgcaaatcaggacccaatagctgtgtag

SEQ ID NO: 4562 - DNA, 1947 bp, Artificial Sequence
  Description of Artificial Sequence: Synthetic coding sequence
atgagcgagcgcaaagaaggcaggggtaaaggaaagggaaaaaagaaagagcgcggttctggcaagaaaccagagtctgctgcgggatcccaatccccagcactgccgccaaggctgaaggaaatgaagagccaggaaagcgccgcaggctcaaagctagtgctccggtgtgaaacgtccagcgaatactcttccctgcggtttaagtggttcaagaatgggaatgagttgaataggaaaaacaagccacaaaatatcaagattcaaaagaaacctgggaaaagtgagttaagaattaacaaagcctccctggccgattcaggagaatacatgtgtaaggtgatttcaaaactggggaacgactcggcttctgctaatatcacaattgtcgaaagcaacgagatcattactggaatgcctgcgagcactgaaggagcttatgtgagctccgagtcaccaatacggatcagcgtgagcaccgagggcgcaaacacaagtagcagcacctctacctccaccaccggaacatcacacctggtgaaatgtgccgagaaagaaaaaactttctgcgttaatggaggcgaatgtttcatggtgaaggatctgagcaacccttcccgctatctttgtaaatgtcaacccggtttcaccggagctaggtgtacagagaatgtcccgatgaaagtgcaaaatcaggagaaacactccggcgagccatttccagaagccgaggaactataccagaaaagagtcctaactattacaggtatttgcattgccttactggtggtagggatcatgtgcgtcgtagcatactgtaagaccaagaagcaacgaaagaagctccatgaccggctccggcagtcactgaggtccgagcgcaacaacatgatgaacatagccaatggcccacatcaccctaaccctcctcctgaaaatgtgcaactagtgaatcagtacgtgagcaaaaacgtgattagttcggagcacatcgtggagagagaagccgaaacgtccttttctacctcccactatacgagcaccgcccatcacagcacaactgtgacccaaacaccatctcactcgtggtccaatggtcacacagagagcatactaagtgagagccattccgttattgtcatgagtagcgttgagaattcccgccactcctctccaaccgggggtcccaggggacgcctcaacggcaccggagggccacgcgaatgcaatagctttctgcgtcacgcaagggagacgcccgattcatatcgggattcgccacattctgaacgctatgtgtctgccatgacgacccccgctcgcatgagccctgtcgattttcataccccctcctcacccaagagcccgccatctgagatgtcacccccagtgtcttctatgactgtatcaatgcctagcatggctgtttccccctttatggaggaagaaagacctctgctgctggtgacaccgcctagacttcgggaaaagaagtttgaccaccatccacaacaattttcatcgtttcatcataatccagcacatgactctaacagcttacctgcttcgcctcttagaattgttgaagacgaggagtacgaaactactcaggaatatgaaccagcccaagagcccgtaaaaaagcttgccaattccaggagagcgaaacgaaccaaacccaatggacacattgcaaaccggctggaggtagactctaacaccagcagccagagctcaaactcagagtccgagaccgaagacgagagggtgggagaggataccccgttcctgggcattcagaatccattggcagcttcattagaagccaccccagccttccggcttgctgactcgaggacaaatcctgctggccgttttagcacccaggaggagatacaggctagactctcttcggtgatagccaaccaggatcccattgccgtctag

SEQ ID NO: 4563 - DNA, 744 bp, Artificial Sequence
  Description of Artificial Sequence: Synthetic coding sequence
atgtccgagcgtaaagaggggcgaggcaaggggaaaggcaagaagaaggagagggggtccggaaaaaaacccgaatctgcagcagggtcacagtcaccagcgctgcccccacggcttaaggaaatgaagagccaagaaagtgcggctggttccaaacttgttctgagatgcgagacctcttccgaatatagctccttgaggttcaaatggtttaagaatggcaatgagctcaaccgtaagaacaagccacagaatatcaaaatccagaagaagcccggaaagagcgaattgcgtattaataaggcctctctagccgatagcggtgagtatatgtgtaaggtgatttccaaactggggaacgacagtgccagtgccaatataacgatcgttgagtctaacgagattatcacaggtatgcctgcctccactgagggggcatatgtctcatctgagtcaccaattcgaatatctgtgagcactgagggcgctaatacatcgtcttctacttctacatccaccacgggcactagccatctcgtaaagtgcgcggagaaagagaagacattctgcgttaatggcggagagtgctttatggtgaaggatctctctaacccttctaggtatctttgcaagtgccagccagggtttactggtgctaggtgcactgaaaatgtacccatgaaggtccaaaaccaggaaagcgcacagatgtcactactggtcattgccgcaaagactacatag

SEQ ID NO: 4564 - DNA, 1938 bp, Artificial Sequence
  Description of Artificial Sequence: Synthetic coding sequence
atgtcagagagaaaagaggggagaggaaaggggaaggggaagaaaaaggaacgcggttccggcaagaagcccgaatctgcagctggatcgcagtcacccgctttgccacctagactaaaagagatgaaaagccaggaaagtgcagccggatccaagttagtgcttcgatgcgagacttccagcgaatactcgagcctgcggttcaagtggtttaaaaacggaaatgagttgaatagaaagaataagccccaaaacatcaaaatccagaaaaagccgggaaaatccgagcttcgaattaacaaggcgtcgcttgctgactctggagagtacatgtgcaaggtcatcagtaagttagggaacgatagcgccagcgcgaacattactatcgtcgaatccaacgagatcattactgggatgccagcctccacagagggagcatacgtttccagtgaaagtccgatacgaattagcgtcagcaccgaaggtgctaatacatcttcctcaacaagcaccagtacaacgggcacatcacatctggtgaaatgcgccgagaaagaaaaaactttctgtgtgaacggaggggagtgctttatggtcaaggatctgagtaatcctagccggtatctgtgcaagtgtccgaacgagtttacgggagacaggtgtcagaactacgtcatggcctcgttttacaaacacctgggaatagaatttatggaagctgaagaactctatcagaagagggtgctgacgattaccggaatctgtattgccctcctggtggtggggattatgtgcgtagtcgcttactgtaagactaagaaacagcggaaaaaactgcacgaccggctgcggcagtcgcttcggtccgagcgcaataatatgatgaatattgccaacggcccacatcaccctaatccgcctcctgagaatgtgcagctggtgaaccagtacgtgtccaagaatgtgattagtagcgagcatattgtcgaacgtgaggcagagacttctttctcaacatctcattatactagcacagcacaccatagtacgactgtcactcagaccccttcccactcctggtccaacggccacacagagtcaattctgtccgaatcccacagtgtcattgtgatgtcctctgtggagaacagtcggcattcaagccccaccgggggacccagaggcagactcaatggcactgggggtcccagagagtgcaattcttttctgcgacacgccagggagacaccggattcttaccgagactccccacactcagaacgatacgtgtctgcgatgactaccccagctcggatgtctccggtcgacttccacaccccgtctagccctaaatcgcccccatcggagatgtccccccctgtgtcttcgatgacagtctcaatgccctccatggccgtttcgccttttatggaggaagaacggccactgctactagttactccgcctcggttacgcgaaaagaagttcgaccatcatcctcagcagttctcgtcatttcaccataaccccgctcacgactcaaactctcttccggcatcccccctccgaattgttgaggacgaggagtatgagaccacacaggagtacgaacctgctcaggaacccgtgaagaagttagccaactctaggagggcgaaacggactaagcccaatggacatatcgctaaccggctggaagtggatagcaatacaagcagccaatctagcaacagcgaatctgagaccgaagatgagagagttggggaagacacccccttccttggcatccaaaaccctttagccgctagcctcgaggctacacctgcctttaggctggcggattctcgaaccaaccctgctgggcgtttcagcacccaggaggaaatacaagcgaggctgtcttcagtaatcgctaaccaggaccctatcgcggtctag

SEQ ID NO: 4565 - DNA, 1923 bp, Artificial Sequence
  Description of Artificial Sequence: Synthetic coding sequence
atgtctgaaagaaaggaagggaggggcaaagggaagggtaagaagaaggagagagggtccggaaagaaacctgagtcagccgctgggtctcagtcccctgcccttcctccacgtctgaaggaaatgaagagccaggagagcgccgctggcagcaagctcgtgctgagatgcgagacatcatccgaatactcttcactacgattcaaatggttcaagaacgggaacgagctcaaccgaaaaaacaagccccagaacatcaagatccaaaagaaacctgggaaaagtgagttgcgcattaacaaggctagtctggccgattctggcgaatacatgtgcaaagtaatctcaaaactcgggaacgattctgcctcagcgaacattactatcgtggaatccaatgagatcattacgggcatgcccgcaagcacagagggcgcatatgtgtctagcgaatcgcctataagaattagcgtgtccaccgaaggcgcaaacacctctagctccacatccactagtaccacaggcaccagccacctggtcaaatgcgcagagaaggagaagaccttttgcgtgaatggcggtgaatgcttcatggtgaaagatctcagcaatcctagccggtatctctgcaaatgccagccgggattcacaggggcacggtgcactgagaatgtcccgatgaaggttcagaaccaggagaaggccgaggaattgtatcagaagagagttctgacaatcaccgggatctgcatcgccttactggtggtcggcattatgtgtgtagttgcttactgtaagactaaaaagcaacggaagaagctacacgatagactaagacagagcttacggagcgagcgcaacaacatgatgaatatcgctaatggaccccaccatccaaatccacccccagagaacgtgcaactggtgaaccagtatgtctctaagaatgtgatttcttcagagcatatagtagagcgggaggcggagactagctttagcacctctcattacacgtctacggctcatcattctacaactgtgacccagaccccaagccacagctggagcaacgggcacacagagagcatcctgtccgagtctcattccgttatcgtcatgagtagcgtggagaactcgagacacagtagtcctactggcggtcccaggggcagactcaacggcacaggaggtccccgagagtgcaactccttcctgcgacacgctagggagactcctgattcgtaccgagattctccccatagtgaacgctacgtctctgcgatgactaccccagcccgtatgtctcctgtcgactttcacacgccatcgtccccaaagagcccgcctagtgagatgtccccaccagtgagctccatgacagtgtctatgccttctatggccgtctctcccttcatggaggaggagcgcccactgctactcgttacgccgcctcgattgagggagaagaagtttgaccaccacccacagcagttctctagcttccaccacaatccagcccatgactctaattcgctccctgcaagtccactgaggatcgtcgaagacgaggaatacgagactactcaggagtatgagccagcacaggagcctgtgaagaagctcgctaattcccggagggccaagagaactaaaccaaacggacatatcgcgaacaggctggaagtggactctaatacctcctcccagagttccaactctgagtcagaaaccgaagatgaacgagttggcgaggatacgccattcctggggattcagaaccctctggctgcatctctggaggctactccagcctttaggcttgctgatagtaggacgaaccccgcagggaggttctccactcaggaggagatccaggctaggctatcctcagtcattgcaaatcaagatccaattgccgtgtag

SEQ ID NO: 4566 - DNA, 1773 bp, Artificial Sequence
  Description of Artificial Sequence: Synthetic coding sequence
atgggaaaggggagggccggacgcgtgggtaccaccgcattacccccacggttgaaggagatgaaaagtcaagagagcgcagccggttctaagctggtactgcgatgcgagacttcatctgaatactccagcctcagatttaaatggtttaagaatggaaatgaattaaaccgaaagaacaagccccagaatatcaaaatccagaagaaaccaggcaagagcgagctgcgtatcaacaaggcgagcctggccgattcaggagaatatatgtgcaaggtgattagcaaactggggaatgatagcgcaagtgctaatatcactattgtggaaagtaacgcaaccagcacctccaccactgggacaagtcacttagtgaagtgtgccgaaaaagaaaagaccttttgcgtcaacggaggagagtgcttcatggtgaaggatctgtctaatccctctagatacctgtgcaaatgtccgaacgaatttacaggcgaccgctgccagaactatgtgatggccagcttttacaaacacctaggaattgaatttatggaagccgaagagctgtaccagaagagagtcttaaccattacaggtatatgtatcgctctgctagtcgtcggaattatgtgtgttgtggcatattgtaaaaccaagaagcaacggaagaagttacacgacaggctgcggcaaagccttaggtctgaacggaacaacatgatgaatatagcaaacggccctcaccatcccaatccgccaccagagaatgttcaattagtgaatcagtatgtgtctaagaacgtgatctcgagcgaacacatcgtggagcgggaagcagaaactagcttctctaccagtcattacacgtcaacggcacaccacagcaccaccgtgacacagacacctagtcactcatggagcaatggacatactgagtctatcctcagcgagagccactcagtcatcgtgatgtcatcagtggagaacagcaggcatagcagcccaaccggtggcccacgcggaaggctcaacggcactggcggacccagggagtgcaacagcttcctacggcacgctagggaaactccggacagttatcgtgatagtccacactccgagcggtatgtgagcgcgatgacaacacccgctaggatgagtcctgtagacttccatactccatccagcccaaagtcaccaccgagtgaaatgtctccccctgtgtcaagtatgaccgtttccatgccttcaatggctgtaagcccctttatggaggaagaacgcccactcctgctcgtgaccccaccaaggttacgcgagaagaaatttgaccaccacccccagcagttttcaagcttccaccataacccagcccacgattcaaactcactcccagcctcaccgctccgcattgttgaagacgaagaatatgagactactcaggaatatgagcccgcacaggaacccgtgaagaaattggcaaattcacggagggcaaagcggacaaagccaaacggtcatattgcgaaccgtctggaagtggatagcaacacctcttcccagtcatcaaattcagaaagcgagactgaggacgagagggttggggaggacaccccattcctcggcattcaaaacccactggcagcatctttagaggccactcctgctttccgcctggcagacagtcgcacaaatccagccggaaggttttcaactcaggaggagatccaggccaggctgtcctcagttattgcaaaccaggatcctatcgccgtctag

SEQ ID NO: 4567 - DNA, 1269 bp, Artificial Sequence
  Description of Artificial Sequence: Synthetic coding sequence
atgaggtggagacgtgcaccaagaaggtcgggaaggccagggccacgggcacagcgccctggttctgccgcacgcagcagtcccccactgcccctgctccccctcctactgctgctgggaactgctgccctggcaccaggcgctgcagccggaaacgaggctgcacccgcaggggcttccgtttgctactcaagcccaccatccgtgggctccgtccaggagttagcccagcgcgcagccgtggtaattgagggaaaggtccatcctcagagacgccaacaaggagcactcgaccgaaaggctgccgctgccgcaggagaggctggagcatgggggggagatagggaaccacccgctgctggccctagggcccttggcccacctgctgaagaacccctacttgccgctaacggaactgtgccttcctggcctactgctccggtgcccagtgccggagagcccggtgaggaggccccatacctggtgaaagtgcatcaggtgtgggctgtgaaagccggtggattaaagaaggatagcctgctcactgtgaggttggggacatggggccatcccgcttttccatcgtgtgggcgactcaaggaagacagccgctatatattttttatggagccagacgcaaattccacatctcgcgctcccgctgcttttcgagctagcttcccaccgctggaaaccggacgaaacttaaagaaggaagtgtctagagtgctgtgcaaacggtgcgcattgccccctcggttgaaggagatgaaaagccaggagtccgcagctggctcaaaactggtcctccggtgcgagactagtagcgagtacagcagtctgcgattcaagtggttcaaaaatgggaatgagcttaacaggaagaacaaacctcagaacatcaaaattcagaaaaagcctggcaagtcggagcttcgcattaataaagcctctctagccgactcaggagaatatatgtgtaaagtgatctccaaacttgggaatgatagtgctagtgccaacattacaatcgtggagtcaaatgcaactagcactagcactaccggtacatctcatctcgtgaaatgcgcagagaaagagaagaccttttgtgtgaatggaggagagtgcttcatggttaaagacctgagcaacccgagtcggtacctgtgcaagtgtcctaatgaatttaccggggaccggtgtcagaattatgttatggcctccttttatagtacctccactccatttttgagcctcccggagtag

SEQ ID NO: 4568 - DNA, 891 bp, Artificial Sequence
  Description of Artificial Sequence: Synthetic coding sequence
atggaaatttacagcccagacatgtctgaagttgccgcagagcgcagctccagtccatcaacccaactgtcggctgatccatcccttgacggactccccgctgctgaggacatgcctgaaccccagaccgaagatggcagaactcccggactcgtaggcctggcggtgccttgttgcgcttgtctggaggccgagcggcttcgagggtgtcttaacagtgaaaagatctgcatcgtgcccattttagcttgcctcgtgtcactgtgtttatgtatagctggtcttaagtgggtgttcgtagataagattttcgagtatgattcaccaacccacctggaccccggagggctgggacaggatcctatcatttctctcgatgctactgctgcctccgctgtgtgggtgtcctcagaagcctacacgagcccggtcagtagggctcagagcgaatccgaagtgcaggtcactgttcaaggcgataaagcggttgtcagcttcgaaccttcagccgcacctacccctaaaaatcggatttttgccttttcatttctgccgagtacagcacctagttttccttcccccacccgaaaccccgaagtgcgtacacctaagtcggctacacagccgcaaactacagagacaaatttacagactgcccctaaattgtcaactagcacttcaacgactggaactagtcatctcgtgaagtgcgcagaaaaggagaaaaccttttgtgttaatggtggagaatgcttcatggtaaaggatctttccaacccctcacggtatctgtgcaagtgtcctaatgagtttactggagatcggtgccagaactatgtgatggcaagtttctactcaacctccacgccgttcttgtcactccctgagtag

SEQ ID NO: 4569 - DNA, 1389 bp, Artificial Sequence
  Description of Artificial Sequence: Synthetic coding sequence
atgtccgaacgcaaggagggacgcggtaaggggaagggcaaaaaaaaagaacgcggaagtggaaagaaacctgagtctgcagccggaagtcagtcaccagcccttcctccccgtctgaaggaaatgaaatcacaagaaagtgcagctggctcaaagctggtcctgaggtgcgagacttctagtgaatattctagcttgagatttaaatggttcaagaatgggaatgagcttaatagaaaaaataagccgcaaaatatcaaaattcagaagaaacccggaaaatccgagttaagaataaacaaggccagccttgctgattctggagaatatatgtgtaaggttatctcaaagctgggcaacgactccgcaagtgccaacatcacaatcgtggagtccaacgagataatcacaggcatgccggcatcaacagagggcgcttatgtgtcaagtgaatctcctatcagaatctccgtatcgaccgagggcgctaacacatcctcctcaaccagtacctccaccacaggcacttcccatctcgtcaagtgtgctgagaaagaaaaaaccttttgcgtaaacggaggcgaatgttttatggtgaaagatctgtcaaacccctcacggtacctctgtaaatgtcagcccggtttcacaggggcaagatgtacagaaaatgttcctatgaaggttcagaatcaggagaaggcggaagagctgtatcagaaaagggtgctcaccattacaggtatctgcatcgccctgctggtggtcgggatcatgtgcgtagttgcttactgcaaaacgaagaagcaaagaaaaaagctgcacgacaggctccggcagagcctgagatccgaaaggaataacatgatgaatattgcaaatggccctcaccaccccaatcctccccctgagaatgtgcagctcgtcaaccagtatgtgagtaagaacgtgatctcaagcgagcatatagtggaacgggaggcagaaacctctttctctacttctcactatacgtcaacagcacaccattccaccactgtcacacagaccccctcacacagctggtcgaatggccacaccgaatccattctgtccgaaagtcactccgtgatcgtcatgagcagtgttgagaactccagacatagctcacctacaggaggcccacggggaagactcaacggaaccggaggccctagggagtgcaacagcttcctacgccatgctagggaaaccccggattcgtacagagatagcccacacagcgaacgccataatcttatcgccgaacttcggagaaacaaagctcatcggagcaaatgcatgcagatacagctctctgccacccacctccggtcgtcaagcattcctcatcttgggttcatcctgtag

SEQ ID NO: 4570 - DNA, 1452 bp, Artificial Sequence
  Description of Artificial Sequence: Synthetic coding sequence
atgcagatccccaaacacattagcattgaagacatcacagccacctcaaccagtaccacaggtacatcccaccttgtcaagtgcgcggagaaggagaagactttctgcgttaacggcggagaatgcttcatggtgaaagacctgagtaacccaagccgttacctgtgtaagtgcccaaacgagttcaccggcgatcggtgccagaattatgtaatggccagcttttataaggccgaagagttatatcagaaaagagttttgactataactggcatttgcatagctttgcttgtcgtggggataatgtgcgtggtcgcctattgcaagaccaagaagcagcggaagaagctccatgatagattacgccagagcctgcgctccgagcgcaataacatgatgaacattgccaatggaccccatcatcctaatccaccccctgagaacgtccagctcgtgaaccagtacgtgagcaagaacgtgatttctagcgaacacattgtggagcgggaagccgagactagtttcagcacatctcattatacctctacagcccatcactccacaaccgtcactcagacgccttctcattcgtggtccaatggacacaccgagtccatcttgtctgaaagtcactcagtcatcgtcatgtcctctgttgaaaactccaggcatagctccccaacgggaggccctcgtggcaggttgaacggtactggaggccctcgcgagtgcaacagcttcctgcggcatgccagagaaacccccgattcttatcgggacagtcctcatagcgagcgctacgtaagtgcaatgactactcctgctagaatgtcacccgtcgatttccacacaccctcgagtcccaaatctcctccctctgaaatgtctcctccagtgtcaagcatgaccgtcagcatgccctccatggctgtgtcccctttcatggaggaagagaggcctctgcttctggtaacccccccaagactgcgagaaaaaaaatttgaccaccatcctcagcagttcagttccttccaccataatccagcgcatgattccaacagcctgccagcttctccccttcgcatcgtggaggatgaggagtacgagacaacacaggagtacgagccagcacaggagcctgtcaaaaaactggctaactctcgacgagctaagagaactaagccaaacggacatattgcgaaccggctggaggttgactccaatacatcatcccagagctcgaattcggaatctgaaacagaggacgagagggtgggagaggatactcctttcctgggaatacagaatccattggcggcttctctggaggctactcctgcatttaggctggccgacagtcgaactaaccctgcaggtagattttctacccaggaagaaattcaggcacggctgtcttccgttatcgccaatcaggatcctatcgctgtgtag

SEQ ID NO: 4571 - DNA, 1263 bp, Artificial Sequence
  Description of Artificial Sequence: Synthetic coding sequence
atgtcagagcgcaaagaaggcagagggaagggcaagggcaagaaaaaagagcgcggtagcggaaaaaagcctgagtccgcagccggttcacagtctcccgctttacctcccagactgaaagagatgaaatctcaggagagcgccgctggatcaaagctggtattgcgctgtgaaacctctagtgaatactctagccttcgcttcaaatggttcaagaacgggaatgaactaaatcggaaaaacaaaccgcaaaatattaagatacaaaagaaacccggtaaatccgaattacggatcaacaaggcatccctggcagacagtggggaatatatgtgtaaagtgatctccaaactcggcaacgattcagcatctgccaatatcaccatcgttgaatcaaatgagatcatcactggcatgcccgcaagcaccgaaggagcttatgtgtcctcagaaagcccgatccggatcagcgtgtccaccgagggggcaaacacttcgagctctacttctacgtctactacaggaacaagtcatttagtaaagtgtgcggaaaaggaaaaaacgttctgtgtgaacgggggagaatgtttcatggtcaaggatctgagcaaccctagccggtacctctgtaagtgccccaacgagtttactggtgatcggtgccaaaattacgtgatggctagcttctacaaagccgaggagctttatcagaagagggtcttaacgattaccgggatctgcatcgccttactcgtggtgggtataatgtgtgtagtcgcctactgtaaaacaaaaaagcaacgcaaaaagctgcacgatagactacgccagagcctacgaagcgaaagaaataacatgatgaacattgctaacggaccccaccacccaaatcctcctcctgaaaacgttcagctcgtgaaccagtatgttagtaaaaacgtgatctcatccgaacacatagttgaaagagaggcagaaacctccttttccacttcacattatactagcaccgcgcaccattccactactgtcacccagaccccatcgcacagttggagtaacgggcataccgaatcaattctgagcgagtctcacagcgttatcgtgatgtctagtgtcgaaaactctaggcacagctctccgactgggggtccacgcggaaggctgaatggcaccgggggaccaagagagtgtaactcattccttaggcatgcccgagagactcctgattcttaccgagattctccgcacagcgagcggtag

SEQ ID NO: 4572 - DNA, 1065 bp, Artificial Sequence
  Description of Artificial Sequence: Synthetic coding sequence
atgttatttaatctgcgtatccttctgaacaatgccgcattccgcaatggtcataactttatggtccggaattttcgatgtggccagccactccagaacaaagtgcagcttaaaggacgtgacctgcttactctgaagaatttcaccggggaagaaatcaaatatatgttgtggttgagcgcggacttaaaatttcggattaagcagaagggagagtatctgccgcttctccaaggcaaatccctgggcatgattttcgaaaagcgcagtaccaggactcggctctcaactgaaactggcttcgcattattagggggtcatccctgtttcctgaccacacaggacattcatcttggtgtgaatgagagtctcaccgataccgcaagagtcctgagctcaatggccgatgccgtgttagcccgagtgtataagcaaagcgacctagacacactcgctaaggaagcatccatccctattatcaacggacttagtgacctttatcaccccatacaaatacttgccgattaccttactctgcaagagcactactcaagtttaaaaggtttgacgctgtcatggatcggcgatgggaataacatactccattccatcatgatgagcgctgctaagttcggaatgcatctgcaggccgctaccccaaaggggtacgaaccggacgcttctgtgacaaaactagccgaacagtacgccaaagagaatggcacgaagctcctcctgaccaacgacccgctcgaggccgcacacggaggtaacgttctgatcacagacacatggatttcaatgggccaagaagaagagaagaagaaacggctgcaagcattccaaggttaccaggtgactatgaagacagctaaagtggccgctagcgactggactttcttacattgcctgcccaggaaaccagaggaggtggatgacgaagtgttctactccccacgcagtctagtgttccctgaagcagagaaccggaaatggacaataatggccgttatggtaagccttttgactgattactcgcctcagctgcaaaagcctaagttttag

SEQ ID NO: 4573 - DNA, 348 bp, Artificial Sequence
  Description of Artificial Sequence: Synthetic coding sequence
atgatccccgctaaagatatggctaaggtaatgattgtaatgcttgccatttgttttctgaccaaaagcgacggcaagtccgttaagaaaagatcagtctctgaaattcagctcatgcataatctgggtaagcatctgaattccatggagcgagtggagtggctgcgaaagaaattacaggatgtccacaatttcgtggccctcggggcacccctggccccaagagacgccggtagccagcgaccccgtaaaaaggaagataatgtgttggttgagtctcacgagaaaagccttggcgaggcggacaaagctgacgtcaacgtcctaacgaaggccaaatcccagtag

SEQ ID NO: 4574 - DNA, 348 bp, Artificial Sequence
  Description of Artificial Sequence: Synthetic coding sequence
atgattcccgctaaggacatggcgaaggtaatgatcgtgatgcttgctatatgctttcttacaaagtctgatggaaagtcagtgaaaaaacggagcgtgtctgaaatccagctgatgcacaatctcggcaagcaccttaattcaatggagcgcgtagagtggttacgcaagaagctccaagacgtgcataacttcgtggcattgggcgctccactggcgcctcgtgatgctggcagccagcgacccaggaaaaaggaagataatgtactggtagaatcacatgaaaaatcattaggagaggcggataaggccgatgtaaatgttctgactaaagccaagagccagtag

SEQ ID NO: 4575 - DNA, 354 bp, Artificial Sequence
  Description of Artificial Sequence: Synthetic coding sequence
atgtcaaccgccgtgctggaaaatccagggctgggtcgaaagctgtccgactttggccaggagacttcatacatcgaggacaactgtaaccagaacggcgctatcagcttgatcttttccttaaaggaggaagttggcgcattggcaaaagttctgcggctgttcgaagagaatgacgtgaatttgacccatattgagtcccggcctagccgcctgaaaaaggacgaatacgagttctttacacacctggacaagcgtagtctgccggctttgaccaacataatcaagattctgaggcacgacatcggcgcaactgtgcatgaattgtctagagacaagaaaaaagatacctag

SEQ ID NO: 4576 - DNA, 411 bp, Artificial Sequence
  Description of Artificial Sequence: Synthetic coding sequence
atgtccaccgcagtccttgaaaaccctggactgggcaggaaactatcagatttcggacaggaaacgtcttacatcgaagataattgtaatcagaatggagcgatttccctaatcttcagccttaaggaagaggtaggcgcactggccaaggtactgagactgttcgaagaaaacgacgtgaacctgacccacatcgaatccagaccctctagacttaagaaagacgaatacgaattttttactcatttggataagaggtccttgcctgctcttaccaatataattaagattctgcgccacgatattggagccactgtgcatgaactgtctcgcgataagaagaaggacacagtcccctggtttcctagaacaattcaggagctggaccggttcgctaatcagatcctctag

SEQ ID NO: 4577 - DNA, 1359 bp, Artificial Sequence
  Description of Artificial Sequence: Synthetic coding sequence
atgtctacagccgtgctggagaaccctggtcttggcaggaagctgagtgacttcggacaggagacttcttacatcgaagataattgtaatcagaacggcgcaatctccttgattttctcacttaaggaggaggtgggcgcactggcaaaagtgctacgactttttgaggaaaacgatgtcaatcttacacatattgagagtaggccatctcggcttaaaaaagacgaatacgagtttttcacccatctggataaacgctctttaccagcccttaccaacataattaagatcctgagacatgacattggcgctacggtgcacgagctatctcgtgacaaaaagaaggacacagtgccatggtttccccgaactattcaagaattggaccgcttcgccaatcaaattctgagctacggtgcagagttggacgctgaccatcccggtttcaaagatccagtttaccgagccagaagaaaacaatttgccgacattgcctacaattaccgacacgggcagcccatccctagggtcgagtacatggaggaagagaagaagacttggggtacagtctttaaaaccctcaagagtctctataagacacacgcctgttatgagtataaccatatcttcccccttcttgaaaagtactgtggcttccatgaggacaacataccccagttggaggacgttagccaattcctccaaacctgtacggggttcagattaagacccgtagctggtctgcttagctcacgcgactttttgggcggtcttgcattccgggtgttccactgcacacagtacatccgtcacgggagcaagcccatgtacactcccgaacccgacatctgtcacgaactgctcgggcacgtgcccctcttctcggaccggtcctttgcccagttcagccaagaaatcggcctcgcctccctcggagccccagacgaatacatcgagaagttggccacgatctactggttcactgtggaattcggcctttgcaagcagggagactcaattaaggcctacggcgcaggcttattgtcctctttcggtgagcttcagtattgcctaagtgagaaacccaagctcctcccactcgagctggagaaaacagctatccagaactacacagtgactgagtttcagccactgtattacgtggcagagtctttcaacgatgcaaaggagaaagtaagaaactttgccgctaccatcccacgcccttttagtgtgcggtacgatccctatacgcaaaggattgaggtccttgataatactcagcaactaaagattctcgcggacagcataaatagtgaaattggcatactatgcagtgccttgcagaaaatcaagtag

SEQ ID NO: 4578 - DNA, 3261 bp, Artificial Sequence
  Description of Artificial Sequence: Synthetic coding sequence
atggcatgcagccccgacgccgtcgtgagcccctccagtgcttttctgcgctcgggctccgtatacgagccactgaagtccattaacctccccaggccggataacgagaccctgtgggacaaattagaccattattatcggatcgtgaaatctacactcctgctttaccagtcccccacaaccggactgttccccaccaagacgtgtggcggagatcaaaaggctaaaatccaggactccctctactgtgcagcaggagcgtgggccctggccctggcatatcggagaatcgatgacgataaagggaggactcacgaactggagcatagtgcaatcaagtgtatgcggggtatactgtactgctacatgcgacaagctgacaaggtacaacagttcaaacaagatccgaggcccacaacttgtctgcactcagtgtttaatgttcacacaggcgatgaacttctcagctacgaagaatatgggcacctgcagatcaacgcagtgtccctgtacctgttgtacctcgtcgaaatgatatctagcggactccaaatcatttacaacaccgacgaagtttcattcatccagaacctggtgttttgcgtcgagcgggtatatcgagtccctgattttggtgtgtgggaacgaggatcaaagtataacaatggttcaaccgaacttcactcatcttccgtcggactggctaaggccgcattggaggccattaatgggtttaacttgtttggtaaccagggttgcagttggtccgtgatatttgtggacttggacgcccataacaggaataggcagacgctgtgctccctgctgcctagagaatcacgctcccacaacaccgacgcggctctgttaccctgcataagctacccagcattcgccctcgatgatgaagtgcttttctcccagacactggacaaggtcgtcaggaaattgaaggggaagtacgggtttaaaagattcctgcgggatggttaccggacttctttagaggacccaaaccgatgttactacaagccagcagagataaagctctttgatgggattgagtgcgagttccccattttttttttgtacatgatgatcgatggagtgttcagaggaaaccccaaacaggtccaggagtaccaggacctattgacccctgtgctgcaccataccacagaagggtatccagtcgtgccaaaatattattatgtgccagctgacttcgtggagtacgaaaagaacaaccccggatctcagaagagatttccgtccaattgtggtcgtgatggcaagctctttttgtggggacaggctctatacattatcgctaaactgctagctgacgagcttattagtcctaaggacatcgaccctgtgcagcgctacgttcctctcaaagatcagagaaatgtctccatgagatttagtaaccagggcccactggaaaatgatcttgttgtccatgtcgcgttaatcgcggagtcacagcggctgcaggtattcctcaatacatatggaattcagactcagacacctcagcaggtggagccaatccagatatggccgcaacaggaactcgtcaaggcctatttacaactgggcatcaatgagaagctagggttgtccggcagacccgacaggccaataggttgtcttgggacctccaaaatctacaggattctaggcaaaacagtcgtgtgttatcctattatttttgacctgtccgatttctatatgagccaggacgttttcttgcttatcgatgacatcaaaaatgccttacagttcattaaacagtactggaaaatgcacggaagacccctgttcctcgtgctgatcagggaggacaacattcgcggaagcagatttaaccctatactggacatgctggccgctttgaagaaaggcatcataggaggagtgaaagtgcacgtggatcgcctgcaaacgctcatctctggcgcagtggtggagcagctcgatttcctgaggatctcagatacagaggagcttcctgaatttaagtccttcgaggagctggagcctcccaaacatagcaaggtgaaaagacaatcctccacaccatctgctcccgaactcggccagcagcctgatgtcaacatttctgagtggaaagataagcctacacacgaaattctccagaagcttaatgattgtagctgcctggcatcccaggctatcctgctgggtatcttgttaaaaagggagggccctaacttcatcaccaaggagggcacagtgtccgaccatatcgagcgagtgtaccgccgagccggaagccagaagttatggagcgtcgttcggagagctgcttctcttctatctaaggtggtggactcccttgcaccttccattacgaacgtactcgtccagggaaagcaggttacactcggagcctttgggcatgaggaggaggtgatcagtaatcctctgtcccccagggtcatccagaatattatctactacaagtgtaatactcacgatgaacgagaagccgtaattcaacaggagctggtgatccacattggctggataatatccaacaacccagagcttttcagcggtatgttaaagatcagaatcgggtggatcattcacgccatggaatatgaactccagatcagaggaggggacaagcctgccttagacctttatcaattgtcaccgagcgaagtaaaacaactactcttagatatactccagcctcagcaaaatggtcgttgttggttgaaccggaggcaaatagatgggagcctcaaccgcacacctactgggttttatgatcgggtgtggcaaattctggaacggacaccaaatggtatcatcgtggccggtaaacatttgcctcaacaacccactctcagcgacatgaccatgtatgagatgaacttctctttgttagttgaagatacactcgggaatatcgatcaaccgcagtaccgtcagatcgtggttgagttacttatggtggtgagtattgtcctggaaaggaacccggagctcgagttccaggacaaagtcgacctggaccgtctggtcaaggaggctttcaacgagttccagaaagatcagagccggctcaaggaaatcgaaaaacaggatgatatgacttcgttctacaacacaccgcctctaggcaagcgaggcacctgttcctaccttacgaaggccgtgatgaacctgttactggagggagaagttaagccgaacaatgacgacccatgtctgatcagctag

SEQ ID NO: 4579 - DNA, 1221 bp, Artificial Sequence
  Description of Artificial Sequence: Synthetic coding sequence
atgacacttgatgtgggacccgaagacgagctgcctgattgggccgctgccaaggaattttatcagaagtatgacccaaaagatgtgatcgggaggggcgtttcaagtgttgtgcggagatgtgtgcatcgtgcgactgggcacgaatttgccgtcaagataatggaggtgaccgcagagcgcctcagcccggaacaattggaggaagttcgggaggctacacggagagagacccacatactccgacaggtagccggtcacccacacattattacactgatcgatagctacgagtcatccagctttatgtttctggtcttcgatctgatgcggaagggtgagttgtttgattacttgacagagaaagtggctctgtcggagaaagaaacacgcagcatcatgaggtcactcctggaggccgtgtctttcctgcacgctaataacatcgtgcaccgcgatctgaaaccagagaatatcttactcgatgacaatatgcagattcgcctgtccgatttcggcttttcgtgccacctggagcctggagaaaaactcagagaactgtgtggcacacccggatacctggctcccgagatcctgaagtgtagcatggatgagacccacccgggatacggtaaggaggtggacctgtgggcttgcggagtcattttatttaccctgctcgctggctcaccacccttttggcatagaaggcagattctcatgctaaggatgattatggagggtcagtaccagttcagctcacccgagtgggacgacagatcatccacagtgaaggacttgatctctagactcctgcaagtggacccggaggctaggttgaccgccgaacaagccctccagcacccttttttcgagcgatgtgagggtagccagccttggaatttgacgcccaggcagagattccgggtggcagtctggactgtgttggctgcaggcagagtggccctgagtacacacagagttagacccctgacaaaaaatgctctgctgcgggatccttacgcactgcggtctgtcagacacttgatcgacaactgcgcgttccggctttacgggcactgggtgaagaagggcgagcagcagaatagagccgcactgtttcagcatcgccctcccggtccttttcctatcatgggaccggaggaagaaggcgactctgccgctattaccgaagacgaagccgtgctcgtgctagggtag

SEQ ID NO: 4580 - DNA, 3708 bp, Artificial Sequence
  Description of Artificial Sequence: Synthetic coding sequence
atgcgatcccgctccaattcgggcgtgaggctcgatggctatgctcgtcttgtacagcagacgatcctgtgctaccagaaccctgtgacaggtctcctgtcggctagccacgagcagaaggacgcgtgggtccgtgacaatatttacagcatcctggctgtatggggcctggggatggcctaccggaagaacgccgaccgggatgaggacaaggcgaaggcttacgaactggagcagaatgttgttaaattgatgcggggtttgctgcagtgtatgatgcggcaggtggcaaaagtggaaaagtttaagcacacacagtcaactaaggattccctgcatgcaaaatacaatacggcaacctgcggtaccgtggtcggcgatgatcagtggggtcatctgcaggtggatgcaacatcacttttcctactgtttctggctcaaatgacagcttcagggctccgcattatctttactctcgatgaggtagccttcatccaaaacctggtcttctacattgaagctgcctacaaagtggcagactacggtatgtgggaacgcggtgacaagaccaatcagggaatacctgagctaaacgcatcttctgtgggaatggccaaggcagcactggaggcgattgacgagctagatctgttcggcgcacatggcggtaggaagagcgtaatacatgttctccccgatgaagtggagcactgtcagagcattctattcagtatgttgccccgtgcctctacgtcgaaagagatcgatgctggtctcttgagcatcatctcttttcccgcatttgccgtggaggacgtgaatctcgtgaacgtaacaaagaacgagatcatctctaagctgcaaggccgttatggctgttgcagatttctgagggacggctataaaaccccccgagaagatccgaatagactgcattacgacccagccgaactcaagctgttcgagaatattgaatgtgagtggccagtcttctggacatattttatcattgacggagtgttctcaggagatgccgtccaggtgcaagagtaccgagaggctctagaagggatactgattcgtgggaaaaacgggatcaggctagtgcccgaactgtatgcagttcctccgaataaagtagacgaggagtacaaaaatcctcatacagtagaccgggtgccgatgggcaaggtaccacacttgtggggacagtctctgtacatcctgtcctcgctgctggcagagggctttctcgctgcgggagagattgatccactgaatcgtcgcttcagcaccagtgtcaagcccgacgtggtagtgcaagttaccgtgcttgccgagaataaccacatcaaagacttgcttaggaagcatggtgtgaatgtccaaagtattgcggacattcatcccatacaggttcagcctggccgaattctaagtcacatttatgccaagctcggaaggaataagaacatgaatctgagcgggaggccttaccgacatataggggtgttgggaacctccaagctgtatgtaatccgtaaccagattttcacctttaccccgcagttcactgaccaacaccacttctaccttgcgctcgataacgaaatgattgttgagatgctgcgaatcgaactggcatatctatgcacgtgctggcggatgacagggcgtcccacccttacttttccaatctcacgcaccatgctgacaaacgatggcagcgatatccactccgctgtgctgtccacgatccggaaacttgaggatggctacttcggtggcgcaagagtcaagctgggaaacctaagcgaattcttgaccacaagcttctatacgtacctcaccttcctggacccggactgtgacgagaaactatttgacaatgcatcagagggaacttttagccctgactcagattccgacctggtgggctatctggaagacacttgtaatcaggaatcccaggatgaactggaccattacatcaatcatctgctccagtctacatccctgaggagttacctaccaccattatgtaaaaataccgaggacagacacgtcttctctgcaatccattcaaccagagatattcttagtgtaatggcaaaggccaaggggttggaggtaccgtttgtgcccatgacgcttcccaccaaagtactgtctgcccaccgcaagtctctgaatctcgtagactctccacagccccttttggagaaggtgccagaatctgacttccaatggccacgtgatgaccatggcgacgttgactgcgaaaagctcgttgaacaactgaaagattgttccaatctccaggaccaagcggatatactgtatatcctatacgttataaagggaccttcctgggacaccaatctgagcggccaacatggggtgactgtgcaaaacctactcggggagctttacggcaaggccggactcaaccaagagtggggcctcattaggtatatctcaggcctgctgcgcaaaaaggtggaggtactggccgaggcttgtacagacctcctcagccaccagaaacagttaactgtgggcctgcctccagaacccagggagaagattatctctgcccctctgcccccagaagagctcaccaagctgatctacgaggctagtggtcaggacatcagtattgccgtgcttacgcaggaaatcgtggtgtatctggcaatgtatgtgcgagctcaacctagcctgttcgtcgagatgttgcgccttcgcatcgggctgataatccaggttatggccacggaacttgcacggtccctgaactgttcgggggaagaggcaagtgagtccctaatgaacctgtctccctttgatatgaaaaatctgttgcaccatattctgagcgggaaagaattcggggtcgagcggtctgtgcgccctatccatagcagcacctcatccccgactatttccatccatgaggtgggacacaccggcgtgactaagaccgaaaggagcgggattaacaggttaaggtccgagatgaagcagatgacacggaggttcagcgccgacgaacagttttttagtgtgggccaagctgcctcgtctagcgcccactccagcaagagcgccaggtcctcaaccccgtccagcccaaccggtacttcctcgtctgactccgggggtcaccacattggctggggtgagaggcagggacagtggctgcgtcgtagacggcttgatggtgccatcaatcgcgttcccgtcggattttatcagagggtgtggaagatccttcagaagtgccacggactatccatcgacggatacgtacttccttcgtctactacacgggaaatgaccccccatgaaatcaagtttgctgtgcatgtggagagcgtgcttaatagagtaccacagcccgagtacagacaactcctcgtggaagccattatggtcctgacactgctgtccgataccgaaatgaccagcatcggcggtattattcatgtagaccaaatcgtccagatggctagccagctgttcctacaagatcaggtctccataggagctatggatacccttgaaaaagatcaggcgactggaatttgccattttttttacgatagtgccccaagtggcgcatacgggactatgacatacctcactagagctgtggcttcatatttgcaggaattactacccaatagtggatgccagatgcagtag

SEQ ID NO: 4581 - DNA, 3261 bp, Artificial Sequence
  Description of Artificial Sequence: Synthetic coding sequence
atggcgtgtagtcccgacgcagtggtctctccttcatctgctttcctgcgttccggttcagtgtatgaacctctgaagtccatcaacctgcccaggccagataacgaaaccctgtgggacaaactagatcattactacagaatcgtcaagtctacacttctactgtatcagtccccaaccaccggcctgttccctacgaagacatgcggaggagatcaaaaggccaaaatccaggattctctttattgcgcggcaggggcatgggccctcgctcttgcctaccgcaggattgacgacgataaaggcaggacgcacgaactggaacatagcgcaattaaatgcatgaggggaatcctgtattgctacatgaggcaggctgacaaggtgcaacaatttaagcaggatccccgtccaacaacatgtctgcattccgtcttcaatgttcacactggcgacgagctgctgtcctacgaggagtacggccaccttcagattaacgccgttagtctctacctgctgtatctggtggagatgatctcctccggtttgcagattatttataatacagatgaagtttcattcattcagaatctggtcttctgcgtggagcgtgtctaccgggtccctgatttcggtgtttgggaacggggatcaaaatataataacggcagcaccgagctgcactcatccagcgtaggtctggccaaagcggctctggaggcaattaacgggttcaatctgttcggcaatcaaggctgtagctggagcgtaatttttgtggatctggacgcccataaccgaaatcgccaaaccctgtgctctcttctgcccagggaatccagaagtcataacactgacgcagctttgctgccctgcatctcctacccagccttcgcactcgacgacgaggttctgttctctcagacgcttgacaaagttgtacggaaactgaagggcaagtacggatttaagcggtttctccgcgacggttatagaacttccctcgaggacccaaaccggtgctactacaagccagctgagataaagctgtttgacggtattgagtgtgagttccctatcttctttctctatatgatgattgatggggtctttaggggtaaccccaagcaagtccaagaatatcaagatcttctgacccccgtcttacatcacactacagaaggatatcccgtcgtgcccaagtattattatgttcctgccgacttcgtggaatacgaaaagaacaaccccggaagccaaaaacggttccctagtaattgcgggcgagacggcaagctgttcctttggggtcaggctctctacattattgccaagctgcttgcagatgagttaatttcccccaaggacattgatccggtgcagaggtatgtacctctgaaagaccagcgaaacgtgtccatgcggttttctaatcaggggccattggaaaatgacctggttgtgcacgtcgcccttattgccgagtcccagagactgcaggtattcctgaatacatacggtattcagacacagactccgcagcaggttgaaccaatccagatctggccccagcaggaactggtaaaagcgtacctgcagctgggcataaatgagaaactcgggctgtctggccgaccagaccggccaattggctgtctgggtacgtcgaagatctacaggatactggggaaaactgtggtctgctatcccatcatttttgacctctccgatttctacatgtcacaggacgtgttccttctgattgacgatattaagaacgcgctccagtttatcaagcagtactggaagatgcatggtaggcccctgttcctagtgctgatacgagaggacaatatcaggggcagccggtttaatcccatcctggatatgttagctgccctgaagaaggggattatcgggggagttaaggtgcatgttgatcggctccaaactttgattagcggagctgtggtggagcaactcgacttcctccgcatatctgacaccgaggaactgcccgagttcaagtcttttgaggagcttgagccaccgaaacattcaaaagtcaaacgtcaatcctctactccgagcgccccagaactgggccagcaacctgacgtgaatatctcagagtggaaagacaaacctacacacgaaatcctgcagaagctcaacgattgttcctgtctcgccagccaggccatactcctgggcatcctcctcaagagagaaggacccaattttataaccaaggaaggcacagtctccgatcacattgagagagtctatcgccgagctggtagccagaaactttggtcagtggttcgcagggccgcttcactgctgagcaaggtggtggattcactcgccccatccattacaaatgttcttgtgcaggggaagcaagttacacttggagctttcgggcatgaagaagaggtgatctctaaccctttaagcccaagggttatccagaatattatctattacaaatgtaacactcacgatgagcgggaggccgtgatccagcaggagctggtaatacacatagggtggattatctccaataacccagagttatttagtggtatgttgaaaattcgcatcggctggatcatacacgcaatggagtacgaactgcagatccgtggtggagacaaacctgcactagatctgtatcaattaagtccaagtgaagtgaagcagctccttctggacatactgcagccacagcagaacgggcgttgttggcttaacagaagacagattgatgggtcactgaatcgcacgcccacgggcttttatgaccgggtatggcagatcctggaacgtactcccaacggcatcatcgtcgcagggaagcacctgcctcagcagcccactcttagcgacatgaccatgtacgaaatgaatttttccttattggtggaagacaccctgggaaatatcgatcagccgcagtatagacagatcgtggtcgaactcctaatggtggtcagcatcgttctggagcggaacccagagttggaattccaggacaaagtggacctggaccggctggttaaggaggcattcaacgaattccagaaagatcagtcacggctcaaggagatcgagaagcaagatgatatgacctccttctacaataccccacctctggggaaaagaggcacatgctcctacctaactaaagctgtgatgaacttgctactcgagggagaagtaaagcccaataatgacgacccttgcctgatatcatag

SEQ ID NO: 4582 - DNA, 3282 bp, Artificial Sequence
  Description of Artificial Sequence: Synthetic coding sequence
atggcgggagcagctggtctcacggccgaggtcagctggaaggtcctcgaacggagggccaggaccaaacggtcagggtccgtatatgagcccctgaagagcattaacctgccaagacccgacaacgagacactgtgggataagctggatcattactacagaatcgtgaagagcaccctgctcctgtaccaaagcccaacaacagggctgttccctaccaagacatgcggaggagaccagaaggccaagatccaggactccctttattgcgctgccggagcctgggctcttgctctcgcttatcgccgaatagacgatgataaggggcgaacacacgagctggaacattcagccattaagtgcatgcggggtattctgtactgctacatgagacaggctgacaaagtccaacagtttaagcaggacccaagaccaacgacctgcctccattctgtgttcaatgtccacactggtgatgaattactgagttatgaggagtatggtcaccttcagatcaacgcggtttcactatacctcttatacttggttgaaatgatctcgtcaggtctccagattatctacaacaccgacgaagtaagcttcatccagaacttggtcttctgcgtcgaacgggtgtacagagtgcccgattttggggtttgggaacggggatccaaatacaataatggctcaacagagctccatagtagttcggtggggcttgcaaaggcggctctggaagcgataaatggctttaatctctttggcaatcaggggtgttcctggagtgtgatttttgtcgacctcgacgcacataaccggaatcgccaaaccctgtgctccctgctcccccgtgaaagtaggagtcataataccgatgctgccctactcccctgtatttcttacccggcttttgcattggacgacgaagtgctgttcagccagacgctggataaggtagtccggaaactgaaagggaaatatggttttaaaagattcctgcgggatggctatcggacctcactggaagatcccaatcgctgctattataagccggctgagatcaaattgtttgacggtattgaatgtgaattccctattttcttcctatacatgatgatcgatggtgtgtttagagggaatcccaagcaagttcaggagtatcaggaccttctgactcccgtgctccatcatacaaccgagggttatcctgtggtgccaaaatactactatgtgccggcagatttcgttgagtatgagaagaacaacccaggttcccagaaacggttcccttctaactgtggaagggatggcaaactgttcctgtggggccaggcactttatattattgccaaattgttggccgatgagttgatatcaccgaaggatattgaccccgtgcagcgctacgtaccattaaaggaccagagaaatgtcagcatgcggtttagcaaccaaggacccctggagaatgatctagtggttcatgtcgcactgatagcggagtctcagcgattacaggtcttccttaatacatacggcattcagacccagactcctcagcaggtggaacccattcagatttggccacagcaggaactcgtgaaagcctatttgcaattgggcatcaatgaaaagttgggtctttctgggaggccggatcgtcccattggctgcttaggcacaagtaaaatataccggattctgggaaagaccgttgtgtgctatcctattatctttgacctgtcagatttctatatgagtcaggatgttttcctcctgattgacgatatcaagaatgctttgcaatttatcaagcaatactggaagatgcacggacggcctcttttcctggtcctgataagggaggataatatacgcggttctagattcaatccaatcctggacatgctggccgctctaaagaaggggatcattggtggcgtgaaggtacacgtggaccgactgcagacacttatatctggcgcagtggtggagcagctcgatttcttacgaatttcggacacagaggaactgcctgaattcaagtcctttgaagagctcgaaccacccaagcatagcaaggtcaaaaggcagtctagtacaccttctgccccagagcttggacagcagccagacgtgaacatatcggaatggaaagataagcccacccatgaaattctgcagaaactcaatgattgctcctgtcttgccagccaggctatcctgcttggcattctccttaagcgagaggggccaaatttcattactaaagaaggcacggttagcgatcacatagagcgcgtgtatcgcagagctggaagtcagaagttatggttggccgttcgctatggcgcagcctttacccagaaattctcctccagcatagcacctcatattacaacattcctggtacacgggaagcaggtgaccttgggcgcatttggacacgaggaagaagtgatctccaatcctctctctcccagggtcatccagaacattatctattacaaatgcaatactcacgacgagcgcgaggctgttatccagcaggaactggttatccatattgggtggatcatcagcaataaccccgagctcttttcagggatgctgaaaattcgtatcgggtggattattcacgccatggagtatgaattacagattcggggaggtgacaaaccagcactagacttgtatcaactcagcccttccgaagttaaacaactacttctggacatcctgcagcctcagcaaaacggcagatgttggttgaacaggcgtcagatcgatggctctctgaacaggacaccaacgggcttttacgacagagtttggcagattctggaacgcacaccaaatggcatcatagtcgccggaaagcatctaccacagcaacccaccctatccgatatgaccatgtacgaaatgaacttttccctgctggtggaagacaccctcggaaatattgatcaacctcagtaccgacaaatagtggtcgaattgctaatggtcgtgagtatcgtactggagcgtaatcccgagttagagttccaagacaaagttgacctcgacaggttggtgaaggaggctttcaatgagtttcaaaaggaccagtccagattaaaagagatcgaaaaacaggatgacatgacatctttctataacacccctcccctcggaaagcgtggcacctgttcctatctgactaaagcagttatgaatctcctcctcgaaggggaggtgaaacccaataatgatgacccgtgtcttattagctag

SEQ ID NO: 4583 - DNA, 3261 bp, Artificial Sequence
  Description of Artificial Sequence: Synthetic coding sequence
atggcatgttcccccgacgcagtcgtaagcccatcaagcgctttcctgcggtccggctctgtttatgagccactgaaatccataaacctcccaagacctgataacgagactctttgggataaactggaccattactacagaatcgtgaaaagcacgcttctgctctatcagtccccaaccactggcttgttccctaccaaaacgtgtgggggagaccagaaggcgaaaatccaagatagcctctactgtgcagctggtgcctgggctctggctctcgcctaccggaggattgatgacgataaaggtcggacacatgagctggagcactccgccatcaaatgtatgcgcggaatcctctactgctatatgcggcaggctgacaaagtgcagcagtttaaacaggaccctcgtcctactacctgtctacactctgtttttaatgtgcatactggtgatgagctcctttcatacgaggaatatggtcaccttcagatcaacgctgtgtccctctatctgctctacctggtcgaaatgatctcaagcggtcttcagatcatctacaacaccgacgaagtgtcctttatccagaatcttgtgttttgcgtggagagagtgtatcgtgtgccagatttcggcgtgtgggaaagaggatccaagtacaataacggtagtacggagttacacagctccagcgttggcctagcaaaagctgctctggaggcgatcaatggattcaatctgttcggaaaccagggctgtagttggtcggtgatcttcgtcgatctcgatgcacataaccggaatcggcagacactctgttctctactaccccgtgaatctagatctcataatactgacgctgctttactgccctgtatatcctaccctgcctttgccttggatgacgaagtgttgttctcacagacgctggataaggtggttcgcaaactgaaagggaagtatggcttcaaaaggttcctgcgagatggctacagaacgtcattggaggatcccaatcgatgttactacaaaccagccgaaataaagttgtttgacggaattgaatgcgaattccccattttcttcttatatatgatgatcgacggagtgtttagaggtaatcccaaacaggtacaagagtaccaggatctcctgacgcccgtgttgcaccacactactgagggataccccgtcgtaccaaaatattactatgttccagccgacttcgttgagtatgagaagaacaatcctggctcccagaagcggttcccgtcaaactgcggaagagatggcaagctctttctttggggccaggccctttacatcattgcaaaacttctggccgacgaattgatttccccaaaagatatcgacccagttcagcgctatgtccccttgaaggaccagcggaatgtgtcaatgcggttcagtaatcaggggcctttggagaacgatctagttgtgcacgtggcactcatcgctgaaagccagcgtctgcaagtctttttgaacacatatggaatccaaacgcaaaccccccagcaggtggagcctatccagatatggccacagcaagagctagtgaaagcctacctccagctggggataaacgagaaactggggctatccggcagacctgatagacctatcggctgtctgggcaccagcaaaatttaccgtattctgggcaaaacagttgtctgctacccaatcatcttcgacctgtctgatttttacatgagccaggatgtgttcctactgatcgacgacatcaaaaatgccctgcaattcattaaacagtattggaaaatgcacggcagacccctctttcttgtgctaatccgcgaagacaacatcagagggtctcgctttaaccccattctggacatgcttgccgctcttaagaagggaattatcgggggagtgaaagtgcacgtggatcgcctccagacactgatttccggagcagtggttgagcagttagactttctacgaatttccgacactgaggagctcccagagttcaagagctttgaggagctagagccaccaaaacattccaaggtaaaaagacaatcttcaactccttccgctccagagctcgggcagcaacctgatgtgaatatcagcgagtggaaagataagccaacacacgaaatcctgcagaaactgaatgattgctcatgtctcgcgtcccaggcaattttgcttgggattctgcttaaaagggagggccctaatttcatcacaaaagagggtaccgtgtccgatcacatcgagagggtctatcggcgagccggatctcagaagctttggctagcagtccgctacggggctgctttcactcaaaagtttagctcctctattgccccacatattaccacctttttggtgcacggcaaacaggtgacactgggggcattcggacatgaggaagaggtgatatcaaacccactgtctcccagggtcattcaaaacattatatattacaaatgtaacacccacgacgaacgagaggctgtaattcagcaggaactggtcatacacatcggctggatcatcagtaacaacccagagctcttcagcggaatgctgaaaatcaggattggatggatcatacatgctatggagtacgaactgcaaattcgcggaggggataaacccgcattagatctataccagctctctccctccgaggtgaagcagttactcctggacattttgcagccacaacagaacggacgatgctggctgaataggaggcaaattgatggatcactgaacaggacacctaccggcttctacgaccgggtgtggcagatcctggaacgcacccccaacgggattatcgtggcaggtaagcatcttccgcaacagccgaccttgtccgatatgactatgtacgagatgaacttctctctgctggtagaggacacgctgggtaatatcgatcaaccccaataccgacagatagtcgtcgagttactgatggtcgtgtctatcgtcctggagaggaatccggagcttgaattccaggacaaggtagacctcgacaggcttgtgaaagaagcctttaatgagtttcaaaaagaccaaagcaggctgaaggagatcgagaaacaggacgacatgacatccttttacaacacccccccactgggaaagcgaggcacctgttcctatctcacaaaggcagtgatgaatctgctgttagaaggcgaggtaaagcccaacaacgacgacccatgtctgatttcatag

SEQ ID NO: 4584 - DNA, 1221 bp, Artificial Sequence
  Description of Artificial Sequence: Synthetic coding sequence
atgactttggacgtgggacctgaggatgaacttccagactgggcagcagccaaggagttttatcagaaatacgatcctaaggacgtgattggcagaggagtgagttccgtcgtgcggagatgcgtgcaccgagcaactggacacgagtttgctgtcaaaatcatggaagtaacggcagagcgcctttcccctgaacagttggaagaggtacgggaagccacgaggagagaaactcatatactgagacaggtggctggtcatccccatattattactctgatagactcatacgaatcctcttcatttatgtttctggtcttcgatctgatgcgaaaaggggagctcttcgactatctcaccgaaaaggttgctctttccgaaaaggaaacacgtagtatcatgcgctcgctgctggaggcggtctcttttctccacgcgaacaacatagtgcaccgggacctcaagcccgagaacattctgctggacgacaatatgcaaatcaggctctctgatttcggcttctcgtgccaccttgagcccggagaaaaactccgggaactctgtggtacccctggctacctcgcccctgagattttgaaatgctccatggacgaaactcatcccggatacgggaaggaggtggacctgtgggcctgcggggtaatactttttaccctactggctggaagtcctccattctggcaccggagacaaatacttatgctgcgcatgatcatggaaggacagtatcagtttagcagtcctgagtgggacgataggtctagcactgtgaaagacctaattagcagactccttcaggtggacccagaggccaggctgacagccgagcaggccctgcagcacccattctttgagcggtgcgaggggtctcagccctggaacctcacaccccgacagcgcttcagagtcgccgtttggaccgtcctggctgcaggcagggtggctctttcaacccaccgggttcgaccgctgaccaaaaacgccttattgcgggacccctacgctctgcgttccgtcaggcatttgatcgacaattgtgcctttcgtttatacgggcactgggtgaaaaagggggagcagcagaaccgagcagctctgtttcaacaccgacccccaggaccgttccctatcatgggacccgaggaggagggggacagtgctgccataaccgaggatgaagcggtgctagttttgggttag

SEQ ID NO: 4585 - DNA, 1125 bp, Artificial Sequence
  Description of Artificial Sequence: Synthetic coding sequence
atgacactcgacgtaggtcccgaggatgaattgccagactgggcggcagccaaggaattctatcaaaagtacgaccccaaggatgtcattggaaggggggtttcttctgtggtgcgtcgatgtgtgcaccgggctactggccacgagttcgccgtgaagatcatggaggtaaccgccgagaggctctccccggagcagctggaggaggtgagagaggccacccgacgtgagacccacatcctgagacaggtcgcagggcatcctcacattattacattgatcgattcctatgagagttcctccttcatgtttcttgtgtttgacttaatgagaaaaggcgagctttttgactatctaaccgaaaaggtggccctgtccgagaaagagacacgttccattatgcggtctcttctagaggccgtatcgtttctccacgctaataatattgtacatagggacctgaaaccagaaaatattctcctggatgacaatatgcagattaggttgtcagactttggtttctcctgtcatttagagccaggggagaagctcagagagctatgtgggacaccaggataccttgcgcctgagatccttaagtgctccatggacgaaacacaccccggttatggtaaggaggtggatctgtgggcctgcggcgtgatcctcttcacactgttggctggcagcccaccattttggcataggcggcagatacttatgctgcgaatgatcatggagggacaataccagtttagctccccagaatgggatgatcgctcctccaccgtgaaggatttaatttcgagactgctgcaggttgatcccgaagctcgcttaactgccgaacaggccttacagcaccccttctttgagaggtgcgagggctcccagccatggaacctgacacctcgtcaacgtttccgcgttgccgtgtggacggtacttgccgctggacgggtggcactgtcgacacatcgggtgcgccctctaaccaagaacgctctgctgcgtgacccttacgcgctaaggagtgtcagacacctgatcgacaattgcgcatttaggctgtatgggcactggataaggaagcagtggatcggcaagctgatggcctgtgtctag

SEQ ID NO: 4586 - DNA, 3999 bp, Artificial Sequence
  Description of Artificial Sequence: Synthetic coding sequence
atgcagcaggctcctcagccttacgaatttttcagtgaagaaaattccccgaaatggcgcggtctgcttgtatccgcgcttcgtaaagttcaggagcaggtccacccaacgctaagtgccaacgaggagtctctttattacattgaggaacttatttttcagctgctaaataaattatgcatggcccaaccaaggaccgttcaagacgtcgaagaaagagtgcagaaaacattccctcacccaattgacaaatgggccattgccgacgctcagtctgcaattgaaaaacggaagaggcggaatcccctgctgttgcccgtggacaaaatacacccttccctgaaagaagtgctgggatacaaggtggactatcacgtctctctctatatcgtagccgtcctcgagtatatctccgctgacatactaaagctcgcaggcaattacgtttttaacatcagacactatgagatctcacagcaggatataaaagtgtctatgtgcgccgataaagtgttaatggacatgttcgaccaagacgatatcggactggtttcgctctgcgaagacgaaccaagcagcagcggcgaactgaattactacgacttggtgcggactgaaattgcagaagaacggcaatacctccgagaacttaatatgataatcaaggtttttcgtgaagcttttctgagcgaccggaagctgttcaagccctctgatattgaaaaaattttctctaatatttctgacatccacgagctcaccgtgaaactgctggggctcatcgaagacaccgtagagatgacagacgagagttcacctcatccgctggcgggatcctgtttcgaggacctcgccgaggagcaggccttcgatccttacgaaacgctctctcaggatatccttagtccagagtttcatgagcactttaacaagctcatggctaggcctgctgtggcactccattttcaatccatagccgacggctttaaggaggctgtacggtacgtgctccctcgcttaatgcttgttcccgtataccactgttggcactatttcgaactccttaagcaactcaaagcttgtagtgaggaacaggaagaccgggagtgcctgaaccaagcaataactgcacttatgaatctccagggttccatggacagaatctataaacagtactctccgagaagacggccaggagaccctgtctgtccattctactctcatcaattaaggtccaagcacctcgctatcaaaaagatgaatgagattcagaagaacattgatggctgggaaggcaaggacattggccaatgctgtaatgagtttataatggaggggccactgacacgcatcggcgcaaagcatgagcgacacatcttcctgtttgacgggttaatgattagctgcaaacccaaccacggacaaacacgactgcctggatacagttcagccgaataccggctgaaggagaaattcgttatgcgaaagatccagatctgtgataaggaagacacatgcgaacacaaacatgcgttcgagttagtgtcaaaagatgaaaattcaataatatttgccgcaaagtccgctgaagagaaaaacaactggatggctgcactgatcagcctccactaccgatctacactggataggatgctcgattctgtcctgctaaaggaagagaacgaacagcctctgcgactgccttctccagaagtctatcgcttcgtcgttaaggactccgaagaaaatatcgtgttcgaggacaacttgcagagcaggagcggcatccccattattaaaggcggtacagtggtgaagctcatcgaaagactcacctaccacatgtacgcggacccaaattttgtgcggacatttcttacgacatacagaagcttttgcaagcctcaggaactgctgtccctcctgatagagcggtttgagattccagagccagagccaactgacgccgacaaactggccatagaaaagggcgaacagccaatctccgccgacctgaagcgctttaggaaggaatatgtccaacccgtgcagctgagaattctcaacgttttcaggcattgggtggagcatcacttctacgactttgaaagggatctggagttgcttgagcgactggaaagttttatcagtagtgtcagaggaaaggcgatgaaaaaatgggtggaatccatcgccaagattattcggaggaagaagcaggctcaggcaaacggggtgtctcacaatatcacttttgaatcccccccaccgcctattgaatggcacatcagtaagcctggtcagttcgagactttcgatctgatgaccctccatccaatagagattgccaggcagctgactctgttggaaagtgatctgtatcgcaaagtgcagccatcagagctcgtgggttctgtgtggacgaaagaggacaaagaaatcaactcaccgaatctcctgaagatgataagacacactactaaccttactttatggtttgagaagtgcattgtcgaagcggaaaactttgaagaacgcgtggctgtgctctcccggatcatcgaaatccttcaggtattccaggacttgaacaattttaatggcgtcctcgaaattgtcagcgccgtgaatagcgtgtcagtgtacaggttggaccatacgtttgaggccttgcaggagagaaagcggaaaattcttgatgaggcggtggaactctctcaagaccactttaaaaagtatctggtaaagctgaaaagcatcaaccctccctgcgtgccgttctttgggatatacctgacaaacatcctcaagactgaggaagggaacaatgacttcctgaagaagaaaggcaaagatcttattaatttttcgaagaggagaaaggtcgcagagatcactggggaaattcaacagtatcaaaaccagccatattgtctgcgcattgagcctgacatgaggagattctttgaaaatctcaacccaatggggagtgctagtgagaaggagtttaccgattatctgtttaacaaatcgcttgagattgaacctcgaaactgcaaacagccaccacgctttccccgaaagtcaacatttagtttgaagtcccctgggatacgcccaaacaccggcaggcacggttccaccagtgggacattgcggggacacccaacgcctctcgagagagagccctgcaagatctcttttagtcgaatcgcagaaactgagctggagtccacagtgagcgcgcctaccagccctaacactcccagtacacctccagtgtcggcttcgtccgatctgagtgtgtttctggacgtagaccttaactcgagctgcggaagcaatagcatattcgcccctgttttgttaccccactccaaatctttctttagtagttgcgggtccctgcataagctctcagaggagcctctcatcccccctccccttccacctcggaaaaagttcgatcatgacgcgtccaatagcaagggtaatatgaaaagtgacgatgacccgcctgcaatacctcctaggcagccccctcccccaaaagtgaagcctcgagttccggtgccaacaggcgctttcgacgggcctctgcacagtccccctccacctcctcctcgcgacccactgcccgatactcctcccccagtgccgctgcggcctcccgagcattttatcaactgtcccttcaatctgcagcctccaccgctgggtcacctgcaccgcgacagtgattggctgcgggatatctcgacttgcccaaactcaccttctacccccccttcaaccccaagccctagggtgcccaggagatgttacgtgctgtcatctagccagaataatcttgcgcaccctcctgctccacccgttccccctagacagaactcatctccgcatctccccaaactccccccaaaaacctacaaacgggagttgagtcatccccctctgtataggctgcctctgcttgagaacgcagagacgccacaatag

SEQ ID NO: 4587 - DNA, 2442 bp, Artificial Sequence
  Description of Artificial Sequence: Synthetic coding sequence
atggcaaaacccctgaccgaccaggagaagcggaggcagattagtataagaggaatcgtcggggtagagaacgttgccgagttaaagaaaagcttcaaccgacatctgcatttcactctagtcaaggaccgaaatgtcgcaaccacccgcgattattacttcgccctcgcacataccgtccgcgatcaccttgtgggacggtggatcaggacacaacagcattactatgataaatgcccaaaactgggtttagacattgaggagctggaagaaatcgaagaggacgccggtcttgggaacggcggtttgggacgcctggccgcatgcttcttagactccatggccacccttggactcgcggcttacgggtacgggatacggtacgagtatggcatcttcaatcagaaaataagggatgggtggcaggtggaggaagcagacgattggctcagatacggcaatccttgggagaagtcgcgcccagaatttatgcttcccgtgcatttttacggcaaggtggagcacacaaacactggaaccaagtggatagatacacaggtagtgttggccctcccctacgacacaccagtgccgggatatatgaataatacagtgaatactatgcgactgtggtcggcacgcgctccaaacgactttaacctgagggattttaatgttggagattatatccaggcagtccttgatcgcaacctcgcagagaatatttcccgagtactgtatccaaatgataacttttttgagggtaaggaattgaggctgaagcaagaatacttcgtagttgcagcaactctgcaggacatcattcgccgatttaaggcttcgaaatttggttctactaggggagccggaaccgtgttcgacgcttttcctgatcaggttgcaatccagcttaacgacacacatcccgcactggctatcccagagctgatgcgcatctttgtcgacatagaaaaactgccctggtccaaagcttgggagctcacacagaagacatttgcatataccaaccacacagtcctccctgaagcactggagaggtggccagtggacttggtggaaaaactgctgcctcggcacctggaaattatttatgaaatcaatcagaagcatctggataggattgttgccctgttccccaaagacgtagacagactgcgccgtatgtccttaattgaagaagaggggtcaaagcgcatcaatatggcccatctctgcattgtggggtcccacgccgtcaatggcgtggctaagatacattctgatattgttaagacaaaggtattcaaggacttcagtgaactggagccagacaagttccaaaacaaaaccaatggcataacaccccgacggtggctgctgctttgcaaccccggactggcagagctgatcgcggaaaaaatcggcgaggattatgttaaagatttgagccagctgacgaaactacacagctttctgggggacgacgtgtttctgcgggaattggcaaaagtgaagcaagagaataagctgaaattctctcaatttctggagactgaatacaaagtcaaaataaatcccagctccatgttcgatgttcaggttaaaaggattcatgagtacaaaagacagctgctcaattgtctgcacgtgataaccatgtacaatcggatcaagaaagaccccaagaagctttttgtgccgagaactgtgattattggtggcaaggcagcccctggctaccacatggccaaaatgattataaagctgataacatccgtggccgacgtggtaaataacgatcccatggtcgggtccaaactgaaagtgatcttcctagagaactatcgggtgtctctggccgaaaaagttatcccagctaccgatcttagcgaacagatcagcaccgcaggtaccgaagcttctggcacaggtaatatgaagtttatgcttaacggcgcattgacaatagggacaatggacggcgctaacgtcgaaatggcagaggaggccggtgaggaaaacctctttatcttcgggatgaggattgatgatgtggccgcacttgacaagaaaggctatgaagccaaagagtattacgaggccctgccagagctcaagctcgtaatcgaccagatcgataatggatttttcagtccaaagcagcctgacctattcaaggatattatcaacatgctgttctaccacgaccgttttaaagttttcgccgattacgaagcttatgtcaaatgccaggataaggtcagtcagctgtacatgaatccaaaggcctggaataccatggtattgaagaatattgcagcctccggcaagttcagctctgacaggaccatcaaggaatatgcacagaacatttggaatgtcgaacccagcgacctcaaaatttctctgagtaatgaaagtaacaaggtgaacggaaactag

SEQ ID NO: 4588 - DNA, 2433 bp, Artificial Sequence
  Description of Artificial Sequence: Synthetic coding sequence
atggaacataaggaagtggtcctcctgctacttctcttcctgaagagcggccagggcgagccacttgacgactacgtgaatacacagggcgcttctttgttttcagtgacaaaaaaacaactcggcgctggcagcatagaagaatgtgccgcaaagtgcgaggaggatgaagaatttacttgccgggcatttcagtatcacagcaaggagcagcaatgtgtgatcatggcagaaaatcggaaatctagtattatcataagaatgcgtgatgtcgtcttattcgagaaaaaagtgtatctctccgagtgcaaaactgggaatgggaagaactacagagggacaatgtccaaaaccaaaaacggcatcacttgtcagaaatggagctctaccagtccgcatcgtccccgtttttcaccagccactcacccttccgaagggttggaggaaaactactgccgtaaccccgataacgaccctcagggcccttggtgctataccaccgatccagaaaagcggtacgactactgtgacatactggagtgtgaggaggagtgcatgcattgttcgggagaaaactatgatgggaagattagcaagaccatgtcagggctggagtgccaagcctgggactctcagagcccccacgcccacggatatataccctcaaagttcccaaataagaatttaaagaaaaattactgtcggaatcccgatagggagctcaggccctggtgttttaccaccgaccccaacaagcgatgggaattgtgcgacataccccgatgcactacccctccgcctagctctggaccaacttaccaatgcctaaaaggtactggcgaaaattatagaggcaatgttgctgttactgtctccggccatacctgccaacactggagtgcacagactccccatacacataatagaacacccgagaacttcccatgcaaaaaccttgacgaaaactattgccgcaaccctgatgggaaacgcgcaccatggtgccatacaacaaattcccaggtaaggtgggagtattgtaagattccttcctgtgatagctcccccgtgagtacagagcagctcgccccaaccgcccctcccgagctcacaccagttgtacaggattgttatcacggcgacgggcagtcatatcgtggcactagttccaccacaaccacaggaaaaaaatgtcaaagttggagttccatgacccctcatcggcaccagaaaactcctgagaactatccgaacgcaggtttaacgatgaattactgccggaatcccgatgctgacaaggggccttggtgcttcactaccgatccaagtgtgcggtgggaatattgcaacctgaagaaatgctctggtacagaggcaagcgtagtcgcgcctcctcccgtcgttcttctgcccgatgtggagactccttctgaagaggactgcatgttcggaaacggcaaaggctaccgcggaaagcgcgcaacaacggtcacgggcaccccttgtcaggactgggcagcccaagagccgcaccgacacagtatctttacccccgagaccaatccaagggcaggcctcgagaaaaattactgccgaaacccggacggcgacgttggtggcccttggtgctatactaccaatcccagaaagctgtatgactactgcgacgtcccacagtgcgccgcaccctcgtttgattgtggcaagccccaagtcgaacccaaaaaatgccctggtcgagtcgtggggggttgtgtggctcatccccatagttggccctggcaggtgtccttaagaaccagattcggtatgcatttttgtgggggaaccctcatatctccagagtgggttttaacagccgcacattgcctggagaaatctcctagacctagcagctataaagtgatcctgggggcacaccaggaggttaaccttgaacctcacgtccaggaaatagaagtcagtaggctctttctcgagcctactcggaaggatatcgctctgcttaagttgagttctcccgctgtgattacagacaaggtgattcctgcctgcctgccctccccaaattacgtggtggcggaccggacagagtgtttcatcacagggtggggagagacccagggaacatttggagccggattacttaaagaggctcagctaccagtgattgaaaataaagtgtgcaataggtacgaattcttgaatggaagagtgcagtctactgagctttgcgcgggtcacctggcgggtggtaccgactcttgccaaggcgattcgggagggcctctcgtctgttttgagaaggacaaatacatccttcagggcgtgactagctgggggttgggctgtgctcgccctaataaacctggtgtctatgttagagtgagtagattcgtgacctggattgagggagtaatgaggaataattag

SEQ ID NO: 4589 - DNA, 633 bp, Artificial Sequence
  Description of Artificial Sequence: Synthetic coding sequence
agattcggtatgcacttttgtggcggaactctgattagcccagaatgggtcttgaccgccgcacactgccttgagaagtcccctcggcctagctcatacaaggtgatcctcggagcccaccaggaggtgaacctcgagccccacgtgcaagaaatagaggtgtcaaggctgttcttggagccaactcggaaagacattgccctgctaaagctgtcctcacctgccgtaataactgataaagtcatccctgcttgcctgccgagtccaaattacgtggtggctgatagaacagaatgctttattacaggatggggtgagacccaaggaacttttggagccggactgcttaaagaagctcagctgcctgtcattgagaacaaggtttgtaatcgctacgaatttctcaacggaagagtacagtctacagagctgtgcgccggtcacctcgctggagggacagactcttgtcagggtgactccggcggaccactggtctgctttgaaaaagataagtacattttgcagggcgtgacctcatggggccttggatgcgctcggccaaataaaccaggtgtgtatgtacgggtgtcgcgcttcgttacttggattgagggcgtgatgcgcaacaactag

SEQ ID NO: 4590 - DNA, 411 bp, Artificial Sequence
  Description of Artificial Sequence: Synthetic coding sequence
atggaacataaggaagtcgtgcttctactgctcctgtttctgaagtccggccagggagaaccactcgatgattacgttaatactcagggcgcatcgctcttcagcgtgactaaaaagcagctgggggcaggcagtatcgaggagtgcgcggctaaatgcgaggaagacgaagagtttacttgtcgcgcttttcagtaccacagtaaggaacagcagtgtgtgataatggctgaaaatcgaaaatcttcaatcataatcagaatgagggatgttgtcctgttcgagaaaaaggtgtacctttcagaatgcaagaccgggaatggtaagaattataggggcaccatgtctaaaaccaaaaacggaataacatgccagaaatggagctccacttctcctcaccgaccaaggtag

SEQ ID NO: 4591 - DNA, 945 bp, Artificial Sequence
  Description of Artificial Sequence: Synthetic coding sequence
atgggaataggcagatcagaaggtggaaggcgaggagcggcactgggagtgcttttagcactgggtgccgcactcctggctgtcggcagcgcgtctgaatacgattatgtgtcctttcaaagcgacatcggaccatatcaatccgggaggttctataccaaaccaccgcaatgtgtcgatattccggctgacctgcgcctgtgtcacaacgttgggtataagaaaatggtccttcctaacctcctagaacacgagacgatggcggaggtgaaacaacaggcttccagctgggtgcccttactaaataaaaattgccatgccggaacacaggtgtttctgtgctctctgtttgccccagtgtgccttgaccggcctatctacccatgccggtggctgtgcgaagccgtgagggactcttgtgagccagtgatgcaattcttcggattttactggccagagatgctaaaatgtgataagttcccggaaggcgacgtttgtattgcgatgaccccccctaatgccacagaagcatccaagccccaagggactactgtatgccccccatgtgataacgagcttaagtcggaggctattattgaacacctatgtgcttctgagttcgcacttcggatgaagatcaaggaagtcaagaaagagaacggggataaaaagatagtgccgaagaagaaaaagccactgaaactcggaccaataaagaaaaaggatctcaaaaaactggtcctgtacttgaagaatggagctgattgcccatgtcaccagctggacaacctgtcccatcacttcctaattatgggtaggaaagtcaagtcgcagtacctgctgacagctattcataagtgggataagaagaataaggaattcaaaaacttcatgaaaaagatgaagaatcacgaatgtcccacgttccagtctgtgtttaaatag

SEQ ID NO: 4592 - DNA, 882 bp, Artificial Sequence
  Description of Artificial Sequence: Synthetic coding sequence
atggacgccatgaaaaggggactctgctgtgttctcctgctgtgcggagctgtctttgtctctcccagtcaggaaatccatgcaagattccggcgaggcgctaggtcctatcaagttatttgccgggatgaaaagacccagatgatctaccagcagcaccagagctggttgcgaccggtactgagaagcaaccgagtggagtattgctggtgtaatagcgggagagcacagtgtcactctgtgcccgtgaaaagctgttcagagcctagatgctttaatggcggaacctgccagcaggcactctattttagcgacttcgtctgccaatgtcctgaaggcttcgcagggaagtgctgcgaaattgatacccgggcaacttgttatgaagaccagggtatttcgtaccgcggaacatggtctaccgccgaatccggagccgagtgtactaattggaatagctctgcgttagcccagaagccttacagcggtcgtcgccctgacgccattagactcggattgggcaatcataactattgtcggaaccctgatagagattctaaaccgtggtgttacgtgttcaaggccggaaaatactcctccgagttttgttccaccccggcttgttcagaggggaattcagactgctacttcggtaacggctctgcctacagaggcactcacagcttgaccgagtctggcgcttcctgtttaccctggaatagcatgattttgattggtaaggtgtatacagctcaaaacccctcagctcaggctctaggtttaggtaagcacaattactgccggtgtcggacagggaggtctgtctcatccccagcaacggcatcaatgaggccatgcctcctatcaatcaggtccggctag

SEQ ID NO: 4593 - DNA, 1551 bp, Artificial Sequence
  Description of Artificial Sequence: Synthetic coding sequence
atggatgctatgaagcgagggctctgttgcgtccttctcttgtgtggtgcagtgtttgtctctccctcccaggaaatccacgctcggtttaggaggggagcgcgaagttaccagggctgttcagaacctagatgtttcaacggcggaacctgccagcaagctctctattttagtgattttgtatgtcagtgccctgaggggtttgccggaaagtgctgcgaaatcgataccagggcaacttgttatgaagaccagggcatttcctatcggggtacatggtctaccgctgaatctggcgctgaatgcactaattggaacagctccgccctggcccaaaaaccttattccggtcgtagacctgacgccattagattagggttgggcaatcataattactgcaggaacccagacagggattcaaagccttggtgctacgtgtttaaagcaggaaaatatagctcagagttctgtagcaccccagcatgttccgaggggaacagcgactgctactttggcaacgggagcgcttacagagggacccattcgctcaccgaatctggcgcatcttgtctcccatggaattcaatgattttgattggtaaggtgtacaccgctcaaaatccttccgctcaggccctcgggcttggaaagcacaattactgcagaaacccagatggagatgctaagccgtggtgccacgtccttaaaaaccgacgcctgacatgggaatactgtgacgtccccagctgctccacgtgcggcctccgtcagtattcccagccacagttcagaattaaagggggattgtttgctgacatagcttcgcacccgtggcaggccgctatcttcgctaagcatcggaggagtccaggcgagcgtttcctctgcggaggaatcctgatctcgagctgttggattctttctgctgcccactgtttccaagagagattccctccacatcatctgaccgttatcctcgggcgtacatacagagtggtccccggtgaggaagagcagaaattcgaagtggaaaagtatattgtgcataaagaatttgacgatgacacatacgataacgacatcgccctgttgcaactgaaatcagattcgtcgcgttgcgcccaggagagttctgtggtaaggaccgtttgtctgcctccagccgatctacaactgcctgactggaccgagtgtgaactgtccggatacgggaaacacgaggcgttgtcccctttctacagtgaacgtctcaaggaggcccacgtcagactgtatccaagttccaggtgcacctcccaacacctgctcaaccgcacagtgacagacaatatgctatgcgctggggacacaaggtccgggggtccgcaggcaaatttgcacgatgcttgccagggagacagtggaggaccgttggtgtgcctcaacgatggacgaatgacactggttggtatcatcagctgggggctggggtgcgggcagaaggatgtcccaggcgtgtacactaaggtcactaattacctggactggatccgggacaatatgaggccctag

SEQ ID NO: 4594 - DNA, 1689 bp, Artificial Sequence
  Description of Artificial Sequence: Synthetic coding sequence
atggacgccatgaaacgcggtctgtgctgcgtcctcctgctgtgtggcgcagtctttgtctcacctagccaggaaattcacgcccgatttcggagaggagccaggagctatcaggttatctgccgtgatgagaaaactcagatgatttaccaacaacatcagtcctggctgcgcccagtgctgagatctaatcgcgtagagtattgctggtgcaactccggccgtgcccagtgtcactcagtccccgtaaaaagctgcagcgagcctcggtgtttcaatgggggaacttgtcagcaggctctgtatttttctgattttgtctgccagtgccccgaaggatttgcagggaaatgctgtgaaatcgataccagggcaacctgctacgaagaccagggcatcagttaccggggtacctggtccacagcagagagcggcgctgagtgcacaaactggaatagcagtgccttagcacaaaagccctatagcgggaggcgccctgatgctattcgcctaggcctgggaaaccataactactgcaggaaccccgacagagactcaaaaccatggtgctacgtctttaaagcagggaaatactcatcggagttctgcagcaccccggcttgtagcgagggcaactctgactgttacttcggaaatggcagcgcgtatcgaggaacacatagtctgacagagtccggggctagttgtctgccctggaactctatgattctaatcgggaaagtctacaccgcccagaatccttccgcacaggctctcgggctggggaagcacaactattgtcgaaacccagatggcgatgccaaaccctggtgccacgtgctgaagaatcggcgactgacttgggagtactgtgatgtgccttcctgttcaacctgcggcttgagacaatattcccaacctcagttccgtattaaaggtggcctgtttgcagatatcgcctcgcacccatggcaagcagccatattcgcaaagcatcgaaggagtccaggggagaggtttctgtgcggagggattctaatttcgtcgtgctggatactctccgcagctcactgcttccaggagaggtttccacctcaccacctgactgtcattctggggcgtacctatcgggtagtacctggcgaggaagaacagaaattcgaggttgaaaagtatatcgtccataaagagtttgacgatgatacctacgacaatgacatagcgctcctgcaactaaaaagtgactccagccgttgcgcgcaggagagtagtgttgttcggacagtttgcctccctccagccgatctgcaactgccggactggaccgagtgcgagctgagcggctacgggaagcatgaagctttgagtcccttttactccgaaaggctgaaggaggctcacgtacggctttacccctctagtcgatgcacaagccagcacttgttaaaccgcacagttacagataacatgctgtgtgccggagatacaagatctggtggacctcaggctaatctccacgatgcttgtcagggagactcaggcggtcccctggtctgtttaaatgacggacgtatgactctggttggtattataagctggggacttgggtgtgggcaaaaagacgttcctggagtctatacgaaggtgacaaactacctggattggattcgcgacaatatgaggccatag

SEQ ID NO: 4595 - DNA, 1311 bp, Artificial Sequence
  Description of Artificial Sequence: Synthetic coding sequence
atggatgctatgaagcgcggactttgttgtgtgctgctcctctgcggcgcagtgttcgtttcccccagccaagaaattcacgccaggttcaggcgcggagctaggtcttatcaggtgatttgccgtgatgagaagactcagatgatttaccaacagcaccagtcttggctccggccagtcctgaggtccaatcgagttgagtactgttggtgcaattccgggagggcgcagtgccactctgtgcccgtgaagagaaattccgattgctatttcggcaacggaagcgcgtatcgcggtacacacagcctgaccgaatctggcgcaagctgtctgccctggaatagtatgatcctgatcggaaaggtttacacagctcagaatccctcggcacaggccctgggactgggaaagcataactattgccgaaatccggatggcgatgcgaaaccatggtgccacgtccttaagaataggcgcctcacatgggagtactgcgacgtcccgagctgttcaacctgtggactgagacagtactcccaaccccagttccggattaaaggcggactgttcgcagatattgctagccacccctggcaggccgcaattttcgcaaaacacaggcgaagccctggggagaggtttctgtgcggcggtatcctgattagctcctgttggatcctctcagccgcacattgcttccaggagaggtttcctccgcaccatctgaccgttattcttggcagaacgtacagagttgtacccggagaggaggaacagaaattcgaggtagaaaagtacatcgtccacaaggaattcgacgacgacacatacgacaacgacattgctctgcttcagttaaaaagcgactctagccgctgcgcacaggagagctctgttgtgaggacggtgtgtcttccacctgctgatctgcaattacccgactggaccgaatgcgaactgagtggttatggcaaacacgaggctctatcacctttctatagcgagagactcaaggaagcacacgtcagactgtatccaagctcaagatgtactagccagcacctgctcaataggacggtgaccgataatatgctctgtgcaggtgataccagatccgggggtccacaggccaacctacatgacgcctgccaaggcgattctggaggtcccttggtgtgcttgaacgatggtagaatgaccttggttgggatcatatcgtgggggctgggctgcggccagaaggacgtaccaggcgtctacaccaaagtcacaaattacctggactggattcgcgacaacatgagaccttag

SEQ ID NO: 4596 - DNA, 1500 bp, Artificial Sequence
  Description of Artificial Sequence: Synthetic coding sequence
atggacgccatgaaacgcggactgtgctgcgttctgttgctctgcggcgcagtctttgtttcacctagtcaggaaattcacgctcgttttaggcgcggagcacgatcatatcaagttatctgccgggacgagaagactcagatgatctatcagcaacaccagagctggctgcgacccgtgctgagaagcaatagagtggagtactgttggtgtaactctggcagggcccaatgccattctgtaccagtcaagagttgcagcgagccgcgatgcttcaatgggggtacatgccagcaggctctgtacttttctgattttgtgtgccagtgccctgaagggtttgccggaaaatgttgtgaaatcgattcaaagccatggtgctatgtgtttaaagccggtaagtatagttctgagttttgttcaacgcctgcttgctccgagggcaactccgactgctattttggtaacggcagcgcttaccgtggaactcattccttaaccgaaagcggggcttcctgtttgccttggaacagtatgatactgattggtaaagtatatactgcccaaaacccttccgcccaggccctgggtctcggtaagcataattactgtcgcaaccctgacggcgacgccaagccttggtgccacgtgctgaagaatcgcaggttgacttgggaatactgtgacgtgccctcctgcagcacttgtgggctgcgccagtatagccagccccagttcagaataaaaggcggactttttgccgacattgcttcccacccatggcaggccgcaatctttgccaaacaccggagatctcctggtgagaggttcctctgtgggggaatccttatatcctcctgctggatcctgagcgctgcacactgttttcaggagcggtttccgccacaccatcttactgtgatcctggggaggacataccgtgtggtgcccggagaagaggaacagaaatttgaagtcgaaaagtacatcgtgcataaggagttcgatgacgacacctatgataacgacatcgcgttacttcagctcaagtctgattctagtaggtgtgcacaggagtccagtgtagtgcgcactgtctgtctcccaccagccgacctccagctgcctgattggacagaatgtgagctgtccggatacggcaaacacgaggcactgtcaccgttttactccgaacggctgaaagaagcacacgtgaggctatatccttcaagccgatgcacttctcagcacttattgaacagaacagtaaccgacaatatgctgtgcgccggagatactcggtccgggggaccacaagcaaacctgcatgacgcatgtcagggagactctggcggtccccttgtctgtctgaacgacggaaggatgactctagtgggtattatatcatgggggctggggtgtggccagaaagacgtgcccggagtgtacaccaaggtaactaactacctggactggatcagggataatatgcgtccttag

SEQ ID NO: 4597 - DNA, 537 bp, Artificial Sequence
  Description of Artificial Sequence: Synthetic coding sequence
atggatgcaatgaagcgcggactatgttgcgtcctgctcctgtgtggagcagtatttgtgtcaccttcccaggaaatacacgcccgttttagaagaggggcacgttcctaccaggttatctgccgagacgagaaaacccagatgatctatcagcagcatcagagttggctgcgcccagttctgaggtccaatcgcgtggagtattgctggtgcaattcaggtagagcccagtgccattctgtgccagtgaagtcttgtagcgagccaaggtgcttcaatggaggtacatgccagcaggctctctacttcagcgacttcgtgtgccagtgtccagaaggatttgccggaaaatgttgcgagatagatactcgggctacctgctatgaggatcagggtattagctaccgcggaacttggtctactgccgagtcgggggctgagtgcaccaattggaatagcagtgcacttgcacaaaagccatacagcggacgcaggcccgacgctattcggctcggcctcggaaatcacaactattag

SEQ ID NO: 4598 - DNA, 474 bp, Artificial Sequence
  Description of Artificial Sequence: Synthetic coding sequence
atggacgctatgaagaggggtttatgttgcgtactgttgctctgtggcgcagtattcgtcagccccagccaagagattcacgctagattcagaagaggcgcaagatcctaccaggtcatctgccgggacgagaagacccagatgatttaccagcagcaccagtcttggttgcgacctgtacttcggagcaatcgagttgagtactgttggtgtaactccggtagagcacagtgccattctgttcccgtgaaatcttgctcagaacccaggtgtttcaacggtggcacctgtcaacaggctttatatttcagcgattttgtctgccaatgtcctgaaggattcgcaggtaaatgttgcgagatcgatacaagggccacttgctatgaggatcaggggatctcgtatcgcggaacgtggtctactgcagagagcggtgctgaatgtactaactggaattcctcagctcttgcttag

SEQ ID NO: 4599 - DNA, 1422 bp, Artificial Sequence
  Description of Artificial Sequence: Synthetic coding sequence
atggatgccatgaaacgcggactgtgttgcgtccttctgctgtgtggcgctgtatttgtttcaccttcacaggagattcacgcacggtttcgtcgaggtgcaagatcctaccaagtcatctgccgcgacgagaagacgcaaatgatttaccaacagcatcagagttggctccgcccagtcctccggtcaaacagagtagaatattgctggtgcaactccggtagagctcagtgccatagcgtgccagtcaaatcctgttcagaaccaaggtgttttaatggaggaacatgccaacaggctctttacttcagcgacttcgtttgccagtgtcccgaagggttcgcaggaaagtgctgcgagattgggaattcagactgttacttcgggaatgggagtgcatacagaggcacacactctctgacagagagtggtgccagttgcctcccctggaatagtatgattctgatcggcaaggtttatactgctcagaatccatctgcgcaggctttaggcttgggaaaacataactactgcagaaatccagacggtgacgccaagccgtggtgtcacgttcttaaaaaccggaggctaacatgggagtattgtgatgtgcccagttgcagcacctgtggcctgaggcagtacagtcagccccagtttcgtatcaagggtggtctcttcgctgacattgcctcgcacccgtggcaggccgctatctttgctaaacacagacgcagcccaggcgagcgcttcttgtgtggaggcattctgattagctcttgctggatcctgtctgccgctcattgtttccaggagagattcccaccacatcacttgactgtgatcctgggcagaacatatcgcgtggtgccgggtgaggaggagcagaagtttgaagttgagaagtacatcgtacataaggaatttgacgatgatacatatgacaacgatattgcactcctgcagctgaaatccgactcttctcgctgcgcacaggagtcctctgtggtgcgcaccgtctgccttccaccggctgatctccaactgcccgattggaccgaatgcgagttgagcgggtacgggaaacacgaagcgctgagtcctttttatagtgagaggctgaaggaagcccatgtcagattgtacccctcctcacggtgtacgagccaacacctcctcaatcgtaccgtaactgataacatgctatgcgccggtgacacccgatctggagggccacaggcgaatctgcacgacgcatgccaaggcgactccgggggacccctggtctgtctcaatgatggacgcatgaccctcgttggcatcatcagttgggggctcggttgtgggcagaaagatgttcctggagtgtacactaaggtgaccaactatctggactggattcgcgataacatgagaccttag

SEQ ID NO: 4600 - DNA, 1083 bp, Artificial Sequence
  Description of Artificial Sequence: Synthetic coding sequence
atggccggtcacctcgcatccgatttcgccttctctccccctcccggaggaggtggggatggaccaggcggtcctgaaccaggatgggtggaccctcggacatggctctcgttccaagggcctcctggaggacccggtatcggtccaggcgtcggacccggatctgaggtctggggaattcccccttgtccacctccctacgagttttgcggcggtatggcgtactgtgggcctcaggtaggggtgggcttagtgcctcaagggggactggaaacctcccagccagagggcgaagctggggtgggagtggaatcgaacagcgacggcgcttctcctgagccatgtaccgtgaccccgggagctgtgaagctggagaaggagaagctggaacagaatcccgaggagagccaggacatcaaagcccttcagaaagagctggagcaattcgcaaagctgctgaagcagaaacggatcacactgggttatactcaagccgatgtaggcctgacactcggagtcctgttcggcaaagtgttcagtcagacgacgatctgtcgctttgaagccctgcagttgtcgtttaaaaacatgtgtaagctacgccctttgctgcagaaatgggttgaggaggccgataataatgaaaatctgcaggagatttgcaaggctgagaccctggtccaggctaggaaacggaaaaggacaagtatcgagaaccgggtgcggggaaatctggaaaatctctttctgcagtgtccaaagcctacactccagcagatttcgcacatcgcacagcagctgggcctggaaaaagatgtcgttagagtctggttttgcaacaggaggcaaaagggcaaacgtagttccagtgactacgcccaaagagaggactttgaggctgctggcagtcccttttctgggggtccagtgagctttccactcgcgcctggccctcacttcggtacacccggatatggtagtccccattttactgcgttgtattcctcagtgccattcccagaaggcgaggccttcccacctgtttctgtaaccactttaggcagcccaatgcattctaactag

SEQ ID NO: 4601 - DNA, 798 bp, Artificial Sequence
  Description of Artificial Sequence: Synthetic coding sequence
atgcatttctatcgcttgtttctgggggctacacggcgattcctaaatccagagtggaaaggtgaaatcgacaattggtgtgtgtatgtccttacatccctgcttcctttcaagatccagagccaggacatcaaggctttgcagaaagaactagagcaatttgccaaactgcttaaacagaagaggattacactaggatacacacaggcagatgttggactgacactgggagtgttgtttggtaaggtattcagccagaccactatctgccgatttgaagccctgcagctgtcatttaaaaacatgtgcaaactaaggccattactgcagaagtgggtggaggaagccgataacaacgagaatctacaggagatctgtaaagctgagactctagtgcaggctagaaaacgcaaacgcacgtctattgaaaatagagtccgcggaaaccttgaaaatctcttcctccaatgccccaaacctaccttgcagcaaatttcccatatcgcacaacagctggggctagaaaaagatgttgtgcgggtgtggttctgcaaccggaggcaaaagggcaagcgatcctctagcgattacgcccaacgcgaggacttcgaggcagcgggttcgccattttcaggcggacccgtttcatttcccctggcaccaggccctcacttcggcacgcctggatacgggtcgccccacttcaccgcactgtacagtagcgttccgtttcccgagggagaagccttcccaccggtgtccgtaactacactaggatcgcctatgcattctaattag

SEQ ID NO: 4602 - DNA, 1083 bp, Artificial Sequence
  Description of Artificial Sequence: Synthetic coding sequence
atggccggtcatttggctagcgacttcgcttttagtcccccaccaggcggtggaggagacggaccagggggacctgaaccgggttgggttgaccccagaacatggctgtccttccagggacctcctgggggtccaggcattggccctggagtcggcccaggctctgaggtatggggaatccccccttgtcccccaccgtatgagttttgcggcggaatggcctattgtggaccccaggtgggtgtcggtcttgtgcctcagggtggtctcgaaacatcccagcccgagggggaagccggtgtgggtgttgaatcgaactcggacggagcatctcccgagccttgtacagttactccaggcgcagttaaattagagaaagaaaagcttgagcagaatcctgaagaaagtcaagacattaaggctctgcaaaaagaactggagcagtttgctaagttgctgaaacagaagcgcatcacgctcgggtacacgcaggccgacgtcggattaacgctgggggtgctttttggaaaagtgttctctcagactactatttgccgtttcgaggcgctacagctgtcatttaaaaatatgtgcaagcttagacccctgctacagaagtgggtggaggaagccgataacaatgaaaatctacaggagatttgcaaggccgagactctcgtgcaggccagaaagagaaaacggacctcaattgagaaccgggtgagaggtaacctggaaaatctttttctgcagtgccctaagcctaccctgcagcagatcagccacatcgctcagcagctgggtctggaaaaggatgtggtacgagtctggttctgcaaccgcagacagaagggtaaacgctctagttcagactatgcccagagggaggatttcgaagccgcaggaagcccattctctggtggccctgtcagttttccgctggctccaggcccacactttggcacaccgggatacggttctccacatttcacagctctttatagcagtgtgccatttcctgagggggaagcatttccaccggtgagcgttactacgcttgggagtcctatgcactccaattag

SEQ ID NO: 4603 - DNA, 798 bp, Artificial Sequence
  Description of Artificial Sequence: Synthetic coding sequence
atgcacttctatcggctgttcctgggggctacaagacgctttttaaaccccgagtggaagggagagatcgacaattggtgtgtttacgtgctgacctcccttctgccgttcaaaatccagtcccaggatatcaaggcactgcagaaggaacttgaacaattcgccaagctcctgaagcaaaaacgtattactttgggatatacccaggccgacgtgggcctcacgctgggggttcttttcggaaaagtgttctcacaaaccaccatttgccgattcgaggccctgcagctgagcttcaagaatatgtgtaagctaaggcctttgctgcagaaatgggtcgaggaggcagataacaacgaaaacttacaggagatttgtaaggccgaaactttggtgcaggcgcgaaaacggaagaggacatcaatcgagaacagagtgcgaggaaacctggaaaacctattcctgcaatgtcctaaaccaacactgcagcagatcagtcacattgcacagcaactcgggttggaaaaagatgtcgtgagggtatggttctgtaatagacggcagaagggtaagcggtcttctagcgactacgcccaacgagaggactttgaggctgccggatctcctttcagcggtggaccggtttcattccccctggcccctggtccccatttcggaacacccggatatggcagccctcactttacggcgctgtactcttctgtgccattccccgaaggagaagcattcccacccgtatcagtgaccactcttgggtctcctatgcacagcaattag

SEQ ID NO: 4604 - DNA, 798 bp, Artificial Sequence
  Description of Artificial Sequence: Synthetic coding sequence
atgcatttctaccgcctcttcctaggtgcgactagacgattccttaaccccgagtggaaaggagaaatcgacaactggtgcgtgtacgtgctaacgagccttctgccatttaaaatccagagccaggatatcaaagccctgcagaaagagttggagcaatttgccaagcttctcaagcaaaaaagaataacactggggtatacgcaggccgatgtgggtctaactctcggtgtgctctttggcaaggtctttagccaaaccactatatgtcgattcgaggccctgcagttgtcattcaagaatatgtgcaagcttcgccctctcctgcaaaagtgggtcgaggaggccgataataacgagaacctgcaggaaatttgcaaggccgagaccctggtgcaggcccgaaaacgtaaacggacctcgatcgagaaccgagttcggggaaatttagagaatttgttcctgcagtgtcccaagccgactctgcagcagatcagccacattgcccagcagctgggactggagaaagatgttgtcagggtctggttctgtaaccgcagacagaagggaaaacggtcttctagcgactacgcacagagggaagatttcgaagccgctggctctccattttctgggggacctgtgtcctttcccttggcacccggaccacactttggaacccccggatacggctccccccactttacagccttgtacagttccgttccttttccagagggggaagcatttccgccagtgtccgttacaaccttgggctcgcccatgcacagcaactag

SEQ ID NO: 4605 - DNA, 1083 bp, Artificial Sequence
  Description of Artificial Sequence: Synthetic coding sequence
atggccggacatcttgccagtgacttcgctttttctcctcccccaggtggaggtggcgacgggccaggcggacctgagcctggatgggttgatccaagaacgtggctcagttttcagggtcctcccggaggacctggtataggcccaggagttggccctggtagtgaggtgtgggggatcccaccctgccctccaccgtacgaattctgtggtggcatggcatattgtgggcctcaggtgggagtggggcttgtaccccaagggggacttgaaacttcccagccggagggagaagccggtgttggtgtggaatctaattccgatggcgcaagcccggaaccctgtacagtgactcccggtgctgttaaacttgaaaaggagaagcttgagcaaaatccagaggaaagccaggatatcaaagccctacagaaagagctggagcagttcgcgaaactacttaagcagaagcgcattactctgggctatacacaggctgatgtgggtctgacattgggcgtcctgttcgggaaggtcttttcacaaactacgatttgtaggttcgaggcgctgcagctgagttttaagaatatgtgcaagctccgtccattgttacagaagtgggttgaagaggccgataataatgaaaatcttcaagagatatgcaaagctgaaacactggtgcaggcacggaaacggaagaggacctctatagagaatagggtgcgcggaaatttggagaacctgtttctccagtgccctaagcctacactgcagcagatcagccacattgcgcaacagctgggcctggaaaaagacgttgttagggtgtggttctgcaatcggaggcaaaagggcaaaaggtcctcctccgactacgcccagcgagaggactttgaggctgccggatctcctttttctggcggacccgtgtcttttcctcttgcacctgggccacactttggtacccccggttacggttctccgcacttcactgcactatatagctcagtgcctttcccagaaggcgaagcatttccacccgtatcggtgacaacgctagggtcaccgatgcattccaactag

SEQ ID NO: 4606 - DNA, 1083 bp, Artificial Sequence
  Description of Artificial Sequence: Synthetic coding sequence
atggccggacaccttgccagcgacttcgcttttagcccacctcctgggggagggggagacgggcctgggggaccagagcctgggtgggttgaccccaggacctggcttagttttcaagggcctcctggaggacctgggataggtcccggtgtaggccctgggtctgaagtttggggaattcctccatgcccacccccttacgaattctgcgggggaatggcgtattgcgggcctcaagtcggggttgggttggtgccccaggggggactggagacgagccagccagaaggagaggccggtgtgggagtggagtcaaactctgacggggcttccccagaaccttgtaccgttacccccggagcagtgaaattggagaaggaaaagctcgagcagaatcccgaagaaagccaggacataaaagccctgcagaaagaattagaacaatttgcaaaactacttaagcagaaaagaatcactcttggctacacgcaggccgacgtggggctcactctgggggtgctgttcggtaaagttttctcccagaccacgatctgcagattcgaagcgttgcaactgtcgtttaagaatatgtgcaaactgcgacctttgctgcagaaatgggttgaagaagccgataacaatgagaacctacaggagatctgcaaggcagaaactctggttcaggcccgtaagagaaagcggacaagtatcgagaatagagtccgcggtaatctcgagaaccttttcctgcaatgtccgaaaccgaccctgcagcaaatttcccatatcgcacaacagctggggttggaaaaagatgtcgttcgcgtgtggttctgcaaccgcaggcagaagggcaaacggtcaagttccgactatgcacaacgcgaggactttgaggcagccggtagcccgttctcaggcggtccagtttccttcccgcttgctcctgggccacatttcgggactccgggttatggttcccctcattttaccgctctctactcaagcgttcctttccccgaaggcgaggcgttccctcccgtgagcgtgaccactctaggctcacccatgcattccaattag

SEQ ID NO: 4607 - DNA, 798 bp, Artificial Sequence
  Description of Artificial Sequence: Synthetic coding sequence
atgcacttctatcgtttgtttttaggggctacacggagatttctaaatcccgaatggaaaggtgagatcgataattggtgtgtttacgtactgacttccctgttgccctttaaaatccaatcacaggatataaaagctttgcagaaggagctggaacaatttgcaaagctacttaagcagaaacggatcaccctgggctacacacaggcagatgtggggctgactctgggtgttttatttggcaaggtgttcagtcagacaaccatttgccggttcgaggcccttcagctgtccttcaagaatatgtgcaaattgcgccctcttttgcagaagtgggtggaggaagccgacaacaacgaaaacctgcaggagatctgcaaagccgaaacactggtgcaggctagaaagagaaagaggaccagtattgagaacagggttcggggaaatttagaaaacctctttcttcaatgccctaagccaaccctgcaacagatctctcacatcgcacagcaactgggacttgagaaggatgtggtcagggtgtggttttgtaaccggagacagaaaggaaaacggtcaagtagtgactatgcccagcgggaagactttgaggccgcagggagcccattttccggtggacctgttagctttcccctagcgccaggaccccactttggtactcccggttatgggagccctcatttcaccgctctctacagctcagtgccatttccggagggtgaggccttccctccagtctctgtcacaacactcggtagccctatgcactctaattag

SEQ ID NO: 4608 - DNA, 1083 bp, Artificial Sequence
  Description of Artificial Sequence: Synthetic coding sequence
atggcaggacacctggccagtgattttgcattcagccctccaccaggtggaggtggagatgggccaggtgggcctgaaccaggatgggtggatccacgcacgtggctgagctttcaggggccacccggaggcccaggcattggtcccggtgtggggcctggaagtgaagtgtgggggatccccccatgtcctccgccttacgaattttgtggagggatggcctattgtggtccacaggttggggtgggtttggtgccccagggcggtctcgaaacaagccagcctgaaggcgaagcaggcgtcggtgtggagtccaactccgacggcgcttctccagagccctgcacagtcacccctggcgctgtgaagctagagaaagagaaattggagcaaaatcctgaggagtcccaggacatcaaggctctccagaaggagctagagcagttcgcaaaattgctcaagcaaaaacgcatcaccctggggtacactcaagctgacgtcgggctgaccctcggggtgctcttcggcaaagtgttcagtcaaaccacaatttgcagattcgaagcactgcaattgagctttaagaacatgtgcaaactacgacccctgctgcagaagtgggtcgaagaggcagataataatgagaaccttcaggagatctgtaaggccgaaactctcgttcaggcgcgaaagaggaagagaacatctattgagaaccgggtgcggggaaatcttgaaaatttatttctgcagtgcccaaaaccaaccctccaacagatttcacacatcgcgcagcagctcgggttggaaaaagacgtggtgcgagtctggttttgtaaccgtagacagaaaggcaagaggtcttcatctgactacgcacagcgcgaggacttcgaggcagccggatcccccttcagcgggggacccgtgtctttccccctagccccaggtccccactttggtacccccggttatggcagccctcattttaccgctctctactcctcagtgccattccctgaaggagaggccttcccccctgtttcggtgacgaccttgggatctcccatgcacagtaactag

SEQ ID NO: 4609 - DNA, 369 bp, Artificial Sequence
  Description of Artificial Sequence: Synthetic coding sequence
atggctggacatctggcatccgacttcgcgttttcccctcctccaggcggaggcggagatggacctggcggaccggaaccaggctgggtggatcctcgaacctggttgagttttcagggccctcctgggggaccagggattgggccaggtgtggggccagggtcagaagtgtggggcatcccaccctgtccccctccctacgaattctgtgggggtatggcttactgcgggccacaagtcggcgttggtttagttcctcaggggggactggagacctcccagcccgaaggggaggcaggcggaggcgagcagcttcgatggggtttgcccggtgcgctccacaggcatccctggtgccgtgaagcctag

SEQ ID NO: 4610 - DNA, 798 bp, Artificial Sequence
  Description of Artificial Sequence: Synthetic coding sequence
atgcacttctatcggctcttccttggggcaacacgacgcttcttaaacccggagtggaaaggggaaatagataattggtgtgtttacgtcctcaccagtcttctgccattcaagattcagagccaagatatcaaagcactccaaaaggagttggagcaattcgcaaagctgttaaagcagaagaggataacactaggctacacccaggccgatgtgggtctgaccctcggcgttctgttcgggaaagtgttcagccagaccaccatctgtcggtttgaggccctgcagctgtcattcaagaatatgtgtaaacttcgccctctgttgcagaaatgggttgaggaggccgataataacgagaatctgcaagagatttgtaaagccgagaccctcgtgcaggcgaggaagagaaaaagaacctcaattgaaaatcgggtgaggggcaatttagaaaatcttttcctgcagtgcccgaaacccactctgcagcagatctcccacatagcacagcagttgggattggaaaaggacgtggtgagggtgtggttctgcaaccggaggcaaaaaggcaaaagatcctccagtgactacgctcagcgtgaggatttcgaggccgcaggctcacctttttcaggtggcccagtgagctttcctcttgccccagggcctcacttcgggaccccgggttatggctcaccccattttacagctctgtattcgagcgtaccattcccggaaggtgaggcctttccacctgtttccgttaccacactgggatcacccatgcatagcaactag

SEQ ID NO: 4611 - DNA, 1083 bp, Artificial Sequence
  Description of Artificial Sequence: Synthetic coding sequence
atggccggacatttggccagcgattttgccttcagtcccccaccaggcggaggaggagatgggcctggtggccctgagccgggatgggtggacccacgtacatggctcagcttccaggggccacccggtggtcctgggatcggacctggagttggccctggtagcgaggtctggggcattccgccttgcccacccccttatgaattttgtgggggtatggcctactgtggccctcaggttggtgtcggattggtgcctcagggcggtttagaaacatctcagccagagggcgaagccggtgttggtgtcgagtcaaatagtgacggagcctcacctgaaccctgtactgttacccctggcgctgtcaagctggaaaaagaaaaactggagcagaacccggaggaatcccaggatatcaaggcattacagaaagagctggagcaatttgccaaactcctgaagcaaaaacgcatcactctgggatatacacaagctgacgtaggcttgactctgggggtgctgtttgggaaggtgtttagtcagaccacaatctgccgctttgaggcactgcaattatccttcaagaacatgtgtaagcttcggccactgctacagaagtgggtcgaagaggccgataataacgagaaccttcaagaaatatgtaaggctgagaccctggtacaggcgcgtaaacgcaagcgaacatcaattgagaaccgcgtacgcggaaacctcgaaaacctgttcctccaatgcccaaaaccaacgctgcaacagattagccatattgctcaacaactgggcttagaaaaagatgttgtgcgtgtttggttttgcaaccggagacagaagggtaaacgctccagttctgactacgcccagcgtgaagattttgaagctgcgggatcacccttttccggtggtcctgttagttttccactagctcctggacctcatttcggtacacccggttacggtagcccacattttacagcattatacagctctgtgccttttccagaaggcgaggcattccctccagtttccgtgactaccctgggctctccgatgcattccaactag

SEQ ID NO: 4612 - DNA, 372 bp, Artificial Sequence
  Description of Artificial Sequence: Synthetic coding sequence
atggccggacatctggcaagtgatttcgccttctctccaccgcctggcggaggcggagatgggcctggcggacccgagccagggtgggtggacccacggacatggttgagcttccagggccctccgggtggcccaggcataggtcccggagtgggccctgggtccgaggtatggggaatccccccttgtcctccaccatatgaattttgtggtggcatggcctactgtgggccacaagtaggggtagggctggtgccacagggcggtctggagaccagccagcccgaaggagaagccggagtgggcgttgagacaccaatgggaccacctaggtccccagcaccccatccgttccctttccccctgctgtag

SEQ ID NO: 4613 - DNA, 558 bp, Artificial Sequence
  Description of Artificial Sequence: Synthetic coding sequence
atggccggacaccttgccagcgactttgccttctcacctcctcccggaggaggaggtgacggacctggtgggccagagcccggatgggtcgacccaagaacctggctttcattccaagggcctccgggaggccctggaatcggaccgggagttgggcctggttctgaggtctggggtattcccccatgcccacccccatacgagttttgcggcggtatggcctactgtggacctcaggtaggtgttggcctggtgccgcaaggagggctagagacttctcaaccagagggcgaagccggtgtcggcgtagagagtaattccgatggcgcaagtcccgagccctgtaccgtaactcctggagcagtgaagttagagaaagagaagctggagcagaatcccgaggaaagccaggatataaaggcccttcagaaggaattagaacagttcgccaaactgcttaaacaaaagcgaattacactcggatacactcaggccgacgttcatccaggaggctcaatctgggaaggtatacagcctaacgatcacctgcccttatag

SEQ ID NO: 4614 - DNA, 372 bp, Artificial Sequence
  Description of Artificial Sequence: Synthetic coding sequence
atggcaggccatctagcttctgactttgccttttctcctccacccggagggggtggggatggtccgggaggaccagagcccggatgggtggacccgagaacttggctgtcattccagggtcctcctgggggacccggtatagggcctggggtcggaccaggctcggaggtctggggaatacctccatgtcctccgccatacgaattctgtgggggaatggcctattgcgggcctcaagtgggcgtgggcttggtcccacaaggaggtctggagactagccagcccgaaggcgaagccggtgttggagtggagactcccatgggccctccacgttcccctgcaccgcatccgttcccatttccattactgtag

SEQ ID NO: 4615 - DNA, 558 bp, Artificial Sequence
  Description of Artificial Sequence: Synthetic coding sequence
atggccggtcatctcgcttctgatttcgcattttcacctcccccaggcggaggcggtgatggcccaggtggtccagagcccggttgggtcgaccccaggacctggttgtcattccaggggcctccaggtggacccggtataggacccggtgttggccctggttcagaagtttggggcattcctccttgtccccctccatatgagttttgcggtggcatggcctactgtggccctcaagtcggcgttggactcgtacctcagggcggtcttgagacttcgcagccagagggcgaggcaggcgtgggggttgagagtaattcagacggggctagccccgagccttgtactgtgacccctggggcagttaagctcgagaaagaaaaacttgaacagaaccccgaggagagtcaagacattaaggccctccagaaggagcttgaacagttcgccaagttgcttaagcaaaaacggattacactgggatatactcaggcagacgttcatcccggtggctccatctgggaaggtatccagcctaacgaccacctgcccctgtag

SEQ ID NO: 4616 - DNA, 372 bp, Artificial Sequence
  Description of Artificial Sequence: Synthetic coding sequence
atggccggacatctggccagcgacttcgccttctcaccaccccctggtggaggtggcgacggacctggaggcccagagcctggatgggtcgaccccaggacctggctctcatttcagggcccacccggtgggcctggcatcgggccaggggtgggcccaggttccgaggtgtggggtattcccccatgtcctcccccatatgagttttgtggcggtatggcgtattgtgggccacaagtgggagtcggtctggtgccccagggcggactggagacaagccagccggagggtgaggccggagtgggagtagagaccccaatgggccctccaagatctcccgctcctcacccttttcccttcccgcttctctag

SEQ ID NO: 4617 - DNA, 558 bp, Artificial Sequence
  Description of Artificial Sequence: Synthetic coding sequence
atggccggacatctggcatccgattttgccttcagcccccctccaggaggagggggagatggccctgggggacccgagcctggttgggttgatccgcgtacttggctgtcttttcagggacccccaggaggtcccggaatcggacccggtgtcggtcctggaagtgaggtatggggaattcctccatgcccacctccttatgagttctgtgggggtatggcctactgcgggcctcaggtcggagttggtttggttccccagggcggacttgagacctcacagcccgagggtgaggctggggtgggcgttgagtcaaactcggacggggctagtcccgagccttgtacagtgacgcccggtgctgtgaagttggagaaagagaagttggagcaaaaccctgaggaaagccaagatattaaggctctacaaaaggagctggagcaattcgccaaactcctgaagcagaaacgtatcacgctaggctacacacaagcagacgtacatcccggtggcagtatatgggaaggaatccaacctaacgaccacctaccattgtag

SEQ ID NO: 4618 - DNA, 558 bp, Artificial Sequence
  Description of Artificial Sequence: Synthetic coding sequence
atggctgggcacctggcaagtgacttcgcctttagcccaccccctggtggtggcggagatgggcctggcggtcctgaacctggctgggtagaccctcgcacgtggctctctttccaagggccaccaggtgggccaggcataggaccgggtgttggcccaggcagcgaggtgtggggcataccaccatgcccgcctccttatgagttctgtgggggtatggcatattgcgggcctcaggtcggcgtgggtctggtgccacagggcggtctggaaacctctcaacccgagggagaagcaggcgtgggggttgaaagtaattcagacggggcatcaccggaaccatgcaccgtgactcccggtgcagtgaaactggaaaaggagaaattggaacagaatcccgaagagtcgcaggacatcaaggcattgcagaaagagcttgagcaattcgccaagctgttgaagcagaagcgtattactttaggatacacacaggccgacgtgcaccctggaggatccatttgggagggtatccaacccaatgaccacctccctctatag

SEQ ID NO: 4619 - DNA, 372 bp, Artificial Sequence
  Description of Artificial Sequence: Synthetic coding sequence
atggcgggacatttggcgtccgattttgctttttcaccccctccaggtggcggaggggatgggcctgggggtcctgaacccggttgggttgatccccgtacttggctgagttttcagggcccacccggaggtcctgggatcggccctggtgtggggccagggtcggaagtatgggggatccccccttgccccccaccttatgagttttgcggtggaatggcctattgcggtccccaggttggggtgggcctggtgccccagggcggactcgagacaagccagcccgagggggaagcgggtgtaggagtcgaaacccccatgggacctccacgctctcccgcaccacacccgttccccttccctctactgtag

SEQ ID NO: 4620 - DNA, 372 bp, Artificial Sequence
  Description of Artificial Sequence: Synthetic coding sequence
atggccggtcacctggctagcgatttcgcgttctctcctccacccggaggtggaggagatggacccggtggtccagagcccggatgggtggacccccgtacctggttgagcttccagggtcctccagggggtcccggaattggacctggagtgggaccagggtcggaagtttggggaatacccccttgccctcctccgtacgagttttgtggaggaatggcctactgcggacctcaagtgggcgtgggtttggtgccccagggtggccttgagactagtcagccggagggagaggcaggcgtgggggtagagaccccgatggggcctccccgatcacctgcgcctcatccttttcccttcccactcctgtag

SEQ ID NO: 4621 - DNA, 2079 bp, Artificial Sequence
  Description of Artificial Sequence: Synthetic coding sequence
atggggactgtttccagtcggaggagttggtggcctttacctctgctccttttgctgctgttactcctcggcccagcaggcgctcgggctcaagaggacgaagacggcgactacgaagagctggtgctggctcttaggtccgaggaagacggcttagccgaggctcccgaacacggcaccaccgccacattccatcgatgtgcaaaagatccatggagactgcccggtacgtatgtggtagtcctgaaggaggaaactcacctgagtcaatccgagagaacagcccgtcggctgcaggcccaggccgctcggaggggctaccttacgaaaatcctgcacgtctttcatggactgttacccggattcctagtgaagatgtccggggacctgcttgaacttgccttgaagctgccacatgtggattacatagaggaagactcttctgtatttgctcagtccatcccatggaatttggaacgtattaccccaccacgctaccgagcagatgagtaccagccaccggacggaggttcactggtcgaggtttacttgctggacacatcaattcagtcagatcatagggagattgagggcagagtaatggtgaccgattttgagaacgtgcccgaagaagacgggaccagattccatcgccaagcctctaagtgcgatagccacggcactcatctggctggcgtggtttcgggacgggatgcgggagtggcaaagggcgcatcgatgagaagcctgcgggtcctgaactgtcagggcaaagggactgtgtctggcactctgatcgggctggagttcattaggaagagtcagctggtacagcccgtgggtcccttggtcgtgctgctccccctggcaggaggctatagtcgagtgttaaatgcggcatgtcaaaggctcgccagggccggtgtcgttttggtcacggctgctggcaacttcagggatgacgcatgtctgtacagccctgcaagcgccccagaagttatcaccgtcggcgcaacaaacgcccaggatcagcctgtgaccctaggcactcttggtactaactttggcagatgcgtggatttgttcgcccctggagaggacattattggggcttcttccgactgctctacctgttttgtgtctcagagcgggaccagccaggcagctgctcacgtcgcaggcatagccgctatgatgctttccgccgaacctgaactgacactcgcagagctgcgccagcggttgattcacttttctgccaaggacgtcattaacgaggcgtggttccccgaggatcagagagtgttgacacctaatttggtggcagctttgccgccaagcacacatggcgctgggtggcaattattctgccggaccgtatggtctgcccattccggcccaactagaatggctacggccgtggcacgttgcgcaccggacgaggagctgctatcctgcagctcattttcacgttctggcaaacgcagaggcgaaagaatggaggcccaagggggaaaactggtctgcagagcccataacgcatttggaggtgaaggcgtctatgccatcgcacggtgttgccttctgccgcaagccaactgcagtgtccataccgcaccccctgcagaggcctccatgggaacccgggtgcattgtcaccagcaggggcacgtgctgacgggatgtagctctcactgggaagtagaggatttggggacgcacaaacctcctgtcctcaggccacgaggccaacccaatcagtgcgttggccatcgtgaagcctctatacacgccagttgttgccatgctccgggactggagtgtaaggtcaaagagcatggcatacctgcccctcaggagcaggttaccgtggcttgcgaagaaggttggacactaaccgggtgttccgctctaccagggacgtcccacgtgttgggtgcatacgctgtagacaacacctgtgtcgttcgctcccgggacgtgtcaacaaccggctctacttctgagggcgcagtcactgccgtggcaatctgttgtcggagccgacatctggcacaagcctcacaggaattgcagtag

SEQ ID NO: 4622 - DNA, 618 bp, Artificial Sequence
  Description of Artificial Sequence: Synthetic coding sequence
atgggaacagtgtcctcaaggagatcttggtggcccttacccctgctcctgctccttcttcttctcctgggtcctgcgggagcaagagctcaggaagatgaggacggtgactatgaagagctggtgctggcgctcagatccgaagaagatggactagctgaggcaccagaacatggaacaaccgccacattccatcgatgtgccaaggatccttggaggctgcctgggacatacgtggtggtcttgaaggaggagacccatctgtctcagtcagaaaggacagcacgacggctgcaggcacaagctgccaggcgcggatacctgactaaaatacttcacgtctttcatggcttactgccaggcttcctggttaaaatgagcggtgacctgctggaacttgcgctcaaactcccacacgtggattatattgaggaagacagctccgttttcgctcagtctatcccctggaatctcgagcgcattacaccaccgagatatagggccgatgagtatcagcctcctgcctatctcgaagaccattgtgggggacatcggggtgctgtacagatggctctgcagaagacccaggagacgctaggccaggaacaattcgattag

SEQ ID NO: 4623 - DNA, 801 bp, Artificial Sequence
  Description of Artificial Sequence: Synthetic coding sequence
atggtgactgacttcgagaatgtccctgaagaggacggaactcgtttccaccgccaggcatctaagtgtgactcacacgggacacatctggccggagtggttagcggcagagatgcaggcgtggcgaagggagctagcatgagatccctacgcgtgctcaactgtcagggtaagggtactgtcagcgggactctcatcggtctggaatttataaggaagtcacaactggtgcagccagtcggtcctctggtggtgctgctgcccttggccggtgggtacagtagggttctcaacgcagcttgtcagcggctggctagagcaggcgttgtcctcgtgacagccgctgggaattttcgagatgacgcatgcctgtacagccccgcttctgcgccagaagtgatcacagttggagctactaatgcacaggaccaacctgtgactctggggaccctggggaccaactttggaaggtgcgttgatctgtttgcgccaggggaggacatcattggggcttcctctgactgttccacctgttttgtctcacagtccggcaccagtcaagcagctgctcatgttgctggaattgcggctatgatgctgtccgcagaacccgagcttacacttgcggagctcaggcaacgcttaattcactttagtgccaaggacgtaattaacgaggcctggtttcctgaagatcaacgggtgggatcctgctttgctggactgtacgggcagcacactcgtggactgcacggttggccacagccaagcccggctgctccccagatgcggtcctgttag

SEQ ID NO: 4624 - DNA, 3972 bp, Artificial Sequence
  Description of Artificial Sequence: Synthetic coding sequence
atggaagatgggggattaaccgcctttgaggaggaccagaggtgtttgtcccagtccctcccgctgcctgtgtctgccgaaggccctgccgcacagacaacagcggaaccgagtcgcagttttagcagcgcccacaggcacttgtcacggcgtaacggcttgtcccgcctctgccagtctcgaactgccctctcagaggatcggtggtcttcctattgcctatcttcactggccgcacaaaatatctgcactagcaaacttcattgccctgccgcacctgagcataccgatccttctgagcctagaggcagtgtgagctgttgctcacttctgcgaggtctgtcgtcaggctggagctctcccctcctgcctgcacctgtatgcaaccctaataaagctatattcacggtggatgctaagacgacagagatactcgtggccaatgataaagcctgtgggctgctgggatatagttctcaggatctgattgggcagaaactaactcagtttttcctgcgcagcgactcagacgtcgtcgaagctctgtctgaagagcatatggaggctgacggtcacgccgctgtggtgtttggaactgttgtggacataatttctcggtcaggagaaaagatcccagtgtctgtctggatgaaacgcatgcgccaggagaggagactgtgctgtgttgtggtactggagcctgtagagcgggtgtctacttgggtggccttccagagcgacgggaccgtcactagctgtgattctcttttcgcacatttgcacggttacgttagcggcgaggatgtagccggtcagcacattacggacctgatacccagcgtgcagctgccacctagtggccagcacattccaaaaaacttaaagattcaaaggtctgtgggcagagctagagacggtaccacttttccactgtcactcaaactgaagagccagccgagctctgaagaggctaccacaggagaggcagctcctgtttcagggtacagagcaagcgtttgggtgttctgtactatttcaggattgatcacactcctgccagacggaaccattcatgggattaatcactcgtttgccctcacattattcggctatggaaaaacagagcttttgggtaaaaacattacttttttgattccagggttctactcctacatggatctcgcatataatagcagcctgcagctgcccgatcttgctagctgcttggacgtaggtaacgagtctggctgcggggagcgcactttggacccctggcagggccaggaccctgccgaaggaggccaagatcctagaataaatgtggttctcgccggagggcacgtggtaccacgggatgaaataagaaaactgatggagtcccaggatatttttaccggaacgcaaactgagttaatcgctggcggacaactgttgtcctgcctgtccccccagcctgctccaggtgtggacaacgtccctgagggaagcctgccggtacacggcgaacaggccttgcctaaggatcaacagataaccgcgctcggccgtgaggagcctgtggccatcgagagtcccggacaggatttactcggggagtcaagaagtgaaccagttgacgtgaagccgttcgcatcctgcgaggacagcgaagccccagtgccggctgaagacggtggctctgatgctggaatgtgcgggttgtgccagaaagctcagcttgagcgaatgggtgtatctggtccgtctgggtccgatctgtgggccggtgcagctgtcgccaaacctcaggccaaggggcagcttgcaggaggaagtctgctaatgcattgtccctgctacgggagcgaatggggcttgtggtggcggtcacaagatttggccccatccccctccggaatggcaggtttatccttcggaacacctaccttagatgaaccatggttaggggtcgagaacgatcgcgaagagctccagacttgcttgatcaaagaacagctctctcagttgagcctggctggggctttagacgtgccacacgccgaacttgtcccgactgaatgtcaggccgtgacagctcctgtttcatcctgtgacctagggggaagggatctttgcgggggttgcactgggtccagcagtgcctgctacgccctggctactgacctacccggagggctggaagctgtagaagcccaggaagttgatgtcaatagcttctcctggaatctgaaggagttattcttctcagatcagacggatcagacctcgtcaaactgcagttgcgctacctccgagctcagagagactccttcctccctggcggtgggaagcgaccccgacgtggggagcctgcaagagcagggttcctgcgtgctggatgacagagaactcttgcttctgactgggacctgcgtggatcttgggcaaggtagacggttcagggaaagctgtgtgggtcatgaccctactgagcccctggaggtctgcctagtcagcagcgagcattatgctgcttctgacagggagagcccaggacatgtcccatccaccctggacgcaggtcccgaggatacatgccctagcgccgaggaacctcgccttaatgtgcaagtcaccagtacaccagtcattgttatgcggggagccgcaggtctgcagcgggaaatccaggagggcgcttatagcggatcttgttatcatcgagacggcctgaggttgtccattcaattcgaggtgcgcagggtcgagttacaggggccaacaccattattctgttgctggctggttaaggacctgttacacagccagcgcgactcggcagcaaggacccgcctgttcctcgccagcttacccggatcaacccactctaccgctgcagagctcaccggtccctctcttgtcgaagtgcttcgagccagaccatggtttgaagaaccaccgaaggctgtggaattagagggtttggctgcatgcgaaggtgagtattcacagaagtatagcacgatgtcaccccttggatccggagccttcggcttcgtttggaccgcagtcgacaaggaaaaaaataaggaagttgtggtgaagtttattaaaaaagagaaggtccttgaggactgctggatcgaagatcccaagctggggaaagtgacgctggaaatagccatcctctcccgggttgaacatgccaacattatcaaagtcctcgatatttttgaaaaccagggatttttccagctcgtgatggaaaagcatggcagcggcctggacttgttcgccttcattgataggcacccacgtttagatgagccattggcttcttacatttttcgccaactagtttccgccgtcggctatctgaggctgaaagatattatccacagggacataaaggatgagaatatagtcattgcagaggactttacaataaagttaatcgacttcgggagcgctgcttatctcgagaggggcaaattgttctacacattttgcgggacaatcgagtattgtgctccagaggtgttgatgggaaatccatatagaggacccgaactggaaatgtggagcctaggtgttactttatacacattggtctttgaagagaatcctttttgtgagctcgaagagaccgtggaagcagctatacacccaccttatctcgtgagtaaggaactcatgtccttggttagtgggctgttgcagcctgtacccgagaggcggaccaccctggagaagctcgttacagatccctgggtgactcagccagtgaatctggccgactatacttgggaggaggtgttcagggtgaataagccggagtctggagtactttcagctgcctcactagagatgggcaacaggagcctcagtgacgtcgcccaggcgcaggaattatgcggtggccctgtgcccggagaagccccaaatggacaggggtgccttcaccctggagaccccaggttactcacttcttag

SEQ ID NO: 4625 - DNA, 1488 bp, Artificial Sequence
  Description of Artificial Sequence: Synthetic coding sequence
atgtggcaactgaccagcctcttactgttcgttgcaacatggggtatttcgggcacccccgcacccttggatagtgtattctcgtcttccgagagagcacatcaagtgctgcggattcggaaacgtgctaattctttccttgaggaactcagacattcctcattggagcgggagtgcattgaggagatctgcgactttgaggaagccaaagagatcttccagaacgtcgacgacaccctggccttctggtctaaacacgtcgatggggaccagtgtctggtactaccacttgaacacccctgcgccagtttatgctgcggtcacgggacatgcattgacggcattgggtcattttcctgcgattgcaggtccggatgggaaggtagattttgccaaagaggggagggcgaacggtggatgctagcagggggaggagccggactggggcctggatgggggcgaggcacctccacgtcctgcccaaggccgccactaccagctgaagtttcattcctgaattgctcgctcgacaatgggggttgcacccattactgtctagaggaagtgggatggcggagatgcagctgcgctccaggttataagctaggtgacgatctgctccagtgccacccagccgttaagtttccatgtggaagaccctggaaacggatggagaagaaaagatcgcatctgaagagagacacagaagaccaggaggatcaggtcgacccccgactgatcgatggtaagatgacacgaaggggcgattcaccatggcaggtggtgctactcgattctaagaagaagttggcgtgtggggcagtcctcatccacccttcctgggttttgaccgctgcgcattgcatggatgagtctaaaaaactgcttgtccggctgggggagtatgatctccgcaggtgggagaagtgggagctggacctggatattaaggaggtctttgtgcacccgaattattctaagagcacgaccgacaacgatatcgctctgcttcacctcgcgcagccagccaccctgagccaaacgatagtacctatctgcctgccagatagcggcttggctgagagagagcttaatcaggccggtcaggaaaccctggtgacaggatggggctatcacagctcccgggagaaggaggccaagcgaaacaggacgtttgtcctgaattttatcaagatccccgtggtgccccacaatgaatgttctgaagtgatgtcaaacatggtatccgagaacatgctttgcgccggaatcctgggagatcggcaggacgcttgtgaaggcgacagcgggggtcccatggtggcaagtttccatgggacttggtttctagtgggcctggtttcatggggagagggatgcggactcttgcataattatggtgtatatacaaaggtgagccgctatttagattggatccatggacatatccgggacaaggaggctccccagaaatcctgggccccatag

SEQ ID NO: 4626 - DNA, 1386 bp, Artificial Sequence
  Description of Artificial Sequence: Synthetic coding sequence
atgtggcagcttacaagcctacttctgttcgtcgcaacctgggggataagtggaactccagccccattggattctgtattctccagctctgagcgggctcaccaggtcttgagaattcgcaaacgagccaatagcttccttgaagaactaaggcacagcagcctcgagcgggaatgtatcgaagaaatttgcgacttcgaggaggcaaaagaaatcttccagaacgtggatgacacattggccttctggagcaagcacgtcgatggggaccagtgtctggtgttacccttggagcatccttgcgcctccctgtgctgcggtcacggtacttgtatcgacggcattggaagtttcagctgcgattgtcgctcagggtgggaaggtagattctgtcagcgagaagtgagttttctcaattgcagccttgataatggtggctgcacccattattgtctagaagaggtcgggtggcgtagatgctcttgcgccccaggatataagttgggcgatgaccttttgcaatgtcacccagcggtcaagtttccctgcggcaggccttggaagagaatggaaaaaaaacgtagccatctgaagcgcgatacagaagaccaggaggatcaagtggaccccaggctcattgacggcaagatgaccaggcgcggagactcaccctggcaagtggtcctactcgattccaagaaaaagttagcctgtggggcagtgttgatccacccctcctgggtacttactgcagcccattgcatggacgagagcaagaaactgctagtgcgactgggtgaatacgacctacgtaggtgggagaagtgggagctggacttggatattaaggaggtgttcgtccatcctaattacagcaaaagcactactgataacgatattgctttgctccacctcgctcagccggctaccctgtcgcaaaccatcgtgccaatttgtttgcccgacagcggcctggcagagcgcgaactaaaccaggctggtcaggagacactggtcacaggctggggctaccattcatcgcgggagaaggaggctaagcgcaacaggacctttgtactgaactttattaaaattcctgttgttccgcacaatgagtgttctgaagttatgtcaaacatggtcagtgaaaatatgctttgtgccggtatcttaggcgatcggcaggatgcctgtgaaggtgacagcgggggtcccatggtcgcaagctttcacggaacctggtttctcgtggggcttgtcagctggggtgaaggctgcggtcttcttcacaactacggtgtgtacacaaaggtttcccgatacttagactggattcatgggcacatacgcgacaaggaagctcctcagaagtcatgggcaccttag

SEQ ID NO: 4627 - DNA, 351 bp, Artificial Sequence
  Description of Artificial Sequence: Synthetic coding sequence
atgtggcagctgacctccttgcttctgttcgtggctacttggggaattagcggtactcccgctcccctggattctgtttttagcagcagcgagcgagcccaccaagtcctccgcatcagaaagagagcaaacagcttcctcgaagagctgcgccacagcagtcttgaacgagagtgtatcgaggagatttgcgacttcgaagaggccaaagagatttttcagaacgtcgatgacacgctggccttctggtccaaacacgttgatggcgatcagtgtctagtgctcccgctggaacacccatgtgcctctctctgttgcggccacggcacatgtatcgacggcatcggatag

SEQ ID NO: 4628 - DNA, 381 bp, Artificial Sequence
  Description of Artificial Sequence: Synthetic coding sequence
atgtggcaactgaccagcctgctcttatttgttgctacatgggggatatctggaactccagcgcctctggatagtgtgtttagctccagcgagagggcacaccaagtgctgcggatccggaagcgggcaaacagctttctggaagagctccgccactcctcattggaaagagagtgtatcgaggaaatctgtgattttgaggaggcgaaggagatttttcagaatgttgacgatacactcgctttctggtctaagcatgttgatggtgaccagtgcttagtgctgccgctggagcacccatgtgcatccctgtgctgtgggcatgggacctgtatcgacggtatcggaagcttctcctgcgactgtaggtccggttggtag

SEQ ID NO: 4629 - DNA, 1551 bp, Artificial Sequence
  Description of Artificial Sequence: Synthetic coding sequence
atggccgcaggcaggagaacttgctctatatccactactaggccctgcgcatcggctagtcggatgtggcaacttaccagtctgctattgtttgtcgctacgtggggaatctcaggcacaccagctcccttggacagcgtgttctcatctagtgaacgagcccatcaagtgctccggatcaggaagagggccaactcttttcttgaggagctgcggcacagtagcttagagagagaatgcatcgaggagatctgcgattttgaggaagctaaagagatctttcagaacgtggacgacactctcgccttctggtcaaagcatgtagatggcgaccaatgcctggttctacccttagaacatccatgcgcaagtttgtgctgtgggcatggcacgtgtatagacggcatcggatctttctcttgcgactgccgatccggatgggagggccgtttttgccaacggggtgagggagagagatggatgctggccggtggaggcgctgggctgggtcctggctgggggcgaggcacctccactagctgcccacggccaccactcccggcagaagtctcttttctgaattgctccctggataacggcggatgtacacactactgtttggaagaggtgggatggcgcagatgtagttgcgcgcctggatacaagctgggagacgatctgcttcagtgtcatcctgccgttaagttcccttgcgggaggccctggaagagaatggagaaaaagagatctcacctcaaaagggatactgaggatcaagaggatcaggtagaccctcgccttatagatggtaagatgactcggcgaggggattcaccatggcaggtggtcctgttagattccaagaaaaagctggcctgtggggctgttctaatccatccaagctgggtgcttactgccgctcattgcatggacgagtctaaaaaactcctggtgagattgggtgagtacgatctgagacgttgggagaaatgggagctggacctcgatataaaggaagtgttcgtccacccgaattacagcaagagcactactgacaacgacattgccctgctgcatctggcacaacctgccactttaagtcagaccattgtcccaatctgccttccggatagcggcctggcagaaagggagctgaatcaggccggacaggagactcttgtgacgggctgggggtatcacagctccagagaaaaagaggccaaaaggaaccgcacatttgttcttaattttatcaagattcccgtggtccctcataacgagtgcagcgaagtgatgtccaacatggtgagcgaaaacatgctatgtgctgggatcttgggcgatcgccaggatgcctgtgaaggtgactccggcggacccatggtggcttcgtttcacggaacctggttcttggtgggtcttgtgtcttggggagaaggctgcggactcttgcacaattatggagtttacacgaaggtctcacggtacctcgattggatacacggccatattcgcgataaggaggccccacagaagagctgggcaccgtag

SEQ ID NO: 4630 - DNA, 1263 bp, Artificial Sequence
  Description of Artificial Sequence: Synthetic coding sequence
atgtggatgacacactggcctagcggaccttccacatcaacagtgacctcagcctggagctgcccttggagtacccgagcccctgcctgcgcggcaggcactgcgcgagcttccaccgcctcagcggcatctgcggctactgcggctgcggctggcagggctgctagcgccagtgctgtgcggggaagaggcggatgctggaggggcggtgcgggacttgggccaggttggggacgaggcacttccactagctgcccgagaccacccttaccggcagaagtgtccttcctgaattgttccctggataatggcggatgcacacactactgccttgaagaagttggctggaggagatgttcttgtgcacccggttacaagctcggagatgatctgctgcagtgtcatccggctgttaaattcccgtgcgggcgaccatggaagcgcatggagaagaaaagaagtcacctgaaaagggacaccgaagatcaggaggaccaagtcgatccaagattaattgatggcaagatgacccggaggggcgacagcccgtggcaggtagtcctgctggatagcaagaaaaaactggcatgcggagctgtcctcattcaccctagttgggtcctgaccgccgcacattgcatggatgagtcaaaaaaactactcgtgcgactgggcgagtatgatctgcggagatgggagaagtgggagctggacctcgatatcaaggaggtgttcgtccaccccaactattcaaagagcactaccgacaacgacattgccctcctccatttggcacaacccgctactctcagccaaaccatcgttcctatttgcttgcctgacagcggccttgccgaacgcgagctcaaccaggctggacaggaaacccttgtcaccggttggggttaccactcctcccgagaaaaggaagccaagcgcaaccgcaccttcgtgttgaacttcatcaaaatcccggttgtaccacacaacgagtgttcggaggtcatgtccaatatggtgtctgaaaacatgttatgcgccggtatcctgggggaccggcaggacgcatgtgaaggtgatagtggcggaccaatggttgcctccttccatggaacgtggttcttggtggggctagtgtcatggggagagggctgcggccttctccataactacggagtttacaccaaggtgtccaggtatttagactggatccacggtcacattagggacaaggaagccccacagaagagctgggcgccttag

SEQ ID NO: 4631 - DNA, 354 bp, Artificial Sequence
  Description of Artificial Sequence: Synthetic coding sequence
atgcctcgcctgttcttttttcacctacttggcgtctgcctgttgctgaatcagttctcgcgcgctgttgcagatagctggatggaagaagtgattaagctgtgtggcagggaactggttagagcgcagatcgccatctgcggcatgagcacctggtcaaaaaggtcactctcacaggaggacgctccccaaacccctaggcctgtggccggtgattttatccagacagtgtccctgggcatctccccagatggaggcaaagcactccgtactggtagctgctttacaagggaattccttggcgcactttccaagctctgccatcccagttcaactaagatccagaagccttag

SEQ ID NO: 4632 - DNA, 558 bp, Artificial Sequence
  Description of Artificial Sequence: Synthetic coding sequence
atgcctagacttttctttttccacctactgggggtgtgcctgctgctgaaccagtttagcagggccgtggccgactcatggatggaggaggtcatcaaactgtgcggcagagaacttgtccgtgcacagatagccatatgcggcatgtccacctggtccaaaagatctctgtctcaagaggacgcgcctcagacgcctcgcccagtagcagaaattgttccaagctttatcaacaaagatacagagaccatcaacatgatgagcgaattcgttgctaacttaccacaggaactcaagttaacactgagcgagatgcagccagcccttcctcaactgcagcagcatgtgccagttctcaaggactcatctctgctgttcgaggaattcaaaaaactgattcggaacaggcagtccgaggcggcagatagctctcccagtgaacttaagtatctggggttagacacgcacagtagaaaaaagcgtcagctgtatagcgcactggccaacaagtgctgtcacgttggttgcaccaagcggtccttggccaggttctgttag

SEQ ID NO: 4633 - DNA, 1047 bp, Artificial Sequence
  Description of Artificial Sequence: Synthetic coding sequence
atgaacggaactgagggacctaacttttatgtgcctttcagcaatgccactggcgtggtaagatccccctttgaatatccacagtattacttggcggagccatggcaatttagcatgctcgctgcatacatgttcctgctcatcgtcttgggtttccctatcaacttcttgaccttgtacgtgaccgtacagcataaaaaactcaggactcctctcaactacatcctgctgaaccttgctgtggctgacctattcatggtcctgggcggtttcacaagtacattgtacactagcctgcacggttactttgtgtttggtcccacaggctgcaatttggaaggatttttcgccactctgggaggcgaaattgcgctttggagcctcgttgtgttagcaatcgagaggtacgttgtggtttgcaagccaatgagcaacttccggttcggtgagaaccacgctatcatgggagtcgcatttacttgggtgatggccctcgcttgcgctgcaccccctttggcaggatggtcccggtatattccagaaggtctacagtgttcatgcggaatcgattattataccctgaagccagaagttaacaatgaaagctttgtgatctatatgttcgttgtgcactttaccattcctatgataatcattttcttttgctacggccagctagtcttcactgtgaaagaagcagcagctcagcagcaggaatccgcgactacccagaaagcagagaaggaagttacacgcatggttattattatggtcatcgcctttttaatctgttgggtgccatatgcttcagttgccttttatatttttactcaccaagggagcaactttgggcctatattcatgacaataccagctttcttcgccaagtcagcagccatttacaacccagtaatctacatcatgatgaacaagcaattcaggaactgcatgctgacaaccatttgctgcggtaaaaatcccctcggagacgacgaggcatcagctactgtcagtaagactgagacctctcaagtggccccagcatag

SEQ ID NO: 4634 - DNA, 1257 bp, Artificial Sequence
  Description of Artificial Sequence: Synthetic coding sequence
atgcctagctcggttagctggggaatcctccttcttgccggtctgtgctgcctggtccctgtcagcctggcagaagatccgcagggagacgccgcacagaagactgacacttctcatcacgatcaagaccacccgacatttaataagattaccccaaacctcgccgagttcgccttctccttgtatcgccagcttgcccaccagtcgaacagtaccaacattttcttcagccctgtgtccatcgcgaccgccttcgcaatgttatccctcggcacaaaggctgatacccacgacgagattctcgagggcctaaactttaatctcactgaaatccctgaagctcagatccacgagggattccaggaactccttcgtacgctgaaccagcccgacagccagctgcagttgaccacgggaaacggcctgtttctgtctgagggtcttaagcttgtggacaagtttctagaagatgtaaaaaaactgtatcactcggaggcattcactgtcaacttcggggatacagaggaggccaagaaacagattaatgactatgtcgagaagggcactcagggcaagatcgtggacttggtcaaagaactcgacagggatacagtgtttgctttagtcaattacatttttttcaaagggaagtgggaaaggccctttgaggtgaaggataccgaggaagaggactttcacgtcgaccaggtgacaacggtgaaagtgcctatgatgaaacggctcggcatgttcaatattcagcactgcaagaagttgtccagctgggtgctgcttatgaaatatctaggcaatgcaaccgccatatttttcctgcccgatgaaggaaagttgcaacatttggaaaacgagctgacacacgatataatcaccaagtttcttgagaacgaggatcgtcgctcggccagcctgcacctgccaaaactgtcaatcaccggcacatacgatctcaagagcgtgctgggccagttagggatcacaaaggtattttctaatggtgcagacctcagcggagtcacggaagaagcgcctctgaaactgagcaaggctgtgcataaggcagtcctgactatcgacgaaaagggtactgaggccgcaggggctatgttcctggaagccattcccatgagcattcccccagaagtgaagttcaacaagcctttcgtattcctgatgatagaacagaacacaaagtccccattgttcatggggaaagtggtgaatcccacgcagaagtag

SEQ ID NO: 4635 - DNA, 1257 bp, Artificial Sequence
  Description of Artificial Sequence: Synthetic coding sequence
atgccctcttctgtgtcctgggggatcctgttgctggcgggtctgtgttgcctggtgcccgtttccttagccgaggacccacagggcgacgccgctcagaagacagatacctcacatcacgaccaggaccaccccacgtttaataaaattacgcctaacctggcagaattcgctttctctctgtatcgtcagcttgcccatcaatcaaactctacgaatatttttttttcccccgtatccatagccaccgcttttgcaatgctgtcccttggcaccaaagccgatacccatgatgaaatcctggagggtctgaattttaacctcaccgaaatcccggaagcgcagatccacgagggcttccaggaattgctgcgcaccctgaaccagcccgatagccagcttcagctgacgaccgggaatgggctgtttctctctgaagggttaaaactggttgataaatttctggaagacgtgaagaaactttaccacagcgaggcgttcaccgttaactttggcgacaccgaggaggcaaaaaaacagattaatgactacgtggaaaaaggaacccaggggaagatcgttgatctagtcaaggaactggacagggatactgtgttcgccctcgtaaactacatattctttaagggcaaatgggaacgcccttttgaggtgaaggatacagaagaggaggactttcacgtggatcaggtgacaactgtgaaggtacctatgatgaagagactcggtatgttcaatattcaacattgcaagaaactgagtagctgggtactccttatgaagtacctcggtaacgccaccgcaatcttttttctacctgacgaggggaagcttcagcacctggaaaatgaactcactcatgatattataaccaaattcttagagaacgaagatagaaggagcgcatccctgcacctgcccaaactgtcaattacagggacatacgatttaaaatcggtgctggggcagttagggataaccaaagtattctccaatggcgcagacctctctggagtcactgaggaggccccacttaagctttctaaggcagttcacaaggccgtcttaactattgacgaaaagggcacagaggccgctggtgccatgttcctggaggccatccctatgtcaatcccacctgaggtgaaatttaataaaccttttgtgtttctgatgatagaacaaaataccaaatcacctctgtttatgggcaaagttgttaacccaacccagaagtag

SEQ ID NO: 4636 - DNA, 1257 bp, Artificial Sequence
  Description of Artificial Sequence: Synthetic coding sequence
atgcctagcagcgtgtcctgggggattctattgcttgcgggtctctgttgtttagtgcctgtatcgctggcggaagatcctcagggcgacgccgctcagaagacagacacttcccatcacgaccaagatcatcccacattcaataagatcaccccgaatcttgccgaatttgcattttccctgtacagacagctggcacatcagtccaatagtacaaacatattttttagccctgtgagcattgccaccgccttcgccatgctgagcttgggcactaaggccgatactcatgacgaaatccttgagggcctgaacttcaatctgacagagattcccgaggcacagattcacgaaggcttccaagaattgctgcgtaccctgaatcagcccgattcccagctccagttgaccacagggaatgggctgttccttagcgaaggcttgaagcttgttgacaagttcctcgaagatgtcaaaaaattataccattctgaggccttcacagtcaacttcggcgataccgaggaagcgaagaagcaaatcaatgattacgtggagaagggcactcagggtaaaattgtggatctggttaaggagctcgatagggataccgtcttcgccctggttaattacatcttctttaaaggtaagtgggaaagacctttcgaagtgaaagacaccgaagaagaagatttccacgttgatcaggttacaactgtgaaggtgcctatgatgaaacgcctgggcatgtttaatatccagcactgtaagaaactgtccagttgggtgttattaatgaagtatttgggaaacgccaccgcaattttcttcctgcctgatgaaggcaagctccaacacctggagaacgagcttacacatgatattataacaaaattcctcgaaaatgaggatcggcgtagtgccagcttgcacctgcctaaattgagtatcactgggacttatgatctcaagagtgtgcttggccagctgggaatcacaaaggtcttctccaatggtgctgacctcagtggagtgacagaagaagcacctctgaagttatcgaaggcagtgcacaaggcggtactcacaattgacgagaagggaacagaagcagccggagcaatgttcctcgaagcaatccctatgtcgattcctcccgaagtcaagttcaataagcctttcgtttttctgatgatcgaacaaaatactaagtccccgttgtttatgggtaaagtggtgaacccaacccagaaatag

SEQ ID NO: 4637 - DNA, 1080 bp, Artificial Sequence
  Description of Artificial Sequence: Synthetic coding sequence
atgccctcaagtgtgtcatggggaatcctcctcttggcaggcctttgctgtttggtccctgtcagtctcgcggaggacccccagggtgacgctgcccaaaagacagatacctctcaccacgatcaggaccatcctacattcaacaagatcacccctaacctggcagagtttgccttctctctgtatcgacaattagcacaccagagcaattcaaccaatatcttcttctcccccgtgagcatcgcgacagccttcgcgatgctgagtcttggtacaaaagcagatactcatgacgagattctggagggattgaatttcaatcttaccgagattcctgaggcacagatccatgagggattccaggaactgctgaggacgctgaaccagcctgacagccagctgcaattgactacaggtaacggcctgttcctatccgaagggttgaagctagtggacaagttcctggaggatgtgaagaagctgtaccactcggaagcatttactgtcaactttggggacactgaggaggccaaaaagcagatcaacgattacgtcgaaaaaggtacccagggcaagattgtcgacctggtgaaagaactcgatcgcgataccgtgttcgctctggtcaattacattttcttcaaaggtaaatgggaaaggccctttgaggtcaaggacaccgaagaagaggattttcatgtcgaccaagtcaccactgtgaaggtacctatgatgaagcgtctcggaatgttcaacattcagcattgtaagaaactatcatcctgggtccttctgatgaaatacttaggaaatgcgacagctatttttttcttacccgacgaaggcaaactgcagcacttagagaatgagctgacacatgatataataaccaagtttcttgagaacgaggatcgtcgctctgcctcgctgcacctgcctaagctttccattaccggcacttacgacctgaagtctgtcttgggtcaactcggaatcaccaaggtgtttagtaatggggctgatctgtctggcgttaccgaagaagcccctctaaagctaagtaaggtgcgcagcccctag

SEQ ID NO: 4638 - DNA, 1257 bp, Artificial Sequence
  Description of Artificial Sequence: Synthetic coding sequence
atgccctccagtgtctcctgggggatcctgctcctcgctggcctgtgctgcctggtgccggtgagtctggccgaggacccacaaggagacgcagcccagaagaccgatacttctcatcatgaccaggatcatcccactttcaataagatcacccctaatctggccgaattcgccttctccttgtaccgtcagctagctcaccaaagcaatagcaccaatatattcttctcccccgtctccatcgccactgccttcgccatgctgtctctcggcacaaaggctgatacacatgacgaaatccttgagggcttgaattttaacctgacagaaattccagaggcccagatccatgaaggattccaggagcttctgaggactctgaaccagcctgactctcagttgcagctgaccaccggtaacggactgtttctgtcagaaggcttgaagctcgttgacaagtttctggaggatgtcaagaaactgtaccacagtgaggcgtttacagtgaatttcggcgataccgaggaggcaaagaagcagataaacgactacgttgaaaagggaacacagggcaagatagtagatctggtgaaagagcttgaccgcgacacggtgtttgctctcgtaaattatatattcttcaaaggaaagtgggagcgaccattcgaagtgaaagatacggaggaagaagatttccacgtggatcaggtgactacggtgaaggtgccaatgatgaaaaggctgggcatgttcaatatccaacactgcaaaaaactgagttcatgggtcctgctcatgaagtacctggggaatgccaccgctatctttttccttccagacgagggaaagctgcaacacctcgagaacgagttgacccatgatataatcaccaagtttctggagaatgaagatcgtcgctcagcttctttacacctccccaagttgtctattaccggaacatatgatctaaaaagcgttttaggccagctcgggataaccaaagtcttctctaacggggcagacctaagcggtgttaccgaggaggctcctctgaagctatccaaggccgtacacaaggccgtcttgacgatcgacgagaagggcaccgaggctgcgggtgctatgtttctggaggctatacccatgtcaattccccctgaggtgaagtttaataaaccattcgtttttttgatgatcgaacagaatacaaaatctcccttgtttatgggcaaggtggtgaacccgacccagaagtag

SEQ ID NO: 4639 - DNA, 1257 bp, Artificial Sequence
  Description of Artificial Sequence: Synthetic coding sequence
atgcctagcagcgtcagctggggcattttattgctcgcaggcctgtgttgtttggtacctgtgtcgctcgccgaggatcctcagggcgacgctgctcagaagaccgatacatcacatcacgatcaagaccacccaaccttcaataagattactcctaatctggccgagttcgccttttcgttgtataggcagcttgctcaccagtccaacagtactaatatcttctttagtccagtgagcatagccactgcttttgcaatgctgagcttaggaaccaaggctgatactcacgacgagattttagaaggcttaaacttcaatcttaccgagataccggaggcccagatacacgagggtttccaagagctgctaaggacccttaaccagcccgatagccaactacagctcactacagggaacggcctgttcttgagtgaaggactgaaactggtggacaaattcctcgaagacgtgaagaaactgtaccactcagaggcctttacggttaacttcggggacacagaagaggctaagaaacaaattaacgactacgtcgagaaaggtacccaaggcaagatcgtcgacttggtaaaggagctcgatagagacactgttttcgctctagtgaactacattttcttcaaaggtaaatgggagcggccatttgaggtcaaggacacagaggaggaggacttccatgtggatcaggttacaaccgttaaggtgccgatgatgaaacggctgggcatgttcaacatacaacactgcaagaagctgtcgagttgggtgctgctcatgaaatatttaggcaatgccaccgcaatcttctttctgcccgacgagggaaagctccagcacctggagaatgaactgactcacgatatcattactaaatttttagaaaatgaggatcgacggagcgcttctttgcacttgcccaaactgagcattaccggaacttatgatctcaagagcgtgcttggccagctgggaattaccaaggtgttctcaaatggggcagatctaagtggtgtgacagaagaagcgccactcaaactgagcaaggccgtacataaagctgtcctgacaatcgacgaaaaggggacagaggctgccggagccatgtttctggaagccattccgatgagcatcccccctgaggtgaagtttaataaacctttcgtatttctcatgattgagcagaacaccaaaagtcctctgtttatggggaaggtcgtgaatcctacccagaagtag

SEQ ID NO: 4640 - DNA, 1257 bp, Artificial Sequence
  Description of Artificial Sequence: Synthetic coding sequence
atgccctccagtgtaagttggggaatcctgcttctggctggtctctgctgtctcgtcccggtgtcgcttgctgaggacccccaaggcgatgccgctcagaaaaccgacacatcacaccacgaccaagaccatcccacctttaataagattacgcctaacttggctgagttcgccttctcattgtaccgccaactcgcgcaccaatctaacagcaccaacattttctttagtcccgtgagtatcgctactgccttcgccatgctgtctctcggaacaaaagcggacacccacgatgaaatccttgagggactgaactttaacctgactgagatcccggaagcgcagatccacgagggatttcaggagctactgcggaccttgaatcaaccagactcacagctgcagctgaccacaggtaatgggctttttctctccgaagggctgaagctggtggacaagtttttggaggacgtgaaaaaactttatcacagtgaggcattcacagtgaacttcggcgacactgaagaggcaaagaagcagatcaatgactacgttgagaagggtactcagggcaagatcgttgatctggtgaaagagttggaccgggacactgtcttcgccctggtgaactatatattctttaaaggcaaatgggaacgccctttcgaagtgaaagacaccgaggaggaggatttccacgtcgatcaggtcactaccgtgaaggtccctatgatgaagcgtcttggtatgtttaatatccagcattgcaaaaaactgtctagctgggtcttattgatgaaatatctcggcaacgccacagccatcttttttctgcccgacgagggcaagttacagcatctcgagaacgagctaacccacgatattattacaaagttcttagagaatgaggacagaaggtcagctagtctgcatttgcctaagctatccattacaggtacatacgatctcaaatctgtcttgggacaactaggcatcaccaaagttttttccaatggcgctgacctctcaggtgtgacggaggaagccccattgaagttgagcaaggctgtccataaagctgtactcactattgatgagaagggaacagaggcggcaggagctatgttcttagaagcaatacctatgagcattcctcccgaagtcaagttcaacaagcccttcgtgttcctgatgatagagcaaaacaccaaatctccactgttcatgggcaaagtcgtgaatcctacccaaaagtag

SEQ ID NO: 4641 - DNA, 1257 bp, Artificial Sequence
  Description of Artificial Sequence: Synthetic coding sequence
atgccctcaagcgtttcatggggcattcttctgctcgccggactctgttgcctcgtcccagtgtctctagccgaggatccacagggcgatgccgctcagaagaccgatacttcccatcatgatcaggaccatccaacctttaataagatcactcccaacctggcagagtttgcgttctccctctatagacagctggcccaccagtcaaactcaacaaacattttcttctcccctgtctcaatcgctaccgcttttgcaatgctgtctcttgggaccaaagccgatactcatgatgagattcttgaaggactgaattttaatttgacagagatacctgaagctcagatccacgagggctttcaggaactgctgaggacattaaaccagcctgactctcagctccagctgacgactggcaatggcctgttcctttctgaaggattaaagttagtcgacaaatttcttgaagacgtcaagaaactatatcatagcgaagccttcacagtgaattttggcgataccgaagaagccaagaagcagattaatgactatgtggagaagggaactcaaggcaaaatcgtagacctcgttaaagagcttgatcgcgatacagtgttcgccctcgtcaattatattttctttaagggaaagtgggagcgaccttttgaggtgaaagacacagaggaggaagatttccacgttgatcaggtcacaactgtgaaggttcctatgatgaaacgtctggggatgtttaacatccagcactgtaaaaaactgtccagctgggtgcttttgatgaagtacctggggaatgccaccgccatcttttttctaccagacgaaggcaaactacaacacctggagaacgaactgacacacgatattattacaaagttccttgaaaacgaagaccgccgatccgcatctttacatctgcctaagttgagcataacaggaacttacgatctcaaatccgttttgggccagctgggtattactaaggtgttttcgaacggggcagacctttcaggcgttaccgaagaggccccactgaagctgtccaaagccgtacataaagctgttctgactatagatgaaaagggtaccgaggctgccggagctatgtttcttgaggcaatccccatgtctatccccccagaagtaaagttcaacaaaccctttgtttttcttatgattgagcagaacaccaagtctccccttttcatgggcaaggtagtcaatcctacgcaaaaatag

SEQ ID NO: 4642 - DNA, 1257 bp, Artificial Sequence
  Description of Artificial Sequence: Synthetic coding sequence
atgccaagcagcgtgagctgggggatccttctactggccggtctctgttgcctcgtgccggtctcactggccgaagaccctcagggggacgccgctcagaaaacggacacctcacatcatgatcaggaccaccccacctttaataagattacacccaacctggccgaatttgcttttagtttgtaccggcagcttgcccatcagtctaatagcactaatattttttttagcccagtctcaatcgcaacggccttcgccatgctgtccttggggacgaaagcagatacccatgacgagatcctcgagggacttaattttaacctgaccgaaatccccgaagcgcagatacacgaagggtttcaggaactgctccggaccctgaatcaaccagatagccagctgcagcttacgacagggaatggactgtttctctccgagggtttaaaacttgtggataagttcctcgaggacgtgaagaagttgtatcacagtgaggcctttaccgttaactttggagataccgaagaagctaaaaagcaaattaacgactatgtggagaaaggcacacagggcaaaatcgtggacctcgtgaaggagctggatagagacaccgttttcgcacttgttaactatatcttttttaaagggaaatgggagcgaccgttcgaagtcaaagatacggaggaggaggattttcacgtggaccaggttaccaccgtgaaagtgccaatgatgaagcgccttggtatgttcaacatacaacactgcaaaaagctttctagttgggtcctgctcatgaaatatctgggtaatgccactgcgatattctttcttcccgacgagggaaagctccagcacctggaaaacgagctgactcacgatatcatcacgaagttcctggagaatgaggatagacgcagcgcctccctgcatctacccaaattatccataactggtacgtatgatttaaaatccgttctgggtcagttggggattactaaagtgttctccaacggggctgatttatccggggtgacggaggaagcccctttaaaactcagcaaggccgtacacaaagcagtcctgacgatcgatgaaaagggaacagaggcagccggagctatgttcttggaggcaattccaatgtcaataccacccgaggtgaagttcaacaaaccattcgtgtttctaatgattgagcaaaacactaaaagcccgctattcatgggcaaggttgtcaatcccacacagaaatag

SEQ ID NO: 4643 - DNA, 279 bp, Artificial Sequence
  Description of Artificial Sequence: Synthetic coding sequence
atgcccagctccgtcagttggggaattctgctgctcgcgggactgtgttgcttagttccagtaagcctggcagaggacccgcaaggggatgcagctcagaaaactgatacctctcatcacgaccaggatcatccaaccttcaacaaaatcacaccaaacctggctgaattcgctttctcgttgtatagacaactggcccatcagtcgaattcaaccaatatcttcttttcaccagtgtcgattgccaccgccttcgctatgctgtccctcggaacttag

SEQ ID NO: 4644 - DNA, 471 bp, Artificial Sequence
  Description of Artificial Sequence: Synthetic coding sequence
atgccaagctctgtgtcttgggggatcctgctgctggcgggactgtgttgcctggtgccagtcagtctcgcagaagacccccaaggcgatgctgcccagaagacagacacatctcaccacgatcaggatcaccctacattcaacaagataactcccaatctggcggaatttgccttttctctttaccgccaacttgcccatcagtccaactcaacaaatattttctttagcccagtgtctatcgccactgccttcgctatgttgagtctgggtaccaaggcagacactcacgatgagatcctggaaggcctgaactttaacctgacggagataccagaggctcagatccatgagggattccaggaactgttgcggacccttaaccagcccgatagccaactgcagctgactaccggcaacgggctgtttctgtctgaaggcctgaaactggtcgataagtttttagaatag

SEQ ID NO: 4645 - DNA, 354 bp, Artificial Sequence
  Description of Artificial Sequence: Synthetic coding sequence
atgccctctagtgtttcttggggcattctgctcttggcgggtctgtgttgtctggttccagtgagcttagctgaggacccgcaaggtgatgcggctcagaagaccgatacttcgcatcatgatcaggaccacccaacctttaacaaaattacaccaaacctggcagagtttgcatttagcctgtatagacagttggcccaccagagtaactcaacaaacatcttctttagccccgtttctatcgcaacagccttcgccatgttgtcgttagggacgaaggccgatactcacgatgagattctggagggtctgaactttaacctaaccgaaataccggaggcccagattcactag

SEQ ID NO: 4646 - DNA, 69 bp, Artificial Sequence
  Description of Artificial Sequence: Synthetic coding sequence
atgccgagtagcgtctcttgggggatccttctgttggcaggtctgtgctgcctagtcccagtgtcttag

SEQ ID NO: 4647 - DNA, 435 bp, Artificial Sequence
  Description of Artificial Sequence: Synthetic coding sequence
atgccatcatctgtctcctggggtattcttcttctcgctggcctgtgttgcttagtgcctgtgtccctggccgaggacccccaaggcgatgcagcccagaaaaccgacaccagccaccatgaccaggatcatcccactttcaacaagatcaccccaaatttggccgaattcgcgttttctttgtaccggcagcttgcccatcagtctaatagcaccaacatattcttttctcccgttagcatcgctactgcgttcgccatgttatctctgggtacaaaggcggacacccacgatgaaatcttggaaggactgaatttcaacctgactgaaattccagaggcccaaatccacgaagggttccaggagctgcttcgaacccttaaccagcccgatagccagctgcaattgaccacgggcaatggcttgttcctatag

SEQ ID NO: 4648 - DNA, 780 bp, Artificial Sequence
  Description of Artificial Sequence: Synthetic coding sequence
atgtattccaacgtgattggaacagttacatccggtaaaagaaaggtgtacctacttagtctcttgctgattggcttttgggattgtgtgacctgccacggtagtcctgtcgatatttgcaccgccaaacctcgtgacatacccatgaaccctatgtgtatttatcgatctccggagaagaaagcaacagaagacgaggggtctgagcagaagatacctgaggcaacaaatcggagggtgtgggagctgtcaaaagcgaattctagattcgcaaccacattttatcagcatcttgccgattccaagaacgataacgacaacatcttcctaagtccactcagtattagcaccgcctttgccatgactaagcttggcgcatgcaatgataccctccagcagttaatggaagtgttcaagtttgacactatctccgaaaagaccagcgaccagatccacttcttctttgccaagctgaattgcagactatatcgcaaagccaataagtctagcaagcttgtcagtgcaaaccgcctgtttggcgacaagtcactgactttcaacgacctgtatgtgtctgacgcttttcataaggcgtttcttgaagtgaatgaagagggctcggaagccgcagcttccactgcagtcgtgattgccggacggagcctcaatcccaatcgagtcacattcaaggctaataggccatttcttgtttttattcgagaggtcccccttaatactatcatcttcatgggacgggtggcaaacccctgcgtgaagtag

SEQ ID NO: 4649 - DNA, 1395 bp, Artificial Sequence
  Description of Artificial Sequence: Synthetic coding sequence
atgtatagcaacgtcatcggcaccgtcacttccgggaagcggaaagtctacctgctctccttgttgctgattgggttttgggattgtgtaacatgccacgggagtccggtcgatatttgcaccgctaagcctagggacatcccaatgaatcctatgtgcatctataggagtccggaaaaaaaggcgaccgaggatgagggatctgagcaaaagattccagaggccactaatagacgtgtatgggagcttagcaaagcaaattctaggtttgccaccactttctatcagcatctggcagattctaagaatgataacgacaacattttcttatctccattaagcattagcacggccttcgccatgactaaactcggagcttgtaacgacaccctgcagcaacttatggaggtgttcaagtttgacacaatttctgagaaaacatccgaccagatccacttcttctttgccaagctgaactgtaggttgtatcggaaggctaataagtcttccaaactcgttagcgccaatcggctatttggagacaagtctttaaccttcaatgagacttaccaggatatctcggagctggtatatggcgcaaagttacagcctctcgactttaaggaaaacgccgagcagagtagagcggcaattaacaagtgggtgtccaacaagacagagggcagaatcactgacgtaatcccaagtgaagcgattaacgaactcaccgtgctcgtcttagttaatacaatctatttcaaaggcctctggaagtcgaaatttagcccggaaaacaccagaaaggaactgttctataaagccgacggagaatcatgttccgcttctatgatgtaccaggagggaaaattccgatatcgcagggtggccgagggcactcaagttcttgagctgcccttcaagggcgacgacattacgatggtgctaattctgcccaaaccagaaaaatctcttgccaaggttgaaaaggagctaacacccgaagtgcttcaggaatggctcgacgaactggaggaaatgatgctggtcgtccatatgcccagattccgaatagaggatggtttctctctgaaagagcagctgcaagacatggggttagtggacctcttttcacctgagaaaagtaagcttcccggtattgtggccgagggtcgggatgacctttatgttagcgatgcctttcacaaggcatttttggaagtcaacgaggaaggcagtgaggccgcagcctccactgcagtggtcatcgctggacgttctttaaacccaaatcgtgtaacatttaaggctaataggcctttcttggtgttcattagagaggtcccgctgaatactattatttttatgggcagggtggcaaatccatgtgtgaagtag

SEQ ID NO: 4650 - DNA, 1476 bp, Artificial Sequence
  Description of Artificial Sequence: Synthetic coding sequence
atggcccttctgtggggcctgcttgtgttgagctggagctgtctgcaaggaccctgttctgtgttcagtcccgttagcgcgatggagccactaggtcgtcagttaacctccggtcccaatcaagaacaggtatcaccccttacacttctcaagcttgggaaccaggagcctggcggtcaaaccgccctgaagagtcccccaggagtatgttcgcgggatcccaccccagagcagacccacaggttagccagagccatgatggcttttacggcagatctgttttctctggtcgctcaaacaagtacctgtcccaatctgatactgtcaccgctgtctgtagctcttgccctatcccacctggcccttggggcacagaatcatacgctccagcgtttgcagcaggttctacatgccggttctggtccgtgtctgccacacctattatcaaggctgtgccaggatttgggccctggcgcattcagattagctgcccgaatgtatctacagaaagggtttccaatcaaggaagatttcctggagcaatctgaacagctgttcggtgcaaagccagtgagcctgactggaaaacaggaagatgatctggctaatataaatcagtgggtgaaggaggccacagagggaaagattcaggagttcctgtccggtctgccggaggacaccgtcctgcttctgctgaatgctatacactttcagggcttctggcgaaacaagtttgacccgtctctgacccagcgagattctttccatctggacgaacagttcacagtccccgtagagatgatgcaggctcggacttaccccctcagatggtttctactggaacagccagagatccaagtggcccacttcccctttaagaataacatgtcctttgtcgtcctggtccctacccacttcgagtggaacgtgtcccaggtgctagcaaatctgtcctgggataccctgcatccacccctggtttgggagcgcccaaccaaggtcaggctgcccaagttgtatttgaagcatcaaatggaccttgttgctacgttaagccagctgggcctgcaggagctgttccaagcacctgatcttaggggcatcagtgaacagagcttggtggtgagtggcgttcaacatcagtcgaccctcgaactttcagaagtaggcgtcgaagctgcagcggctaccagcattgctatgagcagaatgtctctgagctctttcagcgtcaaccgcccatttcttttcttcatctttgaagatacgaccggactacccctattcgtagggagcgtcaggaaccctaatccgagtgctccaagggaactgaaagagcagcaggacagtccagggaacaaagatttcctgcaaagccttaaaggattccctcgaggggacaaactttttggacctgacctcaagcttgtgccccctatggaggaagactatccccagttcggatctccaaagtag

SEQ ID NO: 4651 - DNA, 1476 bp, Artificial Sequence
  Description of Artificial Sequence: Synthetic coding sequence
atggcactcctgtggggcctgctggtgctctcttggagctgcctgcaaggaccgtgcagcgtgtttagccccgtgtcagctatggaaccactaggcagacagttgaccagcggacccaatcaggagcaggtttcgcctctgaccctgcttaagctgggcaatcaggaacctggaggccagaccgcccttaagtcccctcctggggtttgctccagagaccccacccctgaacaaactcatcgcctggcgagagcaatgatggccttcaccgcagacctcttttcgctcgtcgcgcagacctctacctgtccaaacctaattctatccccattgagtgtcgctttagccctcagtcacttagctctcggtgcccagaaccacacattgcagaggctgcaacaggtcttgcacgcaggctcgggtccctgcctgccccacctcctcagccgcctttgccaggacctgggacccggagcatttcgtctggcggctcgcatgtatctgcagaaagggttccctatcaaggaggatttcctggaacaaagcgagcagctgtttggcgctaaaccagtaagcctgacgggaaaacaagaagatgacctggccaacatcaaccagtgggtgaaggaggctacggagggtaagatacaggaattcctgagcggattgcccgaggacacagtgttactgctgttgaacgcaatccacttccagggattttggcggaacaagtttgatccaagcctgacacaaagggatagtttccatctggatgagcaatttaccgttcctgtggagatgatgcaggccaggacttatccgctgcgttggttcctgctcgaacagcctgagatacaagtcgcgcacttccctttcaaaaacaacatgtctttcgtcgtcctggtgcctacacatttcgagtggaacgtgagccaggtgctcgcaaacctatcctgggacactctccaccctcctctggtctgggagcggcctacaaaggtgcgtctacctaaactctatctgaaacatcagatggatttggtggccacactgtctcagttgggcctccaggagctcttccaggccccagatcttcgcggaataagtgagcaatcactggttgtgtctggcgtgcaacaccaatcaacattggaactatcagaagtgggggtcgaggctgccgcagcaacttcaatcgcaatgagtcggatgtcactgagcagtttcagcgttaatagaccattcttgttctttatattcgaagatactactgggcttcccttgttcgtgggctccgtgagaaatcctaaccctagcgctcctcgagagctgaaggagcagcaagactctcctgggaacaaagattttttgcagtcgctcaaaggatttccaagaggagacaagctgttcggtcctgacctaaaacttgtgcctccgatggaagaggactaccctcagttcgggtctcccaagtag

SEQ ID NO: 4652 - DNA, 1284 bp, Artificial Sequence
  Description of Artificial Sequence: Synthetic coding sequence
atggcactgctgtggggtcttttggttctctcctggagttgcttgcagggcccttgcagtgttttcagccccgtgtccgcaatggagccgttggggaggcaacttacaagcggccctaatcaagagcaggtttcccctctgacactgctgaaactgggtaaccaggtgcaaccgggagcacagaaccacaccttgcagcggctacagcaagtcctgcatgccggatctgggccatgccttccacacctgctttctagactgtgtcaggatcttggcccaggagcctttcggcttgccgcaaggatgtatctgcaaaaagggtttcccatcaaagaagacttcctcgagcaatcagagcagctgtttggagcgaaacctgtgagccttacaggcaaacaggaggatgacctagcaaacattaaccaatgggtgaaggaggccactgaaggcaagatacaggagttcctgtctggtctccctgaagacactgtgttattactgttgaacgccatacactttcagggattctggcggaacaaattcgacccctcattgacacagcgcgacagctttcatttggacgaacaattcacggtcccagtcgagatgatgcaagctaggacttaccctctgcggtggttcctgctagagcagcccgaaatccaagtagctcacttcccattcaagaacaatatgagctttgtggtactcgtgcctactcatttcgagtggaacgtgtcacaagtcttggccaacctctcttgggacactctgcatcccccactggtttgggagcggccaaccaaggtaaggttgcccaagctgtacttaaagcaccagatggaccttgtagccaccctgagccagcttggattgcaagagctctttcaagcacctgacctgcgcggtatctccgagcaatccttggttgtgtctggtgtgcaacaccaaagtacactagagctgagcgaggtgggcgttgaagccgctgccgctacaagcatagccatgagccgtatgagcctgtcttccttctcagtaaatcggccttttctgttctttattttcgaagacaccacaggcctgcccttgtttgtaggcagtgtgcgtaatcccaatccctccgctccacgcgaattaaaagaacagcaggactctccgggtaacaaagatttcttgcagtccctgaagggcttccccaggggcgataaactgtttggccctgatctgaaactggtgcctcccatggaagaggattacccccagttcggttccccaaaatag

SEQ ID NO: 4653 - DNA, 768 bp, Artificial Sequence
  Description of Artificial Sequence: Synthetic coding sequence
atggctctcttatgggggctcctcgtgctgtcttggtcatgtctgcaagggccttgctccgtcttctccccagtctcagcgatggagcctctcggcagacagttaacctctgggccaaatcaggagcaggtgagccctcttaccctcctgaaactaggcaaccaggagcctggtggacagactgctctgaagtcaccccctggggtctgttccagagacccaacccctgaacagacccaccgccttgccagggccatgatggcatttactgccgatttgttttcactggtggctcagacgagcacttgtcctaatctgattctgtccccgttgagcgtcgcactggccttatcacatctggctttaggcgcacagaaccatacgctgcagcgactccaacaagtgctgcacgccggttctggcccatgccttcctcacctcctatcaaggctgtgtcaggatctcggccctggcgcttttcgactggccgctagaatgtatctccagaaggggttcccaattaaggaagattttttggaacagtcagaacagctgttcggggcaaagccagtgagtctgactgggaagcaggaagacgacctggccaatatcaaccagtgggttaaagaggccaccgaaggtaagattcaggagttcctctctggtctgcccgaggacactgttttgttgctactcaatgcaatacattttcaggggttttggcggaacaagtttgacccatccctgacacagagggactccttttag

SEQ ID NO: 4654 - DNA, 1503 bp, Artificial Sequence
  Description of Artificial Sequence: Synthetic coding sequence
atggctagtaggctcacgctgctcaccctcctgctgttgctgttggccggagaccgtgcctcctccaatccaaatgccacctctagcagctcccaggatcccgagagcctgcaagatagaggcgagggaaaagttgccacaaccgtaatttccaagatgctcttcgtggagccaattctcgaagtctcttccctgccaacaacaaacagcactacaaactccgccacaaagataacagcaaatactacagatgaacctaccacacaaccaacgaccgagcccacaactcagccaacaatacagccaacccagcctaccacccagctccccacagattctcctacccagccaaccactggctcattctgccccggtccggtcacactgtgttctgatttggaaagccacagcactgaggctgtcttgggagatgcactggtggacttttctttgaaactgtaccatgcttttagcgctatgaaaaaggtagaaacgaatatggccttttctcccttttctatcgcgtcccttctgactcaggtccttcttggtgcaggagagaacacaaaaaccaacttagaaagtatcttgtcttatcctaaagactttacttgtgtgcatcaggctttaaaaggcttcaccacgaaaggtgtcacaagtgtgtcccagattttccattcccctgatctggctattagggacaccttcgtgaacgcctctcgcaccctgtattccagctcccccagggtcctttccaataactccgatgcgaacctggaactgatcaacacctgggtcgccaaaaacactaacaataagatcagtcgtctcctggacagcttaccctcagacacacgcctggtgttgctgaacgctatttaccttagtgcgaagtggaaaacaacttttgacccaaaaaagaccaggatggagccgtttcatttcaaaaacagtgttataaaagtccccatgatgaactctaagaaataccccgtggcgcatttcattgaccagacgctaaaggcaaaagtcggacaattgcaactgtcgcacaatttgtccctggtaatattggtccctcagaacctaaagcaccggctcgaggacatggaacaggccctgtccccttcagtttttaaagcaatcatggaaaagctggagatgtccaaattccagcccacgctgttgaccctgcctcggatcaaagtcacaacctcccaagatatgctgagcatcatggaaaagctcgagttcttcgatttctcttacgacctgaatttatgtgggctgactgaagatcctgatctgcaggtctcagcaatgcaacaccagacggtcttagaactgactgagacaggcgtggaagccgctgccgcttctgcaatctctgtggccaggacgcttctggtgttcgaggtgcagcagccattcctttttgtgctgtgggatcagcagcataaattccccgtctttatggggagggtttacgacccacgcgcatag

SEQ ID NO: 4655 - DNA, 1518 bp, Artificial Sequence
  Description of Artificial Sequence: Synthetic coding sequence
atggcctcgcggctgacccttctcactctgttgctgctgttgctcgcgggatttctggagccacaagacagggcaagctcaaatcccaacgcgacatcctcaagctcccaggacccagagtcactccaggatagaggcgaggggaaagtggcaaccactgtgatatcaaagatgttgttcgtggaacctatactcgaggtctcaagcctgcctaccacaaactccactaccaactctgccacaaagatcacggctaatactaccgatgagcccacgacacagcccacaaccgagcccacaacacagccaactatccagcccacccaacctaccacccagctcccaaccgattctcccacccagcccacaacgggaagcttttgtccaggccctgttaccctgtgctcagatctggagtcccattctacggaggccgttctgggcgacgccctggttgatttttcattgaagctctaccacgctttcagcgctatgaaaaaggttgaaacaaatatggctttttcacctttctcaatcgctagcctccttacgcaggttcttttgggagcaggcgaaaacaccaaaacaaacctggaatctattctgtcatatccaaaagattttacatgcgttcatcaggccctgaaggggttcaccacaaagggcgtgacaagtgtaagccaaatcttccactcacccgacctggccatacgcgatacattcgttaatgcttcgcgtacactttatagttcctcaccccgagttttgtccaataactcggacgccaacctggaattaattaacacgtgggtcgccaagaatactaacaacaagatcagccgactcctggacagtctcccgagcgacactagactggtgctgttaaatgctatctatctttcagccaagtggaagactacctttgatccgaaaaagactagaatggagccattccacttcaaaaacagcgtgatcaaggtgcctatgatgaactccaagaagtacccagtggcgcatttcatcgatcaaactctcaaagccaaagtaggtcaactgcagttgtcacataatttgtctctggtgatccttgtgccccaaaacctgaaacaccgcctggaagatatggagcaggcactcagtcctagtgttttcaaggctatcatggaaaaattggagatgagcaagttccagcctacactgttaaccctgcccagaatcaaggttaccacatctcaggatatgttgtccattatggagaagctggagttttttgactttagttacgatctcaatctgtgtgggctcacagaggatcctgacctgcaggtcagcgcaatgcaacatcagaccgtccttgaactaactgagaccggagttgaggctgccgcagccagtgctatcagcgtggcacggaccctcctagtcttcgaagtgcaacagcctttccttttcgtgttatgggatcaacaacacaaatttcccgtgttcatggggagagtgtatgacccacgggcttag

SEQ ID NO: 4656 - DNA, 1347 bp, Artificial Sequence
  Description of Artificial Sequence: Synthetic coding sequence
atgctgttcgtggagcctatcttggaggtgtcttcgttaccgacaaccaattctaccactaacagtgcaacgaaaatcactgctaacacgacagacgaacccacgacccaacccaccactgaacccacaactcagcccacaatccaaccgacccagccaacgacacagttgccgacagacagtcccacacagccaaccaccggatctttttgccctggccctgtcacgttatgcagtgatcttgagtcccactcaacagaggctgttcttggagacgccctggtagatttctccttgaaattgtaccacgctttctccgcaatgaaaaaagttgagacgaacatggccttctccccattcagcatagctagcctcttgacccaggtattgctgggcgcaggagagaacactaagactaatctggaaagtatcttgtcttaccccaaggattttacttgtgtgcatcaagctctaaaaggtttcaccaccaagggcgttactagcgtgtctcaaatattccactccccagatctggcaataagggatacatttgtcaatgcttccagaacactatactctagcagtcccagggttctgtcaaataactctgatgccaatctggagctgataaatacatgggtcgccaaaaataccaacaacaaaatcagccggctgctggattctttgccttctgacactagactcgtgctgctgaacgctatctaccttagcgccaagtggaagacaacctttgatcctaagaaaacccgcatggaacccttccacttcaagaactctgtcataaaggtgccaatgatgaattccaaaaaatacccggtcgcccacttcattgatcagactctgaaggcaaaagtcggacaactgcagttaagccacaatctttcactggtcatccttgttccacagaatctcaagcaccgactggaggatatggaacaggccttgtcgccatccgtctttaaggcaatcatggaaaagttagaaatgtctaagtttcagcctacactcctcaccctcccacggattaaagtgaccaccagtcaggatatgctgtcaatcatggagaaactcgagttctttgacttttcctacgaccttaacctgtgtgggttgacagaagaccccgacctccaggtgagtgcaatgcagcatcagactgtattagaattgaccgagacaggagttgaggctgccgcagcatcagccatttctgtcgccaggacacttcttgtgtttgaagtgcagcaaccctttctgttcgtcttatgggatcagcagcataagttccctgtattcatgggcagggtctacgatccaagggcttag

SEQ ID NO: 4657 - DNA, 483 bp, Artificial Sequence
  Description of Artificial Sequence: Synthetic coding sequence
atggcctcccgcctcaccctgctgactttgctgttgctgctgctagcaggggatcgagcatcttctaatccaaatgcgacctctagctcatcacaggatcctgaatctttgcaggacaggggagaaggaaaagtagccaccaccgtgattagtaaaatgttgttcgtggaacccattctggaagtgtccagcctccccacaactaacagtaccacgaattccgccactaaaatcacagctaatacaactgacgaacctactacacaaccgactaccgagcccacgactcagcctaccatccagccaacccagcccacaacgcagctgcctacagacagccccacgcagccaacgaccggcagcttttgcccaggccctgtcacattatgctctgacctggaatcgcattccaccgaggccgtgttgggcgatgccctggttgacttcagcctgaagctgtaccacgctttttccgcaatgtag

SEQ ID NO: 4658 - DNA, 402 bp, Artificial Sequence
  Description of Artificial Sequence: Synthetic coding sequence
atggccagccggctcaccttgctgactctcctgctcctccttttagcaggagacagggcctctagcaacccaaacgccacctctagttcatcacaagatcctgaatcccttcaggatagaggagaaggaaaggtggcaaccaccgtaattagcaagatgctctttgtcgagccaatcctcgaggtgtccagcctgcctaccactaattccaccactaacagcgccacaaagataacggccaataccaccgacgaaccaaccacacagcctacgaccgagcctacaactcagccaaccatccagcctacccaacctaccacacaactgcccactgatagtcccactcaaccaggctacgcactcaatcatggtgagattggaatcttaaggttctttctctag

SEQ ID NO: 4659 - DNA, 3405 bp, Artificial Sequence
  Description of Artificial Sequence: Synthetic coding sequence
atgcccgtttttcacaccagaacaatcgagtctatactggaaccagtagctcagcagattagccatctcgtgatcatgcacgaagaaggcgaagtggacggcaaggccatccctgacctgaccgcaccggttgctgcagtgcaggccgctgtgagcaacctcgtgcgagtcggcaaggagaccgtgcaaacaacagaagaccaaattcttaaacgcgacatgcccccagccttcattaaggtggagaacgcatgcactaaactggttcaagctgctcaaatgctgcaatctgatccatacagcgtgcccgcacgggactacctcattgacgggtctagaggcatattgagcgggacgtccgatctgctcttaacattcgacgaagcagaggtgagaaagataataagagtttgcaagggaatcctggagtaccttacggttgccgaggtggtggaaaccatggaagacctagtcacatacacaaaaaatttagggcctggaatgacaaaaatggccaaaatgatcgacgagagacagcaggaattgacacaccaggagcatcgagtaatgttggtgaactcgatgaacactgttaaggaattgctccccgtgctgatttctgccatgaagatctttgtgaccaccaaaaactccaagaatcaaggtatcgaagaggctctcaagaatcggaatttcacagttgagaagatgagtgcggaaatcaacgaaatcatccgtgtcctgcagttaactagttgggatgaggacgcatgggcaagtaaggacactgaagcaatgaaaagagcgttggcttcaattgatagtaaacttaaccaggcaaaaggctggcttagggatccgagtgcatctccaggcgacgcaggcgaacaggctatcaggcaaatactggacgaagctggcaaggtcggggagctctgtgcagggaaggagcgcagagaaattcttggcacttgtaaaatgctgggtcaaatgaccgatcaggtggctgacttacgcgcaagaggacagggcagctcccccgttgccatgcagaaggctcagcaagtgagccaagggctggatgttttaaccgccaaggtagagaacgccgctaggaagctagaagctatgacgaacagcaagcagagcatcgctaaaaaaatcgatgccgctcagaattggcttgcggacccgaacggaggaccagagggagaagaacagatcagaggagctctggccgaggcacgaaagattgctgaactgtgcgacgaccccaaagagcgggacgatatattgcggtcactaggggaaatttcagctcttacttctaaattagcggacctgcgcaggcaaggaaaaggggattcaccagaagctagagccctagctaaacaggttgccactgcactacagaacctccagaccaagaccaacagggccgtagctaactccagacccgcaaaggccgctgtgcacttggaaggcaaaatcgagcaggcccaacggtggatagacaatccgaccgtggacgaccgcggagtgggccaggccgcaatacggggactggtggcagaaggccacaggctagcaaacgtgatgatgggtccctatcgacaagatctcctggcaaagtgcgaccgcgttgatcagcttaccgcacaacttgctgatttggccgctaggggggagggtgaaagcccacaagctagagcgttagcctcccagttgcaagattccctcaaagatcttaaagccagaatgcaggaggccatgactcaggaggtgtccgatgtgttctccgacaccaccacccctataaaactgctcgccgtagcggctacagcccctcctgacgcccctaaccgggaggaggtgttcgatgagcgggctgcaaacttcgaaaatcacagtggcaaactgggcgcaacggctgagaaagccgcagccgtcggcacagctaataagtctacggttgagggcatacaggcaagtgtcaagaccgccagagagctcactccacaggtagtttccgctgcacgcatcttactgaggaatccgggtaatcaggctgcctacgaacatttcgagaccatgaagaaccagtggatagataatgtagaaaaaatgactggcctggtcgatgaagcgatcgacaccaaaagtctgctagacgcttccgaggaggccatcaaaaaggatctggataagtgcaaggtcgctatggcaaatatacagccccagatgctggttgcaggggctacatctatcgccagaagagctaacagaatcctcctggttgccaaacgcgaggtcgagaactcagaggatccaaagttccgtgaagctgtcaaggccgcatctgacgagttgtccaagaccatcagcccaatggttatggacgccaaggccgttgccggaaatatctctgaccctggactccagaagagcttcctggactccggttacagaattctgggagccgtggcaaaggtacgtgaggcgttccagcctcaagagcccgacttcccccctccgccacctgatctcgaacagctgcgccttaccgacgaacttgcacctccgaaacccccattgcccgagggagaggttcccccacctcgaccacccccacccgaggaaaaagatgaagagttccctgagcagaaagctggggaagtaattaatcagcccatgatgatggctgcaagacagctgcatgatgaggctcgcaagtggagcagcaagcctgggattccagccgctgaggttggaattggagttgtagcagaggctgacgccgcagacgccgcaggatttccagtccctccggacatggaagatgactatgagccggagctgctgttgatgccctctaatcaaccggtgaatcaacctattctcgctgcggctcaatcactgcatcgggaggctaccaaatggtcttctaagggtaacgatatcattgccgcagctaagcggatggcactgctaatggccgaaatgagccgattggtgcgcggtggcagtggaaccaaacgcgcactcattcagtgtgccaaggacattgcaaaagccagtgatgaggtgacccgcttagccaaggaagtggcgaagcaatgcaccgataagagaattcgcactaatctactgcaagtctgcgaacgaatacctacaattagcacacagcttaaaattctgagcacagttaaagcaactatgctggggaggacaaacatctcagacgaagagtccgagcaggctaccgaaatgctagtgcataatgcccagaacctgatgcagtccgttaaagaaactgtgagagaagccgaagcagcgtctatcaaaattcggacagacgctggcttcacactgcgctgggtcagaaaaaccccatggtaccagtag

SEQ ID NO: 4660 - DNA, 1335 bp, Artificial Sequence
  Description of Artificial Sequence: Synthetic coding sequence
atgtgcctctgtagtggacgaaagacgattctcgagatctaccccggtcagttccaacccagcctctgtcataagttcatcgccctgagtgataaagaaggaaaactgcttcggaactatacacaaaacatcgatactctcgaacaggtggctgggattcaacggatcatccagtgccacgggagcttcgcgacagcttcatgtctgatttgcaaatacaaggtggactgtgaggctgttaggggggatatcttcaaccaggtggtgccccgttgtccaaggtgcccagccgacgagcccctcgcgatcatgaagcctgagatcgttttttttggggagaatttaccagaacagtttcaccgggctatgaagtacgacaaggatgaagttgacctgctgatagtaattgggtccagtctgaaagtgcgcccagtggccctgatccctagctcaattccgcatgaagtgccacaaattttaataaatagagaaccactcccacatctgcatttcgacgtggagctactgggggactgcgatgtgatcatcaacgagctgtgccacaggttgggcggtgaatatgctaagctttgttgtaaccctgtgaaactgtctgaaatcacagagaagcctcctcgaacgcaaaaggagctcgcatatctgtcggagctcccacctacacctctgcatgtttctgaggatagctcatctcccgagcgtaccagcccaccagatagtagtgtaatagtgacactcctagatcaggctgcaaaatccaacgacgacttggatgtgagcgaatctaagggctgcatggaagaaaaaccccaggaggtgcagacgtcccgcaacgtggaatccattgctgaacagatggagaatccggacctaaagaatgtgggatcctccactggagagaagaacgagagaacctcagtggctggcacggtgcgaaaatgctggcctaatcgggtggctaaagagcagattagccgacgactagatggtaatcaatatttgtttctgcccccaaataggtacatctttcatggtgccgaggtttacagcgactctgaggacgatgtgctgtcttcaagttcttgcggcagcaactccgatagtgggacatgtcagagccctagtttggaggagcctatggaagacgaaagcgaaattgaagagttttacaatggactcgaggacgaaccagatgtgccagagcgcgcagggggagcaggatttggcactgacggcgacgatcaagaggctattaatgaggcaatatcagttaagcaggaagtaaccgacatgaactacccgtcgaacaaaagttag

SEQ ID NO: 4661 - DNA, 1335 bp, Artificial Sequence
  Description of Artificial Sequence: Synthetic coding sequence
atgtgcctctgcagcggtcgaaagactattttagagatataccccggacagtttcagccatccttgtgtcacaaattcatcgctcttagcgacaaggagggaaaactgttgaggaactatacacaaaacattgatacacttgaacaagtggccggtattcagcgtatcatccagtgtcacgggagctttgctacagcctcctgcctgatctgcaagtataaagtggattgtgaagctgtgcgcggagacattttcaatcaggtggtaccacgatgtccgaggtgtccagctgacgaaccgcttgccattatgaaaccggagatcgtgttcttcggcgagaacttacccgaacagttccaccgagcgatgaaatacgataaggatgaggttgacctgctcattgtaataggcagctccttaaaagttcggccagtggccctaatccctagctctataccccacgaagtgcctcagattctgatcaacagagaacccctgccgcaccttcatttcgatgtcgagctcttaggggattgcgacgtcattatcaatgagctgtgtcatcgcctgggaggcgagtacgccaagctttgttgtaatccagttaaactgagcgaaattacagagaaaccaccaagaactcagaaagagctggcttaccttagtgagctcccacctaccccacttcacgtgtctgaggattcatcaagcccagaacgcactagtccccctgacagctctgtgatcgttacattgcttgatcaggccgcaaaatccaatgacgacttagatgtgtctgagtccaagggatgcatggaggaaaagccacaggaagtacagacctctcgaaatgtggaatctattgcagagcagatggagaacccagacctcaagaacgtaggcagttccactggagagaaaaatgaacgaacgagcgtggcagggacagtgcgcaaatgctggcctaatcgcgtggccaaagagcaaatcagcaggcggctcgacggcaatcaatacctgttcctgcctcccaaccggtacatttttcacggagcggaggtatactctgactcagaggatgatgttctctcatccagcagctgtgggtcaaattctgacagcggtacctgccagtccccctccctagaagagccaatggaagatgagagtgaaatcgaagaattctacaatgggctcgaagatgagcccgacgtccccgagcgggcaggaggagcgggattcgggacggatggagacgatcaggaagcaatcaacgaggctatcagtgtcaaacaggaggtcaccgacatgaactacccttcaaataagagttag

SEQ ID NO: 4662 - DNA, 1359 bp, Artificial Sequence
  Description of Artificial Sequence: Synthetic coding sequence
atgttcgacatagaatattttcggaaggatcctaggcctttcttcaagtttgccaaagaaatctaccctggtcagtttcagccttctctgtgtcacaaatttattgccctctctgacaaagagggtaaactgctccgcaattatactcagaatattgacaccctggagcaggtcgctggcatccagcgcattatccagtgtcatggcagcttcgctacagcttcttgcctgatctgtaagtacaaggttgattgcgaggccgtcagaggcgatatcttcaatcaagtcgtacctcgatgtcctaggtgccctgctgacgagcctctggcaatcatgaagcctgaaatcgtttttttcggagaaaatctcccagaacagtttcacagagccatgaaatacgacaaagatgaggtggacttactgatcgtgattggctcaagccttaaagtacggccagtggctctgatacctagcagtatccctcacgaggtgcctcaaatcttgatcaaccgagaaccgctcccccaccttcacttcgacgtagaactcctgggggactgtgatgtcatcattaacgagctgtgtcaccggcttggtggtgagtatgccaaattgtgttgtaaccctgttaagctgtcagagataacagagaagccccctaggactcagaaggagctggcctatctgtcggagctgcctccaacccccctacacgtctctgaggatagttctagtcccgagcggacgtctcccccagatagctcagtgatcgtgacgctcctagaccaggcagctaagtctaatgatgatctggatgtgagtgaatctaagggctgcatggaggaaaagccccaggaggtgcagaccagtcggaatgtggaaagtattgccgagcagatggaaaatcccgatctcaagaacgtcggcagctcgacaggagagaagaacgagagaactagcgtggcaggaacagtacgcaagtgctggcccaatagagttgccaaggaacagatttcccggcgattggacggcaatcagtacttgtttctgcccccaaatagatatattttccacggagcggaagtgtattctgacagcgaggatgacgtactctccagtagtagctgcgggtcaaactcggatagtgggacatgccagtctccaagtctggaagaacccatggaagatgaaagtgaaattgaagaattctacaacggcctcgaagatgagccagatgttccagagcgggctggaggagcaggttttggaacagacggcgacgatcaggaggccataaacgaggccattagcgtcaagcaagaggtaactgatatgaattacccaagcaataagagctag

SEQ ID NO: 4663 - DNA, 987 bp, Artificial Sequence
  Description of Artificial Sequence: Synthetic coding sequence
atgagcgtgaactacgccgcaggcctttcaccttacgcggacaaagggaaatgtgggttgcccgagatatttgatccccctgaagagttggaacgcaaagtttgggaattggccagacttgtctggcagagcagctccgtcgtcttccatactggtgcaggcatttcgaccgcctcagggattcccgacttccgcggaccacacggtgtgtggacaatggaagaacgcggactggccccaaagtttgatacaacttttgaatcagctcggcctacgcagacccatatggctctcgtccaattggagcgtgtcggcttgttacgctttctagtgtctcaaaacgtggacggcctgcacgtccgcagtggattccctagagacaagctggctgagctgcatggcaatatgtttgtggaggagtgcgctaagtgtaagacacaatatgtccgtgacaccgtggttgggacaatgggtttgaaggcaactgggcgactgtgtactgtggctaaggcaagaggccttcgagcctgtagaaacgcggacctgagcatcacactcggtacctcactgcagattcgaccttcaggaaatttgcctctggcaactaaaagacgaggagggagactagtgatcgttaatcttcagcccaccaagcatgaccgacatgccgacctgcgcatccacggctacgtggacgaagtcatgacaagactgatgaagcacctcggtcttgagattccggcttgggatgggccacgagtattggagcgcgcacttccaccactgcctcgaccacccacacccaagctggaacccaaagaggagtctccaacgcgcatcaacgggtccattccagctggaccaaagcaggagccctgcgcacagcataacggaagtgaacccgcttctcccaagcgagaacgtccgactagccccgctccccacaggcctccgaaaagggtcaaggccaaggccgtgccctcttag

SEQ ID NO: 4664 - DNA, 1068 bp, Artificial Sequence
  Description of Artificial Sequence: Synthetic coding sequence
atgtccgttaattacgccgcaggcttgagcccctacgcagataagggaaagtgtggcctccctgaaatcttcgacccccctgaagaattggagcggaaggtgtgggaactggcgaggctggtctggcaatcaagtagcgtcgtcttccataccggtgcaggaatcagtaccgcaagcggcatccccgattttcgcggaccccacggggtatggaccatggaggagagggggctggctcctaagttcgacaccaccttcgagagcgcccgacccacacaaacacatatggctctggtgcagctcgaaagagtggggttgttgcgattcctcgtatcccagaatgtagatggcctccatgtgaggagcggcttccctcgcgacaagctggctgaactacatgggaacatgtttgttgaagaatgtgctaagtgtaagactcaatatgtgagggacactgtcgttggaaccatgggattgaaagcaacaggtcgattgtgcaccgtggccaaggcacggggactacgtgcgtgtcgcggtgaacttcgcgatactattttggactgggaagacagcctccccgatcgtgatcttgctcttgctgatgaagccagtagaaatgcagacctttccattaccttagggactagcttacagattcggccttctggtaacctgcctcttgccactaagcggaggggcggaagactcgtgattgtcaatttacagcccacgaaacatgatcgacacgctgaccttcggatccacggctacgttgatgaggtgatgacacgcctgatgaagcatctgggactcgagatccctgcttgggacggccctagggttctggaacgagccctgcctccactgccaagacctcctacaccaaagctggaacccaaagaggagtctcccaccagaattaatggatcgatccccgctggtcctaagcaggaaccatgtgcccagcataacggcagcgagcccgctagtcctaaacgagagaggccaacgtcccccgctccccaccggccacctaaacgagtgaaggctaaagccgtcccaagttag

SEQ ID NO: 4665 - DNA, 852 bp, Artificial Sequence
  Description of Artificial Sequence: Synthetic coding sequence
atggaagaaagagggctggcccctaaatttgacactacgtttgagtctgcgaggcctacacaaacccacatggcactcgtacaattagaaagggtgggcttactgcggttcctggtctcccagaacgtggatgggctccacgtgaggtccggctttccacgcgataaacttgctgagctgcatggcaatatgtttgtcgaggaatgcgccaagtgtaagacacagtacgtaagagataccgtcgtgggaaccatgggcctcaaagccaccggaagactctgcaccgtcgccaaagcccgtggattgagggcatgtcggggtgagctcagggataccatcctggactgggaagacagcctccctgacagggatctagccctggctgacgaggcaagcagaaatgcggacttgagcatcacgctcggaacctccctccaaatcagaccctcgggcaacctgcccctggcgactaaacgcagaggcggaagattggtaattgtgaatcttcagcccacaaagcacgataggcacgcagatcttagaattcacgggtacgtggacgaggtcatgacaagacttatgaagcatctcggcctcgagatcccggcatgggacgggcctagggtactggagcgggctttgcctcctctgcccaggccgccaacccctaagttagaacctaaagaagaatcacctacaagaattaacggaagcattccagctggcccaaagcaggagccatgtgcccagcacaacgggtctgagcccgcaagccctaaaagggagagacctactagccccgctcctcacaggccacccaagcgcgtcaaggccaaggccgtgccctcttag

SEQ ID NO: 4666 - DNA, 1575 bp, Artificial Sequence
  Description of Artificial Sequence: Synthetic coding sequence
atgactgaagataaggtgaccggaacgctggtattcaccgtgatcacagccgttctcggtagttttcagttcggatacgacatcggtgtaatcaacgctccgcagcaggttattatttcccactacagacacgtgttgggggtgccattggatgaccgcaaggctattaacaactacgtgattaacagtactgacgagcttcccactataagttatagcatgaatccaaaaccaaccccttgggcagaggaggagacagtggccgcagcacaactcatcaccatgctatggagcctgagcgtcagctcatttgcagttggtggaatgactgcctcatttttcggcggatggttaggtgatacactgggtcgtataaaggctatgttagtagccaatattttgtctctcgttggggcactgctgatgggtttcagcaaactaggaccatcccacatcctgattattgcagggaggagtatctctggcctgtattgtggcctgatttccggactggtgcccatgtatataggtgagatagccccaacagctctcagaggggctttggggacattccaccagttagcaattgtgactggcattttgattagccaaattattggcctggagttcattttaggcaattatgacttgtggcacattctcctgggattatctggtgtgagagccatcctccaatcgcttctcctgttcttctgcccggaatcgccaagatacttgtatatcaaactggacgaggaagtgaaagcaaagcagagtttgaaaagactgagaggctacgatgatgtaactaaagacatcaatgaaatgagaaaagagcgagaagaggcctctagcgaacagaaagtaagcattatccagctgtttaccaatagctcctacaggcaacctatccttgtggctcttatgctacacgtcgcccaacagttttcaggcataaatggaatcttctactacagcaccagcattttccagaccgctgggattagcaaacctgtttacgccacgattggcgtcggtgcagtcaacatggtttttaccgccgtctccgtctttcttgtggagaaggccggacgacgctccctgtttctgatagggatgtctggaatgtttgtgtgtgccatctttatgagtgtcggccttgtgctgttgaataagttcagttggatgagctatgtgtctatgatcgccatcttcctgttcgtgagtttttttgaaattggacctggtccaatcccttggttcatggtcgctgagttcttcagtcagggccctaggccggctgccctggcgattgcggcattttccaactggacttgtaatttcatagttgccctgtgctttcaatacattgctgacttctgcggcccttacgtgttcttcctttttgccggagtactgctggccttcaccctatttacattctttaaagtgcctgagaccaagggcaaaagcttcgaagaaatcgccgctgagtttcaaaaaaaatctggcagtgcccacaggcccaaggctgctgtggagatgaagttcctgggggcaacagagacagtgtag

SEQ ID NO: 4667 - DNA, 1218 bp, Artificial Sequence
  Description of Artificial Sequence: Synthetic coding sequence
atgcatctgaaccgcattaaagcgatgctggtggcaaacattttgtcgctggtgggcgcactgctgatgggattctccaaactcgggccatctcatatcttgatcatcgccggacgtagtatttccggattgtactgtggacttatcagcggtctggtccccatgtatatcggcgagatcgccccaacggccctccgaggcgctcttgggacgtttcatcagctggcaatcgtaactggaatcctgatctcacagattatcggcctagagtttatattgggaaactatgatctgtggcatatcctgctcggtcttagcggagtgcgtgccatcctccagtccctcttgttgtttttttgccccgagtcgcctcggtacctctatattaagttagacgaggaagtgaaagctaaacagagcctgaagagactccggggatacgacgatgttaccaaggacattaatgagatgcgcaaggaacgcgaggaagcatccagcgaacagaaggtgagcatcatccagctattcaccaactcgtcgtacagacagcctattctggttgcactcatgctccacgtagcccagcagtttagtggtattaatgggatattctattactccacgagcatcttccagactgctggcatatctaaacccgtgtatgcaaccataggcgtgggagctgttaacatggtgttcacggccgtttctgtattcctggtagagaaggccggtcgacgatcattattcctcattgggatgtcagggatgttcgtatgcgctatcttcatgtctgtgggtcttgtattgctgaataaattcagctggatgtcctatgtaagtatgatagctatttttctatttgtcagcttttttgagattggtccaggaccaattccatggttcatggtcgctgaatttttttcccaggggccacgccctgcagccctcgcaattgccgctttcagcaattggacttgcaacttcatcgtggcactctgtttccaatatatcgccgatttttgcggtccctacgtgttcttcctattcgctggagtcttattggcctttactctgttcacatttttcaaggtgcctgaaacaaaggggaagtcgtttgaagaaatcgctgcagagtttcagaagaaaagcgggtcagcacaccgacctaaggccgcagttgagatgaagtttctgggcgctacagagacagtttag

SEQ ID NO: 4668 - DNA, 1290 bp, Artificial Sequence
  Description of Artificial Sequence: Synthetic coding sequence
atggcggcacaaggctatggatattaccggactgttatttttagtgccatgttcggagggtactctttatattatttcaacaggaagacattcagttttgtcatgccttctttggtggaggagattccgctggataaagacgacctcggatttatcacatcatctcagagcgctgcctatgccatctcgaaattcgtctccggggtgttaagtgatcaaatgagtgcaagatggctgttctctagtggacttctgctcgttgggctggtgaacatcttttttgcgtggagttcaacagtgccagtgtttgcagcactgtggttcctaaatgggctggctcaaggcctgggatggcctccctgcggaaaggtactgagaaaatggttcgaacccagccaatttgggacatggtgggcgatcctctctacttctatgaacctggcaggcggtttaggcccaattcttgctactattctggcacagtcttactcatggcggtcgacattggcactcagtggcgctctgtgcgtggttgtgtcattcctctgcctcctcttgatacacaatgagccagccgatgttggcttaaggaatctggaccctatgccatctgaggggaagaaaggcagcttgaaggaagagagtacattacaggaattacttctctctccttacctgtgggtactctcaacaggctatctcgtggtgttcggagtcaagacttgttgtactgattggggccaattcttcctcatccaggaaaaggggcagagcgcgttggtggggagcagctacatgtcggccctcgaagtcgggggtctggtcggatccattgctgctggctacctgtctgaccgggctatggccaaggccggactttcgaattatgggaacccacgccacggcttactgctgttcatgatggctggtatgacggtttctatgtacctattccgcgttaccgttaccagcgactcgccgaaactgtggattctggtgctgggagccgtgtttggattttccagttacggtcccatcgctctgtttggggtgatcgccaatgagagcgcccctcccaacctgtgcgggacatctcatgctattgtgggtttgatggccaatgtagggggatttttggctggattgccgttcagtaccattgccaaacactactcatggagtacagccttctgggtcgctgaggtcatatgcgcagcttcaaccgctgctttcttcctccttaggaacatcaggacaaagatgggccgagtgtcaaaaaaggcagaatag

SEQ ID NO: 4669 - DNA, 1356 bp, Artificial Sequence
  Description of Artificial Sequence: Synthetic coding sequence
atggcggctcaaggatacggctattaccgcacagtcatcttctctgccatgttcgggggatactcgctttactattttaaccgcaagactttttcgtttgtcatgccgtcactcgtcgaagagattccactggataaagatgaccttggatttatcacttcaagtcagtccgccgcttacgccataagcaagttcgtgtctggcgtgctgagtgatcaaatgagcgccaggtggctttttagcagtggacttttgttagttggcctggtcaacatttttttcgcatggtcatcgactgtacccgtgttcgcagctctgtggttcctgaacggactggcacagggactggggtggcccccatgtggcaaagtgctgcggaaatggttcgaaccttctcagttcggaacatggtgggccatcctttccacttcaatgaatctcgctggcggtcttggcccaattctagccacaattctagcccaatcctactcatggcggagcacactcgccctgtcgggcgctctgtgcgtcgttgtgtcctttctatgcctgctcttaatccacaacgagcctgccgacgtgggactgagaaacctcgatccaatgcctagcgagggcaaaaaggggtcgctgaaggaggaatccaccctgcaggaacttttgttatcaccatacttgtgggtgctcagcaccggctacttagttgttttcggtgtcaaaacatgttgtaccgattggggccaattcttcctcatccaggagaagggtcagagtgccctggtaggatcatcctatatgagtgctttggaagtggggggactcgtcggctcaatcgccgcagggtacctcagcgaccgggcaatggccaaagccggtctgagcaactatggtaatcctcgccatggccttcttttgtttatgatggctggtatgactgtttccatgtacttgttcagggtgaccgtcacatcagactctccaaaggacgttgccttctggactcttgcccttcatcccttggcagagctgaccggctttaccgagcatgagctttggatcctcgtcttgggggcagtgttcggtttctcttcctacggacctattgctctgtttggagtaattgccaatgagagtgctcccccaaatttgtgcggaacaagccacgctattgtcggcctcatggccaatgtgggcggatttttggctggcctacctttttccacaatcgccaaacattattcatggtccactgccttttgggtcgctgaagtaatctgcgccgcttccaccgcggcattcttcctgctgcgcaacatccggacgaaaatgggtagagtctcaaaaaaagccgagtag

SEQ ID NO: 4670 - DNA, 1716 bp, Artificial Sequence
  Description of Artificial Sequence: Synthetic coding sequence
atgaccagagccggagaccacaataggcagcggggttgttgtggatccctcgcggattacctgacaagcgcgaaattcttgctgtacctcgggcactctttaagcacttggggcgaccgaatgtggcacttcgctgtgagcgtttttcttgtggagctgtatggcaattcactgctgctgaccgcagtatacggtctggttgtcgctggcagtgtccttgtgctcggcgctatcattggagattgggtggacaagaacgcgcgactcaaggtggcacagacctccttagtggttcagaatgtgagcgtcattctgtgtgggattatcttgatgatggtgtttctacacaaacacgagttactgaccatgtatcacggttgggttctcacaagctgctacattctaattatcaccattgccaatatcgctaatctagcctctacagctactgctatcaccatccagagagactggatcgtagtggtagcaggtgaggaccggagcaaacttgccaatatgaatgctacaatcagacgtatagatcaactgaccaacatcctggctccaatggcagttggacagatcatgacattcggaagtccggtgatagggtgtgggtttatctccggatggaatttggtgtcaatgtgcgttgaatatgtgctgctatggaaagtgtatcagaagacgcccgcactggctgtgaaggcaggcctcaaggaagaagagaccgagctcaagcaactgaaccttcacaaagataccgagcccaagccattggagggcacccatctgatgggcgtgaaggactcgaatatccacgaactggagcatgaacaggagccaacatgcgcatcgcaaatggcagaaccttttcgcacattcagagacggatgggtatcgtactacaaccagccggtgttcttggccggaatgggactggccttcctctacatgaccgtgctgggttttgactgcatcaccacgggctacgcctacacacaaggattatccgggtccatcctttctatccttatgggcgcttctgcaatcacgggcatcatggggaccgtcgcattcacctggctgcgccgtaagtgtggactcgtgcgtacaggactgatatctgggctcgcacagctctcttgcctgatcctatgtgttatatcagtcttcatgcccggaagcccgctggaccttagcgtgtcaccctttgaagatatacgcagcagattcatccagggagagagcattacccccaccaagatccctgagatcacaacagaaatctatatgagcaatggttctaacagcgctaacattgttcctgagacctccccagaaagtgttccgataatatcggtgtccctgcttttcgccggtgtgatcgcggcacgaatcggtctgtggtcattcgatcttactgtgactcagctgttacaggagaacgtcatcgagtccgagcgcggaataattaacggagtgcaaaattcaatgaattaccttttagacctgctgcattttataatggttatcctcgcaccaaatcccgaagcctttggtctgctagttctgatatcagtcagtttcgtcgccatgggacacattatgtattttcgatttgcacagaatacacttggcaataagcttttcgcctgcggcccagacgctaaggaagttagaaaggagaaccaagcaaataccagcgtcgtttag

SEQ ID NO: 4671 - DNA, 603 bp, Artificial Sequence
  Description of Artificial Sequence: Synthetic coding sequence
atgacacgggcaggtgaccacaacagacagcggggttgctgtggctccctcgcagactatctgacatccgcaaagttcctcctatacctggggcacagcttgtcaacttggggagatcggatgtggcacttcgcggtgtccgtgttccttgtagagctttacgggaattctctgctgctgaccgcggtttatggcctcgtcgtggccggttccgtcctggtcctgggagcaattatcggggattgggttgataaaaacgccaggctgaaggttgcccagacttccctggtggtgcagaacgtgagtgtcatactgtgcggaatcatcctgatgatggtctttctacacaagcatgaattgcttaccatgtaccacggttgggtccttacctcctgctacattctaatcattactattgccaacattgcgaacctggcatccaccgccacagctattacaattcaacgggattggattgtcgtagtagccggagaggaccgctctaaactcgcaaatatgaacgccactattaggaggattgatcagcttaccaacattctcgccccaatggccgtcgggcagataatgacatttggtagttag

SEQ ID NO: 4672 - DNA, 78 bp, Artificial Sequence
  Description of Artificial Sequence: Synthetic coding sequence
atgacccgggctggagatcacaaccgccaaagagggtgttgcggaagtctggccgattaccttacaagcgctaaatag

SEQ ID NO: 4673 - DNA, 78 bp, Artificial Sequence
  Description of Artificial Sequence: Synthetic coding sequence
atgacacgcgcaggtgaccataacaggcagcgaggttgctgcgggtcactcgctgactatctaacatccgcaaaatag

SEQ ID NO: 4674 - DNA, 168 bp, Artificial Sequence
  Description of Artificial Sequence: Synthetic coding sequence
atgaccagagcgggagatcacaatcggcagcgtggatgctgtgggtctctggccgattaccttacctcagcaaagttcctgttgtacctgggccacagcttgagtacttggggcgacaggatgtggcacttcgccgtgagcgtgtttctagtcgagctgtatggctag

SEQ ID NO: 4675 - DNA, 300 bp, Artificial Sequence
  Description of Artificial Sequence: Synthetic coding sequence
atgagggcgagtattcataagaagctccgcaagagtagcggcatagttactatcttgtattccgccttcgttctcgtgagcactagtgatatggcggaagagaccgaggacgcttggccacgttgctatcttcagtttttggctctcctgctcacctcgacgtcagcaagagcagccgctgccattgccgctgcagaggagccggcaggttccccaagcgtgatgactcgagcgggagatcataacaggcagaggggctgttgcgggagccttgcagactatctgacaagtgctaaatag

SEQ ID NO: 4676 - DNA, 504 bp, Artificial Sequence
  Description of Artificial Sequence: Synthetic coding sequence
atgggcgtgaaggatagtaatatccacgagctggagcatgagcaagaacccacttgcgctagccagatggcggagccatttaggacatttcgcgatggctgggtctcttattacaatcagcctgtgttccttgccggtatgggactcgctttcctgtacatgacagtcctgggtttcgactgcattactactggctatgcctatacccagggcctgagtggctccattttgtccattctgatgggcgcatccgccattacaggcattatgggaactgtcgccttcacgtggcttcggaggaagtgtggtctggtcaggactggcctgatcagcggcctcgcacagctcagctgtctgatactgtgtgtgatctctgtttttatgcccggatcaccactggatctgtccgtgagtccatttgaggacataagatcccggtttatccagggggagtcaattacccctacaaagataccggagatcactacagagattcacgtatag

SEQ ID NO: 4677 - DNA, 2496 bp, Artificial Sequence
  Description of Artificial Sequence: Synthetic coding sequence
atggagaggccgtggggcgctgcagacgggttgagtcggtggccccatggcctgggactgctccttctcctgcagcttcttcctccctcaacactgagccaggaccgccttgacgcaccccctcctcccgcagcccctcttccaagatggtctggcccaattggagttagctggggactgagggccgctgctgccggaggggctttcccccgtgggggaagatggcggcgtagcgccccaggtgaggacgaagagtgtggacgtgtccgggactttgtcgccaagctggccaacaacacgcatcagcacgtattcgatgatctgcggggaagcgtctcacttagttgggtgggagactctactggagtcatattggtcttgaccacctttcacgtgccactggtcattatgaccttcgggcaaagtaagctgtatagatctgaggactacggaaagaacttcaaggacataacagacctgattaacaacactttcatccggactgaatttggcatggccattgggcctgagaacagcggcaaagtagtgctcacggctgaggtctctggcggttctagagggggaagaatcttccggtcctctgatttcgccaagaacttcgtacaaactgatctaccgttccatccactcacccaaatgatgtacagcccgcagaactcagattacttgttagcattaagcactgagaacggcctctgggttagtaaaaactttggagggaagtgggaggaaatccacaaggccgtatgtcttgcaaagtgggggtctgacaatactatttttttcacaacatatgctaatggatcctgcaaggctgacctcggcgcactagagctctggcggacatcagatctggggaagagctttaagacaataggtgtgaaaatatatagcttcgggcttgggggacgctttctcttcgccagcgttatggctgacaaggacactacgaggcgtattcatgtatccacagaccagggagatacatggtccatggcccaactgcctagtgtggggcaagagcagttttactcaatccttgcagcaaatgatgacatggtctttatgcatgttgacgagccaggggacacaggcttcggtactattttcacaagcgacgaccggggtattgtatacagcaagtctttggacagacacctctacaccaccaccggcggtgaaaccgatttcactaacgtcacatccctgaggggcgtatacattacctccgtcctgtctgaagataactcaatacagacaatgattacttttgaccagggtggaagatggacacatttgcggaaaccagagaactccgaatgtgatgcaactgctaagaacaagaatgagtgttcactgcacatacatgccagttatagtattagccaaaagctgaacgtgcctatggcgccactgagtgaacctaatgctgtaggtatcgtcattgctcatgggagtgtgggcgatgctatttctgttatggtgcccgacgtgtatatctcagatgatggcggatatagttggacaaaaatgctggaagggccacattattatacaattttggacagtgggggaatcattgtggccattgagcattccagccgcccaataaacgtgatcaagttcagcaccgacgaaggacagtgttggcagacctataccttcacacgtgaccccatctacttcacaggccttgcttcagagccaggcgctcggtctatgaatatctcgatatgggggttcactgagtccttcctgaccagccagtgggtttcttacactattgacttcaaggatattttagaaagaaattgcgaggagaaagactataccatttggctggcgcactctaccgaccccgaggactatgaggacggatgcattctaggatacaaggaacagtttttaagactacgaaagagctccgtctgtcagaatgggagagactacgtggtgacaaaacagccgtcaatatgtctttgcagcctggaggatttcctgtgcgattttggctattatcgcccagagaatgattctaagtgtgttgagcagcccgagctgaagggccatgacctcgagttctgtctgtacggacgtgaggagcatctcacgactaatggttacagaaaaattcctggcgataaatgtcagggaggcgttaatcctgtgcgagaagtgaaagaccttaaaaagaagtgcacaagtaattttttgtctcctgagaagcagaacagcaagtctaattctgtgccaatcatcctggctatagtcggtcttatgctggtgaccgtcgtggctggggtgctgattgtcaagaagtatgtatgtggcggtcgattcctcgtacacagatacagcgtgctgcaacagcacgcagaagccaatggggtagatggggtcgatgccctggatactgcaagccacaccaacaaatctggctatcatgacgattctgacgaggacctcttggaatag

SEQ ID NO: 4678 - DNA, 2085 bp, Artificial Sequence
  Description of Artificial Sequence: Synthetic coding sequence
atgacttttggccagagtaaactgtaccgttccgaagactacggcaaaaacttcaaggacatcacggaccttatcaacaatacattcattaggacagaatttggcatggcaatcggacccgaaaactctggcaaggtggtactgaccgccgaggtgagcggaggatcccgtgggggacgcattttcaggtctagcgacttcgccaagaatttcgtccaaactgacttaccatttcaccccctgacccagatgatgtactccccccagaacagtgattatttgcttgctctgtctactgagaatggtctttgggtgtcaaagaacttcggagggaagtgggaggaaatacacaaagcggtgtgcctggccaaatggggctccgacaataccattttctttaccacgtacgcgaacggttcttgcactgacctaggcgctctcgaactatggaggaccagcgatctcggcaaatccttcaagaccatcggcgtcaaaatctactccttcgggctcgggggaaggtttctgttcgcttccgttatggccgataaagacaccactcgcagaatccacgtgtccaccgatcagggagacacctggtccatggcacagctccccagtgtaggacaagaacagttctacagcatattagctgccaacgacgatatggtcttcatgcatgtggatgagccaggggacactggcttcggaaccatcttcacatcagacgatcggggtattgtgtacagcaagagtctggatcgccatctgtatactacaaccgggggtgaaacggattttactaacgtcacatcactcagaggtgtctacatcacctcggttctctctgaggacaacagcatacaaacgatgataaccttcgaccaagggggtagatggacgcacctgagaaagcctgagaatagtgagtgcgacgccactgccaagaacaagaatgagtgctctctccatatccacgcttcgtatagcatcagccagaagctgaacgtgccaatggcccctttgagtgagcccaacgccgttggaatcgtgattgcacacggaagcgttggagatgcaatttccgtgatggtgcccgatgtgtatatttcagatgacggaggatattcctggacaaaaatgttggagggcccacactattacacgatactggactctggtggcatcattgtcgctatcgaacactcctcccggccaattaacgtcataaagttttcaacagatgagggccagtgctggcagacttatacattcacacgtgatccgatttacttcaccgggcttgcaagtgagcccggtgcccgatctatgaacatttctatctggggattcaccgagagctttcttacaagccaatgggtttcctatacgatcgattttaaggatatcctggagcggaactgcgaggagaaagactatacgatttggctcgctcatagcacagatccagaagactacgaagacggctgcatcctgggctacaaagagcagtttcttcgtctcaggaagtcctccgtgtgccaaaacggaagagactatgtcgtgaccaagcagcctagcatctgtctgtgctccctggaggatttcctctgcgattttggctactataggccagagaacgatagtaaatgcgtcgaacaacccgagctcaaggggcacgatcttgagttctgtctatacgggagagaagagcatctcacaaccaacggctatagaaagatccccggagataagtgccagggcggagtcaaccccgttagggaagtaaaagacttgaaaaaaaaatgtacatccaactttctgtcccccgagaagcaaaactccaaaagcaattccgtacccattattttggcaattgtcgggcttatgctggtaaccgttgtggcgggagtgctaatagtcaaaaaatacgtttgtggcggacgattcctggttcaccgctattcagtgttacaacaacatgccgaagcgaatggcgtggatggtgttgacgccctcgacacagcaagccacaccaataagtctggatatcacgatgatagcgatgaagacctcttggagtag

SEQ ID NO: 4679 - DNA, 1446 bp, Artificial Sequence
  Description of Artificial Sequence: Synthetic coding sequence
atgaaggtgctcagtgaaggccaactcaagctgtgtgtagtccagccagtgcacctaacttcctggctgcttatctttttcatactgaagagtatcagttgtctcaaacctgccaggctgccaatttaccagcgtaagcccttcattgctgcatggaatgcacctaccgaccagtgtctcatcaagtataacctgaggctgaatctcaaaatgttccccgtaataggcagccccctcgccaaggcaagggggcagaacgtgaccatcttttatgtgaaccggcttggctattacccatggtatacttcccagggggtgcccatcaacggcggactccctcaaaacatatcactacaagtgcatttggagaaggccgatcaggacataaactattatattccggcagaggacttttcagggctcgccgtgattgactgggagtattggaggcctcagtgggcccgtaactggaacagcaaagatgtttatcgtcaaaaatcccgcaaattgattagtgacatgggcaaaaatgtatccgcaacagatattgagtacctggccaaggtcacttttgaggagagcgcaaaggcattcatgaaggagaccattaaactgggcataaaatcgaggccaaagggtctctgggggtattacctttatcccgactgccacaactacaatgtgtatgcccctaactacagtggatcttgccccgaagacgaggtcctgagaaataatgagttatcttggctgtggaactcaagtgcagccctataccctagtattggcgtctggaaatccctgggcgacagtgaaaatatcctgaggttcagcaaatttcgcgtgcatgaatcgatgcgcataagcacaatgaccagtcacgattatgccctgcctgtatttgtctacaccagattgggttaccgcgatgagcctctgtttttcctgagtaagcaggatctcgtctcgacaatcggtgagtcagcagcgctcggcgctgccggaatagtaatatggggcgatatgaacttaactgcaagcaaggcaaactgcactaaggtaaaacagtttgtgtcttctgacttaggatcatacattgccaacgtaacccgagcagccgaggtctgctcattacacctgtgtcgcaataatggcaggtgtattcgcaagatgtggaatgcccctagctatctgcaccttaaccctgcctcgtaccatatagaggccagcgaggacggggaatttacagttaagggcaaagccagcgacacagacctggcagtgatggcagataccttttcttgtcactgctatcagggttacgagggtgccgattgtagagagatcaagacggctgacggttgcagcggtgtgagtcccagcccaggatccttaatgacactctgcctgctcctgctagcatcatacaggtcgatccagttatag

SEQ ID NO: 4680 - DNA, 1536 bp, Artificial Sequence
  Description of Artificial Sequence: Synthetic coding sequence
atgggagtcctgaagttcaagcatattttcttccggtcttttgtgaagagcagcggcgtgtcacagattgtttttacattcctgctcatcccatgttgcctgactctcaattttcgggctccgcctgtaatcccaaatgtgccattcctctgggcctggaatgcacctagtgaattctgtctgggaaagttcgacgagcctctggatatgagtctgttctcctttattgggagcccgagaatcaatgctaccgggcaaggagtgactattttctatgtggaccggttgggttactatccatatatcgacagtatcactggagtgactgtcaacggcggaatcccgcagaagattagcttacaggaccatctggacaaggccaaaaaagacatcacgttttatatgcctgtggacaacctcggtatggccgtcattgattgggaggagtggcgccctacttgggcaagaaactggaagcccaaagacgtgtataagaatcggtctatagagctggtacagcagcagaacgtgcagctgagtctgaccgaggccaccgagaaggccaaacaggaattcgagaaggccggaaaggacttcctggtggaaacaatcaagctggggaaactgctccgccctaatcatctatggggttattacttgtttccagactgctacaaccaccactacaagaaaccgggatataacgggagctgcttcaacgtggaaatcaaaagaaacgatgacctctcttggctctggaatgaaagtactgccctctatccttcaatttatctgaacactcagcagtctcctgtagcagctactctgtatgtccgtaacagagtaagggaggcaatacgcgttagtaagatccccgacgccaagtccccgctccccgtgtttgcctacacccgaatcgtgttcactgatcaggtgctgaagttcctctcgcaggacgaattggtctatacctttggcgagaccgtagccctcggggcaagcgggattgtcatatggggtaccctctcgattatgcgcagcatgaagtcttgtctgcttctggacaattatatggaaactatactaaacccatatattatcaacgtaacgctcgccgctaaaatgtgcagccaggtgttatgtcaggaacaaggcgtctgcatccggaaaaactggaacagctctgattacctccacctgaatccagacaacttcgcgatccagctcgaaaaaggcggaaagttcaccgtgcgtggtaaaccaaccctggaggacctggagcagttctcggagaaattctactgtagttgttacagcacactgagttgcaaggaaaaggcagacgttaaggataccgacgccgttgacgtgtgcatcgccgacggagtgtgtattgatgctttcctgaagcctcccatggagaccgaagaacctcagatattctacaacgcctccccatccactctttctgctaccatgtttatttggaggttggaggtctgggaccaagggattagtcgtatcggctttttttag

SEQ ID NO: 4681 - DNA, 1530 bp, Artificial Sequence
  Description of Artificial Sequence: Synthetic coding sequence
atgggagtgctcaagttcaagcatatcttcttccggtcattcgtcaaatccagtggggtgtcccagattgttttcaccttccttctgattccttgctgtctcactctgaatttccgagccccaccggtgatcccgaatgtgcccttcctttgggcctggaacgccccatctgagttttgcttaggcaaatttgacgagcctctggacatgtcccttttcagctttatagggagccccagaattaatgctactggtcagggcgtaaccattttctacgtcgataggttaggatactatccctacattgactctatcaccggggtgacagtaaatggcggaattccccaaaagatttccttgcaggaccacttggacaaggccaagaaggatatcactttctacatgcccgtggacaatctggggatggccgtgatcgattgggaagaatggcggccaacatgggctcgaaattggaaaccgaaagacgtgtataagaacagatccatcgaacttgtccagcagcaaaatgtgcagctgtcattgaccgaggctacggaaaaggccaaacaggaattcgagaaggccggtaaagactttctcgtagagactattaaattgggaaagcttctgaggcccaatcatctgtggggttactaccttttcccagattgctacaatcaccactacaaaaagcctggttacaatggctcctgcttcaacgtggagatcaagaggaacgacgacctcagctggttgtggaatgagtctacagccctgtacccaagcatctatctgaacacccagcagagtccagtggccgctactctgtacgttcgtaacagggttcgagaggctataagggtttcaaagattcctgatgcaaagtctccattgccagtgtttgcttacaccagaatcgtgttcaccgatcaagttttgaagtttctctcccaggacgaactggtatatacttttggcgagactgtcgccctgggagccagtgggatcgtcatttgggggacgctgtcgatcatgcgttctatgaaaagctgtttactgctcgacaattacatggagactattctgaatccctatatcattaatgtgaccttagccgcaaaaatgtgctcccaggtgctttgccaagaacagggcgtgtgcatccgaaaaaactggaacagtagcgactatctccatctcaatcccgacaacttcgccattcagttggaaaaagggggtaagtttacggtgcgcggtaagccgacactagaggacctggaacagtttagtgaaaaattttactgcagctgctacagtaccctgtcctgtaaagaaaaggctgatgtaaaggacacagatgccgtggacgtctgcatagccgatggcgtttgtatcgatgcctttctgaagccacccatggagactgaagagcctcagatcttctataacgcctcgccttctactctgtccgctaccatgttcatcgtgtcaatcctattccttattatctcctccgtcgcctcactttag

SEQ ID NO: 4682 - DNA, 243 bp, Artificial Sequence
  Description of Artificial Sequence: Synthetic coding sequence
atgggtgttctgaagtttaagcatatcttcttcagatctttcgtgaaaagttcaggagtctcgcagattgtgttcacttttttgttgatcccctgttgcctgaccctgaactttagagcccctcctgtcatcccaaacgtcccatttttgtgggcgtggaatgctccttccgagttctgcctgggtaagtttgatgagcctctggatatgagccttttcagctttatcggctcccccaggtag

SEQ ID NO: 4683 - DNA, 1530 bp, Artificial Sequence
  Description of Artificial Sequence: Synthetic coding sequence
atgggagttctaaaatttaagcacatcttcttccgcagcttcgttaagagttctggggtgtcccagatcgtcttcaccttccttttgatcccatgttgtctgaccctgaatttccgcgcacccccagttatcccaaacgtcccttttctgtgggcctggaatgcaccatctgagttttgtctgggcaagttcgacgaacccttagatatgagcctgttcagcttcatcggttctccccgaataaatgcgacaggtcagggagtgaccattttttatgttgacaggttaggctattatccatacatcgatagcatcaccggggtgacagtgaatggaggaatcccacagaagatttccctgcaagatcaccttgacaaggcaaagaaggacattacattctacatgcctgttgacaatctgggcatggctgtcattgattgggaagaatggagacccacatgggctcggaattggaagcctaaggacgtgtacaagaataggtcaattgaactggtccagcagcagaacgtgcaactgtctctgaccgaagcgactgaaaaggctaagcaggagtttgagaaagcaggcaaggattttcttgtggagaccatcaaattgggtaagctattgcgccctaatcatctgtgggggtattatctgttcccagattgttacaaccatcattataagaagcctgggtataacggctcttgtttcaacgttgaaatcaagagaaatgacgatctctcttggctgtggaacgagtcgactgccctgtatccttccatttaccttaacacacaacagtcacctgtcgctgctacactctatgtgcggaaccgcgtgcgggaggccatcagggtgagcaagatcccggacgccaagagcccccttcctgtgtttgcatatacgagaatcgtattcaccgaccaagtgctgaaattcctgagccaagacgagctggtctatacttttggagagaccgttgctctgggggcttctggaatcgtaatctggggaacgttgtccataatgagaagcatgaaaagttgcctactcctcgacaactacatggagacaatactgaatccatacataattaacgttaccttagcagcgaaaatgtgctcccaggtactgtgccaggaacagggcgtgtgtattcgaaaaaactggaactcgagtgattacctccacttgaacccagacaactttgctattcagctagaaaaggggggaaaatttacagttagaggtaaacctaccctggaggatctcgagcaattcagcgagaagttttattgctcctgctattcaactttatcatgtaaggaaaaggccgacgttaaggatacagacgccgtggacgtttgtatcgctgacggagtatgcatcgacgcctttttaaagccacctatggagaccgaagagcctcagatattttataatgcctccccaagcacgctctctgcgacaatgtttatcgttagcatcctgttcctaatcatctccagcgttgcttcattgtag

SEQ ID NO: 4684 - DNA, 1530 bp, Artificial Sequence
  Description of Artificial Sequence: Synthetic coding sequence
atgggggtattgaaattcaaacatatcttcttcaggagtttcgtcaagagttccggagtgtcacagattgtgttcacttttctcctcataccctgctgtcttacactgaattttagagcccctcctgtcattcctaatgttccgtttctttgggcttggaacgccccttccgaattttgcctcggaaaatttgatgaaccactggacatgtccctgttctcctttatcggcagccccagaatcaacgccaccggacagggagtgaccatattttacgtggacaggctgggctattacccttatattgacagcattaccggggtgacggtcaacggtggcatcccccaaaagatcagtctccaggaccatctggataaggccaagaaagacatcactttttatatgcctgtggataacctggggatggcagtgatcgattgggaagaatggcggcctacttgggcccgtaattggaaacctaaggacgtctataaaaaccgctccatcgagctggttcagcagcaaaatgtccagctgagtcttacggaagctactgaaaaagctaaacaggaattcgagaaagcgggtaaggatttcctggtcgaaacaatcaaattggggaagctcctgcgacccaaccacctgtggggttactatctcttccctgattgctacaaccaccattataagaagcctgggtataacgggtcctgcttcaatgttgagataaaacggaacgacgacctctcctggctgtggaatgaaagtactgccctttacccatctatctatcttaacactcagcaaagcccagttgctgcgaccctttatgtgagaaaccgggtgcgcgaagcaatacgcgtgagcaagattcctgacgccaaaagccccctcccagtgtttgcatatacccggatcgtgtttacagaccaggttctaaaattcctttctcaggatgagttagtttacacctttggcgagaccgtcgccctgggcgctagcggcatcgttatctggggaacgctatccatcatgcgctctatgaagtcctgcttgctcctggacaattacatggagaccatcctgaacccctacatcattaatgttactctggccgcaaaaatgtgctcgcaggtcctttgtcaggagcagggtgtctgtattagaaagaactggaactctagtgattatctgcatctaaatcccgacaatttcgccattcagctcgagaaggggggtaaattcaccgtccggggaaaacccacgctcgaggatcttgaacagtttagtgaaaaattctactgcagttgctacagcacactgagctgtaaagaaaaggctgacgttaaggacacggacgccgtcgacgtgtgcattgccgatggggtatgtattgacgcatttttaaaaccccctatggaaacggaggaaccccaaattttttataacgcctctccatcaaccctgtccgccacaatgttcattgtctcaatcttgttcctgattatttccagcgttgcttctctttag

SEQ ID NO: 4685 - DNA, 1764 bp, Artificial Sequence
  Description of Artificial Sequence: Synthetic coding sequence
atgccaagatacggcgcaagcctgcgccaatcctgtcccagaagtggacgcgagcaaggtcaggatggcaccgcgggtgcacctggattgctgtggatggggctcgtgctggctctcgctctcgccctagcacttgctttggctttgtcagattccagagtgttatgggccccagctgaagcccaccccttatcccctcaagggcatccagccaggcttcatcgcatagttccacgcctgagggatgtgttcggttggggaaatctgacatgtcccatttgcaaaggacttttcaccgccatcaacttgggactgaagaaagagcctaatgtggccagggtaggttctgtcgccataaaactgtgtaatctgctaaagattgctccacctgctgtatgccagtcaattgtgcacctgttcgaagacgacatggtggaagtttggcgccgatccgtcctatcaccctctgaggcatgcggcctgctgctggggagtacttgtggacactgggacatcttttccagctggaatatcagtctgcctacagtaccaaaacctccacccaagcccccaagtcccccagccccaggcgcacccgtttcacgcatcctgttcctcaccgatctgcactgggaccacgactatctggagggtacagaccctgactgcgccgaccctctgtgctgcagaagaggaagcgggctgcctcccgcaagccgcccaggggctgggtattggggtgaatatagcaagtgcgatctccccctgcgcactctcgaatcacttctgagcgggcttggtcctgccggaccattcgatatggtgtactggacgggcgacatcccagcccacgatgtgtggcaccagacgcggcaggaccagctgagagcactgaccactgtcactgccctagtcagaaagtttttggggccagtgccagtttaccctgccgtggggaatcacgaatctacaccagtcaattccttcccccctccatttattgagggtaaccactcaagcagatggctctacgaggcaatggctaaagcctgggaaccctggctgcccgcagaagctttgagaaccctccggtatctgagttctgtcgagacacaggagggcaaaagaaaggtgcacataattggccacattccccctgggcactgcctcaagtcttggagttggaactattatcgcatcgtagctcggtatgaaaatacactggccgcacaattcttcggacatactcacgtggacgagtttgaggtgttttacgacgaagagactctctcaagacccctcgcagtggccttcctggcacccagcgccacaacatacatcggcctcaacccgggatatagggtgtatcagattgacggaaattactcgggatcttcacatgtggtgctcgatcacgagacttacatcctgaacctaactcaagccaacatccccggtgctattccccattggcagctgctttatagagcaagggagacctatggtctgccgaacacattgcccactgcctggcataatctggtctatcggatgagaggtgacatgcagctatttcagacattttggttcctatatcacaaaggccacccgccttcagaaccctgcgggacaccatgcaggctggctacattatgcgcacagctgtccgcacgagcggattcccctgccctgtgcaggcatctgatgcccgacgggagccttcccgaagcacaatccttgtggccaaggcccctcttctgttag

SEQ ID NO: 4686 - DNA, 1896 bp, Artificial Sequence
  Description of Artificial Sequence: Synthetic coding sequence
atgcccaggtatggcgcaagcctccgccagagctgcccccgatccggaagggaacagggccaggatgggacagctggggctcccggtctcctgtggatggggctcgtgttggctctggccctcgccttagcattggctctagccctctcagatagcagggtgttgtgggcgccagcagaggcccaccctctgtctccccagggccacccagccagactgcacagaatcgtccccagactgagagacgtcttcggttgggggaacctgacttgtccgatttgtaaagggctgttcacagccataaaccttggcctgaagaaagagccgaatgtggccagggtgggctctgtcgcaatcaaactgtgcaatctcctgaagatcgcccctccagctgtgtgccaatccatagtccacctgtttgaggatgatatggtggaggtctggcgcaggtcagtgctatccccctcggaggcctgcggcttgttgcttggttctacgtgcggtcactgggatatcttttcatcatggaatatctctctccctacggttcccaaaccaccacctaaacccccttcccccccagcccctggggcaccagtgagtcgtatcctcttcctcactgatctgcattgggatcacgattatcttgaaggaacggatccagactgcgctgaccccctgtgttgtaggcgtgggagcggactgcccccagcgtcaagaccgggagctgggtactggggtgaatactccaagtgtgatctgcccttgcgcaccctcgaaagcctcctctccggtctggggccagctggcccttttgatatggtgtattggaccggagatatccctgcacacgacgtctggcatcagaccagacaggatcagctcagagccttaaccaccgtaactgcgctagtgagaaagttcctggggccagtgcctgtctaccccgctgtgggaaatcatgaatcaactcctgtgaatagttttcctccaccattcatagaggggaatcactccagccgatggctatacgaggctatggcgaaagcatgggaaccatggttaccagcagaagcactccgaacgcttcggatcggcggtttttacgcactgagtccctaccctgggctccgactgatcagcctaaatatgaatttctgcagtcgcgagaacttctggctgctgatcaattccacggaccccgcaggccagctgcaatggctggtgggagaactgcaggccgctgaagatagaggcgacaaggttcacatcatcggacatatccctccgggacattgccttaaatcatggtcgtggaactattaccggattgtggccaggtatgagaataccctcgcagcccagttctttggccacacccacgtggacgagtttgaggtgttctatgacgaagagaccctgagccgcccactggccgtggcattcctggcacccagcgcaacaacatatattgggcttaaccctgggtatcgtgtgtaccagatagatggcaattactccggatcaagtcatgtcgtcctcgaccatgagacctacatcctaaacctcacgcaggctaatattcccggtgctatcccccactggcagctcctctaccgcgctcgagaaacctacggacttcctaacacgttacctaccgcttggcacaatcttgtctatcgcatgaggggggatatgcagttatttcaaaccttctggttcctgtaccacaagggccatcctcccagtgagccatgtggtactccatgtaggcttgccacactctgcgctcagctgtccgcccgtgctgatagtcccgctctgtgtaggcatttaatgcccgacggcagtctaccagaggctcagtccctctggccgagacccctattttgctag

SEQ ID NO: 4687 - DNA, 1728 bp, Artificial Sequence
  Description of Artificial Sequence: Synthetic coding sequence
atgccgcgttatggggcttctctgaggcagagctgtccccgaagcggcagagaacaggggcaggatggcacagcaggagctccaggacttctctggatgggactcgtgctcgcattagcacttgcactcgccttggcactggccttgtccgattccagagttctgtgggcgccagccgaggcacacccactctcccctcaggggcatccagctcggctgcacaggatcgtgcctagactccgggacgtgttcggttgggggaatctgacctgccctatatgcaaaggcctgttcacggccatcaacctgggtctaaagaaagagcccaatgtggctagggtaggctctgtcgcaataaagttatgtaatctgttgaagattgctccaccagccgtgtgtcagtctatagttcacctgtttgaggacgatatggtagaggtgtggaggcgatctgtcttgtccccgtctgaggcttgcgggttgctcctcggcagcacctgcggccattgggacatattctcttcctggaacatcagtcttcctacagtgccaaaaccaccacccaaacccccttcacctcccgcaccgggagctcccgtctcccgtatccttttcctgacagacctgcattgggaccatgactacctcgaggggacagacccggactgcgccgaccccctgtgctgtcgacgcggttcaggactcccacctgcgtcaagacccggagcaggttattggggtgaatactcaaaatgcgacctgcctctgagaactcttgagtcgctgctcagcggcctggggccagctgggcctttcgatatggtgtactggacaggagacattcccgcacatgatgtctggcatcagaccagacaggaccagctgcgcgcactcaccacagtaactgccctagtgcgcaagtttctggggcctgtgcctgtatatcctgccgtgggaaatcacgagtcaaccccagtcaactccttcccccctcctttcatcgagggtaatcacagtagccgctggctctatgaggctatggcaaaagcctgggagccgtggctgcctgccgaggcgcttcgaacactcagaaaggtgcacatcatcgggcacataccacccggacactgcctcaaaagttggtcctggaactactatagaatcgtggctagatatgaaaatacattggcggctcagtttttcggccatacccacgtggatgagttcgaggtgttctacgatgaggagacactctcaagaccattggctgtggcttttctcgcaccctcagccacgacttacatcggtctaaatccagggtaccgcgtctatcagattgatggtaattactcaggctccagccacgtagttctggaccacgaaacctatattttgaatcttacacaggccaatatccccggagcaattcctcactggcagctgctgtatcgggcacgggagacatatggactgcccaataccctgcccactgcttggcataatcttgtgtaccgtatgcgaggtgacatgcaactgttccagaccttctggtttctctaccataagggccaccctccaagcgagccctgtgggacgccctgcaggctggccacgctgtgcgcccagctatcagcccgagcagattcccctgccctctgtaggcacctgatgcctgatggctcactgcctgaggctcagtcattgtggccgagacctcttttctgttag

SEQ ID NO: 4688 - DNA, 1893 bp, Artificial Sequence
  Description of Artificial Sequence: Synthetic coding sequence
atgcctaggtatggcgctagtcttagacagtcctgtcccagatctgggagagaacagggacaggacggtacagcaggcgcacctggccttttgtggatgggattggtgcttgctcttgcattggccctggccctggccctcgccctgagcgatagcagggttttatgggcgccagcagaagcccatcccctgtccccccagggtcaccctgctcgattacaccgcatcgttcctcggctgcgcgatgtgttcggctggggaaatctaacttgcccaatttgcaagggtctgtttacggctattaatctgggactgaaggagcctaatgtggccagagttggatctgttgccattaaactgtgcaacttgctgaagattgcaccgccagccgtgtgccagtcgattgtacacctgttcgaggatgatatggttgaggtgtggcgcagatcagtgctcagtccctctgaggcttgtggactgctgttggggagcacatgcgggcactgggatatcttttcaagttggaatattagcttgccaacagttccaaaaccacctccaaaacctccctccccccctgccccaggcgctcccgtctcacggattctcttcctgacagatctccattgggatcatgactaccttgaaggaaccgaccctgactgtgcagatccgctatgttgccgtcggggttcaggcttgccccctgcctcacggcctggggctgggtattggggtgaatatagcaagtgtgatctgccgctacggacactggagtctctgcttagcggccttggcccagctgggccttttgatatggtatactggacaggagatatccctgcccacgacgtctggcatcagacccgccaggaccagctgcgagctctgaccaccgttaccgctctcgtccggaaattcctggggccagtaccggtctaccccgctgttggtaatcatgaatccacaccagtgaattctttccccccaccctttatcgaaggaaatcattcaagcagatggctctatgaggctatggccaaggcttgggaaccctggctcccagcggaggcccttcggacattgcgaatcggcggattctacgcattgagcccctatcctgggctcaggctgatttctctgaatatgaatttctgttcacgggaaaacttctggctgctgattaactcaacagatcctgccggacaactgcagtggttagtcggggaactgcaagccgctgaagatcggggtgacaaggtacacattataggccacattcctcccggacactgccttaagagctggtcgtggaactactaccgcatcgtcgctagatacgaaaatacactcgccgcacagttcttcggacatacacatgtagatgagttcgaggttttttacgatgaagagacattgagcagacccctggctgtggccttcctcgctccaagcgccaccacctatatcggcctgaatcctgggtacagagtgtatcaaattgatggcaactattcaggctcatcgcacgtggttcttgaccacgagacctacatcctgaacctcactcaagcaaacatacccggtgccataccacattggcagctcttgtatagagctagagagacctacggcctgcctaatacactgccaaccgcctggcataacctcgtttaccggatgcggggagatatgcaactgtttcagaccttttggttcctttaccacaaaggacatcctccatctgaaccatgcggcacgccttgccggttggctaccctctgtgcacagctctctgctcgcgctgattcccccgcactgtgccgccacctcatgcccgacggatccttacccgaagctcagagtctttggcctcgccctctgttctgctag

SEQ ID NO: 4689 - DNA, 1101 bp, Artificial Sequence
  Description of Artificial Sequence: Synthetic coding sequence
atgcctcggtatggagcatccctcaggcaaagctgcccacggtcggggagagagcagggtcaggacggaactgccggagccccaggactgctgtggatgggactggtactggcccttgcactggcattggcattggccttggctctgtctgacagcagagtgttgtgggctccagctgaggcacacccactaagtccccaaggacacccagcgaggttgcaccgtattgtgccaagactccgtgatgtcttcgggtggggaaacctgacctgcccaatatgtaaagggctttttacggccatcaacctcggtcttaagaaggaaccaaacgtggccagggtcggatctgtggcgataaagctatgtaacctcttaaagatcgcaccccctgccgtctgtcagagtatcgttcatctctttgaagacgatatggttgaggtctggagacgctcagtccttagcccctcagaagcttgtggattgttgctcgggtccacgtgtggacactgggatattttctcaagttggaacattagcttgccgacagttcccaagccaccaccaaagccaccttctcccccagccccaggagcccctgtgtcgcgaatcctcttcctgacagatcttcattgggaccatgattacctggaggggactgatcctgactgcgcagaccccttatgctgccgtagagggagtggcctcccccctgcctccagacctggcgctggttactggggagagtatagcaaatgtgatctacccttgcgcactctggaaagccttctcagcgggcttggacccgctggaccctttgatatggtgtactggactggcgacataccagcccatgatgtctggcaccagacgagacaagaccagcttagggcgttgactacagtgaccgctctagttcggaagttcctgggacccgtccccgtgtaccctgctgtgggaaatcatgagtctacgccagtgaatagttttccaccgccatttatcgaaggaaaccattccagccgctggctctacgaggcaatggctaaggcatgggaaccgtggctgcctgccgaggcactgcggaccctgcgttgcatttag

SEQ ID NO: 4690 - DNA, 1209 bp, Artificial Sequence
  Description of Artificial Sequence: Synthetic coding sequence
atgcctaggtatggggcttctcttcggcagtcatgtccgaggagtggccgagaacaggggcaggatggtactgcaggagcaccgggtctgctctggatggggttggtcttggccctggctctggcgctcgcgctcgccctcgcactgtcagactcccgagttctgtgggcacccgctgaagcccatcccctgagtccacagggacatcctgcaaggcttcacaggatcgtcccccgactgagggatgttttcggatggggtaacttgacctgccccatttgtaaaggccttttcacagctattaacttgggactaaaaaaagaacctaacgtcgccagggtgggaagtgttgccatcaagctgtgcaaccttctgaagatcgctcctccagccgtctgccagagcattgtccatctcttcgaagacgacatggtcgaagtttggcggaggagcgtcttgtctccttctgaggcatgtggcctgctcctgggttctacttgtggacactgggacattttctcttcctggaatatttctcttccgacagtgccaaagccaccacctaaaccaccctcaccaccggcaccaggcgctccagtgtccagaatcctcttcctcacggacctccactgggatcacgattatctggaggggacggaccctgactgtgctgatcccctttgctgtaggcgcggaagcgggctgcctcccgcttcccgcccaggtgcgggatactggggtgaatacagcaagtgtgatctacccttacgcactttggaatccctgctttcaggcttgggaccggctggaccctttgatatggtgtactggaccggcgacattcccgcacatgacgtgtggcaccaaaccaggcaggatcaactgcgtgccctcaccacagtgacagctctcgtgcgcaagtttctgggaccagtccccgtgtaccccgcagtaggcaaccacgaaagcacaccggtgaactcctttccaccaccttttattgaaggtaatcactctagtcggtggttgtacgaggctatggccaaggcgtgggaaccatggctccccgctgaagctttacgaacattacgctatttaagctcggtcgaaacccaggaggggaagcggaagaattggggggtgctctgcagcttcccaatcccacgttctccaccacacctgtcacagtatgaatttctctttccatag

SEQ ID NO: 4691 - DNA, 954 bp, Artificial Sequence
  Description of Artificial Sequence: Synthetic coding sequence
atgtacaacatgatggagaccgagctcaagcctccaggaccccagcaaacctccgggggaggcggaggtaattcgacagccgcagcagctgggggaaaccaaaagaacagcccggaccgcgtaaaaagacccatgaacgcgtttatggtctggtcacggggacaacgacggaaaatggcacaggaaaaccccaagatgcacaatagcgagatctctaagcggttgggagccgaatggaagctcctgtccgagaccgagaagcgtccttttatcgatgaggccaaacggcttcgggctctgcacatgaaagaacatccagactataaataccgacctagaaggaagacaaagacactgatgaaaaaagacaagtatactctgccaggcggtctgcttgccccaggcggtaacagcatggctagtggggtgggagttggagctggactgggcgcaggagtcaaccagcgaatggattcctatgcacacatgaatgggtggtcaaacggatcttatagcatgatgcaagatcagttgggatatccccagcatccagggttgaatgcccatggcgcagcccagatgcaacccatgcaccggtacgacgtgagcgcacttcagtataactcaatgacaagctcccagacctacatgaacggctcacctacatattctatgtcctactctcagcagggtacacctggaatggctctaggcagtatgggaagcgtggtgaagtctgaggcgtcttctagtcccccagtggtaactagcagttcacacagccgggctccgtgccaagccggagaccttagggacatgatctcaatgtacctgcccggtgctgaggtaccggagcctgctgctccaagcagactgcacatgagccagcactatcagtcaggacctgttccaggcacagccatcaatgggacactgcccctctcacatatgtag

SEQ ID NO: 4692 - DNA, 954 bp, Artificial Sequence
  Description of Artificial Sequence: Synthetic coding sequence
atgtacaatatgatggagaccgagcttaaaccccctgggccacaacagacgtctggtgggggagggggaaactcaaccgcagcagccgcaggcggaaatcagaagaattctcccgatcgcgtgaaaaggccgatgaacgcctttatggtatggtcacggggtcagcgcagaaagatggcccaagaaaacccaaagatgcataattcagagattagtaagcgcctcggtgcagaatggaagcttctgtccgaaacagagaagcgccctttcattgacgaggctaagagacttagggcacttcatatgaaagaacatcccgattataaataccgcccacgtagaaagacaaagaccctaatgaaaaaagacaaatatacactgcctggcggactgctggcacccggaggaaattccatggccagcggggtaggggtgggcgctggacttggcgcaggagttaatcagagaatggacagctatgctcacatgaacggatggtccaatggctcttacagtatgatgcaggaccagctgggctatcctcagcatcccggtctgaatgcacacggagcagcccagatgcagcccatgcatcgatatgacgttagtgccctgcaatacaattcgatgactagtagtcagacatatatgaatgggagccccacgtactctatgtcatactctcaacagggtacaccaggtatggcactcgggtccatgggatcagtggtaaagtcggaggcatcctcttctcctccggttgtgacatcctcttcccacagccgcgctccatgccaggccggtgacttgcgggatatgatatccatgtacctgcctggcgcagaggtgcccgagccagctgctccatctcggctgcacatgtctcagcattatcaatccgggcctgtccccggaactgcaatcaatggcaccctgcccctgtcccatatgtag

SEQ ID NO: 4693 - DNA, 1182 bp, Artificial Sequence
  Description of Artificial Sequence: Synthetic coding sequence
atgcatcaagccggttacccagggtgtagaggggcaatggcagagagtcacttactccagtggctattgctactattgccaactctgtgtggacctggaacagcggcatggaccacgagttctctcgcgtgcgcccaggggcctgagttctggtgccagtcacttgaacaggcgcttcagtgtcgcgcactcggacattgcctgcaggaggtgtgggggcacgtcggggcagatgacctttgccaggaatgtgaggacatcgtccacatcctcaataagatggctaaagaggctattttccaggacacaatgaggaaatttctggagcaggagtgtaacgtgctcccactcaagctacttatgccccagtgcaatcaggtgctcgacgactattttccactggtcatcgattatttccagaaccagactgactccaacggcatatgtatgcacctggggttatgtaagtctcggcagccggagcctgagcaggagccagggatgtctgaccctctgcctaagcccctgagggaccctctgccggaccccctactagacaagctggtcctgcctgttctgcccggtgctctgcaagccaggcctggcccacacacccaggacctgagtgaacagcaattccccatccccctcccatactgctggctgtgccgcgcactaatcaagcgaattcaggctatgatccctaaaggtgcactcgctgttgcggtggcccaggtctgccgtgtggtgcctctggtggccggaggtatttgccagtgtttggcagaacgctattcggtcatactgctggacacattgctaggtcggatgttgccgcagctggtatgtcgcctagtcctgcgatgcagcatggacgactccgcaggaccgaggtcgcctacaggagaatggctccctagagacagtgagtgccacctgtgtatgtccgtgactacacaagctggcaactccagcgagcaagccatcccccaggccatgcttcaggcatgcgtgggtagctggctggatcgggagaaatgcaaacaatttgtggaacagcacaccccgcagctcctgacactcgtgcccaggggctgggacgctcacacaacatgccaggctctgggggtgtgtggaaccatgtcgagtcctctccagtgcatacattcccctgatctgtag

SEQ ID NO: 4694 - DNA, 1182 bp, Artificial Sequence
  Description of Artificial Sequence: Synthetic coding sequence
atgcatcaagccggataccccggatgccgaggcgcaatggccgaatctcaccttcttcagtggctgctgcttttgctgcccaccctatgtgggccaggcaccgcggcatggacgacgtccagcctcgcctgcgcacagggccctgagttctggtgccaaagtctcgagcaggcactgcagtgtcgcgctctgggccactgcctgcaagaagtgtggggccacgtaggtgctgacgacctgtgtcaggagtgcgaagatattgtacacatcctgaataagatggcaaaagaggccatcttccaagacacaatgagaaaattcctggaacaggaatgtaatgtcttgcccctcaaacttctcatgccccagtgtaatcaagtcctggatgactatttccctctggtgattgattacttccaaaatcagaccgattcaaacggaatctgtatgcacctgggactgtgcaagtctcgacagccagaacccgagcaagaaccgggaatgagtgaccctctgcccaagccattacgggaccctcttcccgatccactgttggataaactagtgctgccggtgctccctggagcattgcaagccaggccaggcccacatacccaagacttgagcgaacaacagttcccaatacccctgccatattgctggttgtgcagagctctgatcaaacggattcaagctatgatccccaaaggagccctggccgtggcggttgcacaggtttgcagagtggtgccactggtcgccggaggcatatgccagtgtctggctgaacgatactctgttatcctcctggataccttactgggaagaatgctaccccaactggtatgccggctggttttgcggtgcagcatggatgactccgctgggccaaggagccctacaggtgagtggcttcctagggatagtgagtgtcatttgtgcatgtccgtcaccacacaggctggaaattccagtgagcaggcaatcccgcaggctatgcttcaggcctgcgtcggcagctggttagaccgggaaaaatgcaaacagtttgttgagcagcacacaccccagttgttaacccttgtccccaggggatgggacgcacataccacatgtcaggctctgggggtctgcggcacaatgagcagccccctccaatgtatccactctcctgatctctag

SEQ ID NO: 4695 - DNA, 1050 bp, Artificial Sequence
  Description of Artificial Sequence: Synthetic coding sequence
atggcggaatcgcacctcttgcagtggctgctgctcctccttcctacactttgtggcccaggtacagcagcatggactaccagctcccttgcctgtgcacaggggccagaattttggtgtcagagtctcgaacaggccctccagtgtcgagcgctcgggcattgtctgcaggacactatgagaaagtttctagaacaggagtgtaatgttttgcctcttaaattattgatgcctcagtgtaatcaggtgctggacgactacttccccctggtgattgactattttcagaatcagactgattcgaatggtatctgcatgcatctaggattgtgtaagtcccgccagcccgaacccgagcaagagcccggaatgagcgatcccctccccaaacccctgagagatccccttccagatccattgctggacaagttagtgctcccagttctccccggagctctccaggcacgacctgggccacacacccaggatttgagtgagcagcagtttcctatcccactcccttactgttggctgtgcagagctctgatcaaaaggatccaagcaatgatccccaagggagccctggcagtggccgtggcacaggtctgtagggtcgtacctctcgtggccggagggatctgtcagtgcctggcggagcggtactccgttatcctgctcgacacgcttctaggtagaatgctgccgcagcttgtgtgtcgacttgtactgcgatgtagcatggatgatagcgcgggaccacggagcccaaccggagagtggcttcctcgggattcagagtgtcacctctgtatgtccgtaacaactcaggccggtaacagttcagaacaggccattccccaagctatgctccaagcttgtgtggggtcatggcttgaccgggagaagtgcaaacagtttgtcgagcagcacaccccccagctgctgacgctggtgcctcgcggatgggacgcacacactacctgtcaggccctgggtgtctgtggaacaatgtcttcaccccttcagtgtattcattctccggatttatag

SEQ ID NO: 4696 - DNA, 1152 bp, Artificial Sequence
  Description of Artificial Sequence: Synthetic coding sequence
ggagccatggctgagagtcacttactgcagtggctgctcttgcttctgccaactctatgtgggcctggtacggctgcatggacgacgtctagtctcgcctgcgctcaagggccagaattctggtgtcagagtctcgagcaggcactgcaatgccgcgctttggggcactgcttgcaagaggtatggggtcatgttggagctgatgatctgtgccaggagtgcgaggatatcgtgcacatcctgaacaagatggccaaggaggcaatttttcaggacactatgcgtaagtttttagagcaggagtgtaacgttctgcccctgaagctgctgatgccccagtgcaatcaggtgctggatgattactttccccttgtgattgattatttccagaatcagaccgactccaacggaatctgtatgcaccttggactctgcaaaagtcggcagccagaacccgaacaggagcccggaatgtctgaccctctgcctaaaccattgagagatcccctgccagatcctctcctcgacaaattagtgctgcccgtcttacctggcgcactgcaagcacggccaggaccgcatacacaggatttaagtgagcagcagttccccatacctcttccgtactgctggctgtgccgcgcactgatcaagcgcatccaagcaatgatccccaagggagcccttgcagtagcagtggcccaggtgtgtcgcgtagtcccgcttgtcgccggtggtatctgccagtgcctcgccgaacgttatagcgtcatcctcttagatactcttctgggacgcatgctgccgcaacttgtatgtcgcttagtgctcaggtgtagcatggacgactctgcgggaccacgctcgccaaccggagagtggctacctcgcgacagcgaatgtcatctgtgtatgtccgttacaacccaggccggaaattcaagcgaacaggctatcccacaggccatgctccaggcatgtgtgggatcttggttagatagagagaagtgcaagcagttcgtggagcagcacacaccccagcttctaacactcgtccccaggggctgggatgcccatacgacatgccaggctttaggtgtttgtggaaccatgtcctcacccttacagtgtatacacagcccggacctttag

SEQ ID NO: 4697 - DNA, 1728 bp, Artificial Sequence
  Description of Artificial Sequence: Synthetic coding sequence
atgctcggcgttctggtgctcggggctctggctctcgctgggcttgggttcccagcccctgcagagcctcaacctggcggtagtcagtgtgtagaacatgactgttttgccctttatccaggacccgcaacatttcttaatgcctcgcagatttgcgacgggctacgcggacacctgatgacagttaggtcgtctgtggcagccgacgtgatctccctgctgctgaacggtgacgggggagtcggcagacggagactgtggatcggcctgcagctgcctcctgggtgcggcgatcccaaacggctcggcccactgcggggtttccagtgggtcaccggggacaacaacacctcgtattctaggtgggctcgactcgacctcaacggagcaccactctgtggacctctctgtgtggctgtttccgctgccgaggccaccgtgccttcggaacctatatgggaagagcaacagtgcgaagttaaagccgacgggtttctgtgtgaattccatttccccgcaacatgtcgcccactggctgtagaaccaggggcagctgcagctgccgtgagcatcacgtatgggactccttttgccgcacgcggagccgatttccaagctctaccagtgggcagtagcgccgctgtggcaccactgggactgcagctgatgtgtacagcccctcctggggcagtgcaggggcactgggcacgggaagcaccaggcgcttgggactgtagcgtggagaatgggggttgcgagcacgcatgcaatgccattccaggagctcctagatgtcagtgtcccgctggagccgctctgcaggctgacggaaggagttgcacagctagcgccacgcaatcgtgtaatgatttgtgtgagcacttttgcgtgcctaatccagaccagccaggaagctacagctgtatgtgtgaaactggttatcggctggcagcagaccaacatcgatgtgaagatgttgatgactgcattctggaaccttccccatgtccccagcggtgcgtcaatactcaaggtggatttgagtgtcactgctaccctaattatgatctggtggacggagaatgcgttgaaccagtagatccatgttttagagcaaattgtgagtatcagtgtcagcctctgaaccagacaagctacctgtgtgtttgcgccgagggcttcgcacccatcccccacgaaccccatcggtgtcagatgttctgtaaccaaaccgcatgtccagccgactgcgatcccaacacacaggcttcatgcgagtgtccagagggctatattctggatgacggctttatctgcactgatatcgatgagtgcgagaatggcggtttctgttcaggggtttgccacaaccttcctgggacatttgagtgcatttgcggacccgactccgccctggcccgtcacattgggaccgattgcgactccgggaaggtggacggcggagattctggatctggcgaacctccaccgtctccaaccccagggtccacactgactccccctgctgtgggcctggtacactctggccttttgatcgggattagtatcgctagtctgtgtcttgttgtggcactactggccctgctgtgccacctgaggaagaaacagggcgctgccagggccaagatggagtataagtgtgcagccccatccaaggaagtggtgctccagcacgtgaggaccgaaagaactccgcagcgcctgtag

SEQ ID NO: 4698 - DNA, 1674 bp, Artificial Sequence
  Description of Artificial Sequence: Synthetic coding sequence
atgagcgaagcagcctcccaggggttgagggctgccgcaaggagcgtatgggccggtactgaccgccgagggtgtagacacagacgtccagtccctttgtgtagtggtactgcactgagccaatgtccccgttttccacgaaggctgcatgccgctagattgggcaacatgctcggcgttttagtattaggtgccttggcactggcgggattggggttcccagcacccggatgtggtgatcccaagcgattgggtcctttgcgcggttttcagtgggtaaccggggacaacaacacaagttatagccgctgggcccgactggatttgaatggcgctccattatgcgggccactctgcgtcgccgtttcagctgccgaggccactgtgccatccgaacccatttgggaggaacaacagtgcgaagtgaaggccgacggctttctgtgtgagttccatttcccagccacctgcagaccactggccgtggaacccggagctgccgcagctgccgtgagcattacctatggcactcctttcgctgccagaggagctgattttcaggccttgccggtgggatcttcagcagctgtcgctcctcttgggctccagttaatgtgtaccgctccgccaggtgcagtccaaggacattgggcccgagaagcacctggcgcttgggattgctcagtagaaaatgggggatgtgaacatgcttgtaatgcaatacctggtgcacccagatgtcagtgccctgcgggagcagctctccaggccgacggtcgttcctgtactgcctccgctactcagtcatgcaacgacctgtgtgaacatttctgtgtgcccaacccagatcaacccggttcttactcttgcatgtgcgagaccggttatagactggctgcagatcagcacagatgtgaggatgtggatgactgcatccttgagccgagtccatgtccccagaggtgtgttaatacccagggcggattcgaatgccattgttatcctaactacgacctggtggatggcgaatgcgtggagccagtcgacccgtgctttcgcgcaaactgtgagtaccagtgccaacccctgaaccagaccagctatttgtgtgtctgtgctgaagggttcgccccaatcccccatgaaccgcaccggtgccagatgttctgtaatcagacggcctgcccagccgattgtgatcctaacacgcaggcaagctgcgaatgccccgaggggtacatcctggatgatgggttcatatgtaccgacattgacgagtgtgagaatgggggattctgcagcggcgtgtgccacaatcttccaggtactttcgagtgtatttgtggcccagatagcgccttggctaggcacatcggtaccgattgcgatagcggcaaagtcgacggcggagacagtggcagtggtgagccgccacccagcccaacacccggttccactctgacaccaccagctgttgggttagtccacagtgggctgctcatcggcatatctattgcctccctgtgtttggtggtagccttactcgctttgctgtgccacctccggaagaagcagggagcggcaagggccaagatggagtacaagtgtgccgcacccagtaaggaagttgtgctgcagcatgtcagaactgagagaactccgcagagactctag

SEQ ID NO: 4699 - DNA, 1062 bp, Artificial Sequence
  Description of Artificial Sequence: Synthetic coding sequence
atggagctgacggaactcctgctggttgtcatgttgcttttaactgcccgactgacgctgagctccccggctcctccggcttgcgacctgcgagtgctttctaagctgttgagggactctcacgtgctgcacagccggcttagccagtgtccagaagtccacccgctgcccacccccgtactccttcctgccgttgactttagcctcggggagtggaagacccagatggaggaaaccaaggctcaggatatcctaggcgcagtgaccttacttttagagggggtaatggccgctcgagggcagctgggacctacctgcctgagcagcctgctgggccagttgagtgggcaagttcgcctcctgctgggtgccctgcagagtcttttagggacacagctcccacctcaaggtaggacaactgctcacaaagaccctaatgccattttcctaagcttccagcacctcctcagaggcaaggtccgctttctcatgcttgtgggagggtctactctttgtgtccggagggcgccaccaaccaccgctgtcccttcccgcacgtcacttgttttgacactgaatgaacttccgaacaggacatccgggctactggagaccaatttcacagcaagcgctcggacaaccggatccggactgttgaagtggcagcaaggcttccgtgcaaaaattccagggttgctgaaccaaacttccaggagcctcgatcagattcccggatacttgaaccgcatccatgagttattgaacgggacgcggggactcttccctggacctagtagacgcaccctgggggctcccgatatttcttcggggactagcgataccggatcgctcccacctaatttgcagcccggatatagcccctctcccacacaccccccaaccgggcagtataccctgttcccactgcctcccaccttgcctaccccagtagtgcaactgcatcccctgcttccagatccgtcggcacccaccccaaccccaacttctccgttgttgaatacgtcttatacccattcccagaacctgtcccaagaggggtag

SEQ ID NO: 4700 - DNA, 945 bp, Artificial Sequence
  Description of Artificial Sequence: Synthetic coding sequence
atggagctaactgagctgctgttagttgttatgctactcttgacggcaaggttgacacttagctcccccgctcctccagcctgtgatcttcgggtgcttagcaagctgctcagagactcccacgtgctgcattcgcgcctgtcacaatgtccggaagtgcatcccctgccaacacccgtgttacttcccgctgtggacttcagtctcggggaatggaaaacccaaatggaggagactaaggcacaggacatcctcggcgctgtcactcttctgctcgaaggcgtgatggccgcaagggggcagctcggacccacatgtctcagtagcttactggggcagctttcgggccaggtccggctgctgctgggcgctctccaaagtctactcggcactcagctccctccccaggggcgtaccacagcccacaaggaccccaacgccatatttctgtcatttcagcacctgctgaggggaaaaacctccggactcctcgagacaaacttcaccgccagcgccaggactacaggttctggtttactgaaatggcagcaggggttccgcgcaaagattcccggtctgttaaatcagacgtctcgttcacttgatcagatccccggataccttaacaggatccacgaactgttgaatgggactcgcggactcttcccgggaccgagtcgccgaacactgggcgcaccggacatttcctctggcaccagcgacactggctccctccctcctaacctccaaccaggatattctccttcacctacacatccaccgacggggcagtacacgctattcccccttccccctaccctacctacaccagtggtccagttgcatcctctgctgccggatccatccgctcctacccctacaccaacaagcccactgcttaacacctcctacacacactcacaaaacctatcccaggagggctag

SEQ ID NO: 4701 - DNA, 861 bp, Artificial Sequence
  Description of Artificial Sequence: Synthetic coding sequence
atggaactgacagagctcctactagtagtcatgttactgcttactgcccgtttgaccctatcttcgcccgcacctcctgcttgtgatctccgggtgctatcaaagctgctgagagatagccacgtgctgcactcccgcctgtcacaatgcccagaagtgcaccctctgcctactcctgtgctgttgccagctgtggattttagcttaggcgaatggaagacgcagatggaggaaaccaaggctcaggatatcctcggggctgtgactctgcttctggagggggtaatggccgctcggggacaacttggcccaacttgtctatcctctctcttggggcagctgtccggacaggtgcggctgctacttggtgccctgcagagcctcctgggcactcagctcccacctcaggggagaactaccgctcataaagaccccaatgcaattttcctgtcattccaacatctgttgcgcggaaaagacttctggattgttggtgacaagctccattgcctgagccaaaactactggctgtgggctagcgaagttgctgcaggcatccaatcgcaagattcttggtcagctgaacccaacctacaggtgcccggtccgaatccccgaatccctgagcaagatacacggacactcgagtggaactcttggacactgagctggacactcactcaggaccctcggagtcccggacacttcttgcggaatattcgccatcgcctgcctgcaactcagccccctgcttggatttttagctttcccaatccttcgtcttattggacagtctacgccctcccatcgtctactcacctggctcacccctgcggtcccgcaccgcctcccgcttcttag

SEQ ID NO: 4702 - DNA, 1050 bp, Artificial Sequence
  Description of Artificial Sequence: Synthetic coding sequence
atggaacttactgagctgttgctggtggttatgctcttacttaccgctcggctcactctgagctcaccagcccctcctgcctgcgacttgagagtcctcagcaagctgctgcgcgacagccatgtactgcatagccggcttagtcaatgtccagaggtccaccctctcccaactcctgtcctccttcccgctgttgattttagcctcggggagtggaaaactcagatggaagagaccaaggctcaggacattctaggtgctgtcaccctgctcctggagggcgtgatggccgctagaggccagctcgggcctacatgcctatcatctctcctcgggcagctgagtggtcaagtgaggctcctgttaggcgctctgcaatcactgctggggacgcaggggagaacgaccgcgcataaggaccccaatgccatattcttgtccttccagcatttactgagaggaaaggtacggtttcttatgttggtcgggggaagcaccctgtgcgtgcggcgtgccccaccaactactgctgtcccaagtcgcacctccctggtcctgaccctgaatgagctgcctaacaggaccagcggactactggaaacaaactttaccgcgtcggccagaaccacaggcagcggactactgaaatggcaacagggttttcgcgcaaaaatacctggactcctaaaccagacaagcagaagtcttgaccagatccctggatatctcaatcggatccacgaactgctcaatggcactcgcggactcttccctggaccgagtagaaggactctaggagcacccgatatcagttctggtacctcagacactggcagccttcccccaaacctgcagcctggctattcccctagccctactcatccacccaccggtcagtataccctgtttccactcccgcctactctgcctacccctgtggtgcagctccacccattactccccgatcctagtgcccctacgccaacacctacctcccctttgctcaacaccagttacacccatagccagaacctttctcaggagggatag

SEQ ID NO: 4703 - DNA, 963 bp, Artificial Sequence
  Description of Artificial Sequence: Synthetic coding sequence
atgcccatgtaccaggtgaagccctaccacggcggaggagctccgctgagggttgagttacctacgtgtatgtatcgcttaccaaacgtccacggtaggtcgtatggacccgctcccggtgctggacacgtacaggaagagagtaacctgtctctgcaggcattagaatcccggcaggacgatattctcaaacgcctttatgagcttaaagcggcagtcgacgggctctccaaaatgatccagacccctgacgccgatctcgatgtgactaacattatccaggctgatgagcccactactttgaccacaaatgctttggatttgaatagtgtgctcggcaaggactacggtgcattaaaggacattgttataaatgctaacccagctagcccccctctgtcactgctcgttttgcatcggcttctgtgtgagcatttcagagtcctgagcacggtccacacacattcttctgttaagtccgtgccggagaatctgttgaagtgtttcggggagcaaaacaaaaaacagccgagacaggactatcagctagggtttactttgatctggaagaacgtcccgaaaactcagatgaagttcagcatccagaccatgtgtcctattgagggcgaagggaacatcgctcggtttctcttctccctgttcggacagaaacacaatgccgtgaatgccacccttatcgacagttgggtagacatcgccattttccagttgaaggaaggctccagcaaagagaaggctgccgtttttaggagtatgaactctgcactcggcaagtctccatggctggctggcaacgaactgacagtcgcggatgttgtgctgtggtcggtcctgcagcaaatcgggggatgctcagtcaccgtgcctgctaacgtgcagcgttggatgagatcgtgcgagaaccttgcccctttcaacacagctcttaaactccttaaatag

SEQ ID NO: 4704 - DNA, 1068 bp, Artificial Sequence
  Description of Artificial Sequence: Synthetic coding sequence
atggaacgtctgtggggtctgttccagcgggcacagcagctttctcctaggagcagccagactgtctatcaacgagtggagggaccgcgaaagggtcatctggaagaggaggaagaggacggtgaagagggagccgagacactggctcacttctgcccaatggagctgaggggaccagaaccactgggaagtaggccccgacagccgaatctcatcccgtgggctgccgctggcaggcgcgcagccccatacttagtacttaccgcccttctcatcttcaccggggcattcttgctcggttatgtggccttccggggaagctgccaggcttgcggggatagcgtcctggtggtctccgaagatgttaattacgaacccgacttagattttcaccaaggtagattgtattggtctgatctgcaggccatgttcctccagtttctgggggagggacggctggaagataccattcgacagacttcgctgagggagcgcgttgctggttccgcaggcatggccgctctgactcaagatatcagggcggcactatcccgccagaagctcgaccatgtgtggaccgatacgcactacgtcggtcttcagtttccagatccggcacaccccaacaccctacattgggtggacgaggccggaaaggtgggggaacagctgccccttgaagacccagatgtatactgtccgtactctgcgattggtaacgtcaccggcgagctcgtttatgcccattatgggaggcccgaggacctgcaggacttacgggctcggggagtggacccagtgggcaggctgttactggttagagtgggagtgataagtttcgctcagaaggaggcacagaggccgtgcggaccgcctcgaatggccggagagcctccccgactccccttgtctcccggacctcgcgctaccaccgccgcttccggccagcagtcccaggatctgcaccctcatcagcagcatctgaggctgcatcgacggccactgcgtgccagatctctgcgctgccacagaggtccagagggctgcatgggtccaagatcctcgtag

SEQ ID NO: 4705 - DNA, 2406 bp, Artificial Sequence
  Description of Artificial Sequence: Synthetic coding sequence
atggagcggctttgggggctgttccaacgggcacagcagctctcacctagaagtagccagacagtgtaccagagggtggaagggccacggaagggccacctggaagaggaagaggaagacggtgaagagggcgctgaaacacttgcccacttctgtcccatggaactgcgcggacctgagccacttggatctagaccgaggcagccaaatctgatcccttgggccgcagccggacgcagggcagccccatacctcgtcctaacggcactactcatttttaccggggcttttctgctcggttatgtggccttccgcggatcttgccaggcctgcggcgatagtgtgcttgtagtgtctgaagatgtgaactacgaacctgatctggattttcaccaaggcagactttattggagtgacctgcaagctatgttcttgcagtttctcggcgaagggaggttggaggacaccatccggcagacctcgttgcgggaaagggttgcaggatctgccggtatggctgcgctgacacaggacatccgtgccgcactgtcaagacagaaactggatcatgtatggacagacacccactatgtgggtctgcagtttccggaccccgcacaccccaacacactacactgggtcgacgaggctggcaaggttggagaacagctcccgctggaggatccggatgtgtattgcccctactccgctatcggcaatgtcacaggagagctggtctatgcacattacggccgaccggaggacctgcaagatttgagagccagaggtgtggatcctgtgggccgtctgttactggtgcgcgtcggggtgatatccttcgcacagaaggtaacaaatgctcaggattttggcgctcagggagtgctgatctatcctgaaccagcagatttcagccaagatccaccaaagccatctctctcaagccaacaggctgtgtacggacatgtgcatctggggaccggcgacccttacaccccaggctttccaagcttcaaccaaacgcagtttccccctgtggcttccagcggcctgccttcaatccccgcacagcctatatccgcagacattgccagtcgcctccttcgcaaactgaagggaccagttgcgccacaggagtggcaggggagtctactgggctctccctaccacttggggccaggtccccgtcttaggctcgttgtcaataatcatcggacttctacccccattaataatatatttgggtgcatagagggtcgctctgagcctgatcattacgtggtgatcggtgcccagcgggacgcatggggtccaggggcagcaaaaagcgcagtcggcactgccatactccttgagcttgttaggactttcagttctatggtctcaaacggtttcagaccaagacgtagcctgttgttcatatcatgggatggcggtgactttggatccgtcgggtccaccgaatggctggagggatacttgtccgtgttacatttgaaagctgttgtctatgtgtcattggataatgccgttctgggcgatgacaaatttcacgctaaaacaagccctctactgaccagcctgatcgaatcagttctgaagcaggttgactccccaaaccattctgggcagaccctgtatgagcaagtcgtgttcacaaatccgtcttgggacgcagaggtaattcgcccactacccatggattctagtgcttactcatttacagcctttgttggtgtcccggctgtggagttcagcttcatggaagacgaccaggcatatccgttcctccatacaaaggaggatacttatgagaacctacacaaggttctgcagggacgtctgcctgccgttgcacaggccgttgctcagcttgccggacagctgctaattagactgagccatgatcgactgttgcccctagacttcgggcgttatggcgacgtagtactgagacacatcgggaacctgaacgaatttagtggcgatctgaaagctagaggactgactttacagtgggtctacagtgcccgtggagattatatcagggccgctgaaaagttacgccaggagatatacagttctgaagaaagagacgagaggctgactcgaatgtataatgtgaggattatgcgggtcgaattttacttcctgtcccagtatgtgtctcccgcagactcaccattccgacacattttcatgggtaggggcgaccatacgctcggcgctctcttagaccatttaagactacttaggagcaactcaagcggaaccccgggagcaacgagtagtaccggcttccaggagtctcgattccggagacagctggccttgctgacctggacactgcaaggggctgcaaatgccttaagcggcgatgtgtggaatatcgacaacaatttttag

SEQ ID NO: 4706 - DNA, 1029 bp, Artificial Sequence
  Description of Artificial Sequence: Synthetic coding sequence
atggtatctaatggtttcaggcctcgccgtagcctcctgtttatttcatgggatggcggtgattttggatccgtgggatcaacagaatggctagaggggtatctgagtgtgctccacctgaaggctgtggtgtacgtgtctcttgataacgccgtcctgggcgacgataaatttcatgccaagacgtcacctctgctgaccagcttaatcgaaagcgtcctgaaacaggtcgactcccccaaccactcaggacaaaccctctacgaacaggtggtgttcactaatccctcttgggacgccgaagtgatccggcctttgcctatggactctagtgcctattcctttactgcctttgtcggcgtcccagccgtggaattttctttcatggaggatgaccaggcctacccctttctgcacacaaaggaggacacctacgagaatctacataaggtgctgcaaggtagactcccggcagtcgcacaggcggttgctcagctcgcagggcagttactcatcagactgagccatgatcgccttctgcccctggatttcggccgatacggcgacgttgtactgaggcacattggaaatttgaatgagtttagtggagacctgaaagcgagaggacttacactccagtgggtgtatagcgctagaggtgactacattcgagcagccgaaaaactgaggcaggagatttacagctccgaagagcgggatgaaagactgacccgcatgtacaacgtgagaataatgcgcgtggaattttacttcctgtctcagtatgtgtcccccgcagattctcccttccggcatatattcatgggtagaggggaccacactttgggtgcgttgttggaccatctgcggctgctcagatctaattcgtctggtacgcccggagccacttcttcgacaggctttcaagagtcaagattcaggcggcaactggccttgctcacatggactctgcagggcgcagcgaacgcgctctctggcgacgtttggaatatagataataatttttag

SEQ ID NO: 4707 - DNA, 1596 bp, Artificial Sequence
  Description of Artificial Sequence: Synthetic coding sequence
atggcggcaactctggacctcaaatctaaagaggagaaggatgcagagctggacaaacgcatcgaggcccttcgaagaaaaaatgaagccctgatcaggcgttaccaggaaattgaagaggatcgcaaaaaggcagaacttgagggggttgctgtgacagcccctcggaaaggtagatcagttgagaaggagaatgtagctgtcgaaagcgaaaagaacctgggtcccagcagacggtcccctgggacccctcgccctcctggcgctagcaaaggagggagaacccctccccaacaagggggacgggcaggaatgggcagagcttcccgcagctgggagggttccccaggggaacagccacgaggcggaggtgctggagggaggggaaggcggggaagaggcagagggtctccacatctttcaggcgctggggatacttctataagcgatcggaaatccaaggagtgggaagagaggcgacggcagaacattgagaagatgaacgaggagatggagaaaatcgcggagtatgagcgaaaccagcgcgagggtgtgcttgagcccaatcctgtgcgaaactttctcgatgatcccaggcgacgttcagggcctctggaagaaagcgagagggacagacgtgaggagtcgaggaggcacggcaggaattggggtggacctgatttcgagcgcgttcgctgcggactggaacatgagcgccagggtcggagggcgggactgggcagtgcaggggatatgacactgagtatgacggggagggaacgctcggagtaccttcgttggaaacaggaacgtgaaaaaatcgatcaagagcgcctccagcggcaccgtaagccgactgggcaatggaggagagaatgggacgccgagaagacagacggtatgtttaaggacggtcccgtacctgcacatgagcctagccatagatacgacgatcaggcctgggctcgccctcctaaaccaccgacatttggagagttcctcagccagcacaaggccgaggcctccagtcgtcgaaggcgcaaaagcagcaggcctcaggcaaaggccgcaccccgagcctacagtgatcatgatgatcgctgggagacaaaggagggtgccgcaagtccagcacctgaaacaccccagcctacgagtcctgagacctcgcctaaggaaacgccaatgcaaccccctgaaatccccgctcccgctcaccgacctccagaagatgagggagaagaaaatgagggagaggaggatgaggaatgggaggacataagtgaagacgaggaggaggaggagattgaggtagaagaaggggacgaggaagagccggctcaggatcaccaagcacctgaggctgcgcctactggcattccgtgctccgagcaggcccacggcgtaccattcagcccagaggaacccctgctcgagccccaggcaccaggcacacccagctcaccatttagccccccttcggggcaccagccagtttctgattggggggaagaggtggagttaaattcacctcgtacgacccatctggcaggagccctgagccctggggaggcctggccttttgaaagtgtgtag

SEQ ID NO: 4708 - DNA, 1329 bp, Artificial Sequence
  Description of Artificial Sequence: Synthetic coding sequence
atgcactactgtgtgttatcagcatttctaatcctgcacttggttactgttgccttgtccctctcaacttgttctacactggatatggatcagttcatgcggaagcgcatcgaggccatcagggggcagattttgtccaaattgaaacttactagtccacctgaagattatcccgaacccgaagaggttcccccagaggtcatctctatatataacagcacccgcgatttgctgcaggagaaagcttcaaggagagctgcagcatgcgaacgggaacggtctgacgaagagtattatgctaaagaagtttacaagattgatatgcctccgtttttcccatcagagacagtttgtcccgtcgtgacgaccccttccgggtccgtcggcagtttatgctcaaggcaaagccaggtgctttgtggctacctcgatgccatacctcctactttctatcggccttactttagaatcgtgcggttcgatgtgagcgccatggaaaaaaatgcttctaacctcgttaaagccgagttccgagtattccgactacaaaatcctaaggcaagggtaccagagcaacgcattgaactctaccagatactgaagtctaaggacctgacatcgcctacacagagatacatcgactctaaagtggtaaaaactagagccgaaggcgaatggctgagctttgatgtcactgacgccgtgcacgagtggttgcaccataaagacaggaacctgggctttaaaatctctcttcattgcccttgctgtacgttcgttccatcaaacaattacatcatccccaacaaatcagaggagcttgaggccagatttgcgggaattgatggcacctccacatatacgagcggtgaccagaaaacaattaagtccacaaggaaaaagaatagtggtaagaccccgcacctgctgctcatgctgctgccgtcctatagactggagtcgcaacagaccaatcggagaaagaagagggcattggacgcagcgtactgtttccgcaacgttcaggacaattgttgcctgaggcctttatatatcgattttaagagggaccttggctggaagtggattcatgagccaaaaggctacaacgcaaatttctgtgccggagcctgtccatacctttggtcctccgacacacagcattctcgcgtgttgtccttatataataccattaatcccgaggcctcggcctccccttgctgcgttagtcaggacttggaacccttgacaatcctgtattacatagggaaaacacctaaaatagaacagctgagcaatatgatcgtgaaaagctgcaaatgtagttag

SEQ ID NO: 4709 - DNA, 1245 bp, Artificial Sequence
  Description of Artificial Sequence: Synthetic coding sequence
atgcattattgcgtcctgtccgcatttctcatcctccacctggtaaccgttgccctgtccctgtcgacctgtagcactctcgacatggaccagtttatgaggaaacgcattgaagcaatcagagggcaaatattaagtaaattgaaattgacctcgccgcctgaggattaccccgagcccgaggaggttcctccagaagtgatatccatttataatagtactcgcgatttactccaggagaaagcctcccgtcgggctgccgcttgcgaacgggaacgctcagacgaggaatactacgctaaagaggtgtataagatcgatatgccaccattttttccaagtgaaaatgctatacctccaaccttttaccggccttacttcagaatagtgcgttttgacgtctctgccatggaaaagaacgcatcgaacctggtcaaagccgaattccgcgtgttccggctgcaaaaccccaaggccagggtgccggagcagcggatagaactgtatcaaatcctgaagtcaaaggacttaacctccccaactcagcggtacattgacagcaaagtcgtgaagactagagcagaaggtgagtggctaagtttcgatgtcactgacgctgtgcacgagtggctgcaccacaaggatcggaacctggggtttaagatttcactgcattgcccctgctgcacgttcgtgcccagcaacaactacatcattcccaataagagtgaagaactggaagcgaggtttgctgggatagatggaactagcacctataccagtggggaccaaaaaactattaaaagcacacgcaaaaaaaactccggtaaaacgccacaccttctgttgatgctgcttccatcttaccggcttgaaagccagcaaacaaacaggagaaagaagagagcattagatgccgcatattgctttaggaacgtgcaggacaattgttgcttgcgtccgctctatattgacttcaaaagagatctcgggtggaaatggattcatgaaccaaaaggatacaacgctaatttttgtgcgggagcctgcccttacctgtggagtagcgacacacagcatagcagagtactctcgctctacaacaccatcaacccggaagcctcggctagcccctgttgcgtgtcacaagacctcgagcccctgaccatactgtattacatagggaagactccaaaaatagaacaattgtctaatatgatcgtgaagtcttgtaagtgctcctag

SEQ ID NO: 4710 - DNA, 1239 bp, Artificial Sequence
  Description of Artificial Sequence: Synthetic coding sequence
atgaagatgcacctgcagcgcgctctcgtggtactggcgctgctgaacttcgcaacagtgagtctaagtctgtcgacctgtacaacccttgatttcgggcacatcaagaagaagagagtggaggctattaggggtcagattctcagcaaactccggttgacctctcctcctgagcctaccgtgatgacccacgtgccttatcaggtactcgctctgtacaactcgacgcgggagctgctagaggaaatgcacggagagcgggaggaaggctgtactcaagagaataccgagtcagagtactatgctaaggagatccacaagtttgatatgatccaagggctcgccgagcataatgaacttgctgtgtgtccgaaaggaattacctccaaagtttttcggttcaatgtgtcaagcgtcgaaaaaaaccggacgaaccttttcagagcggagttccgggtactgcgggtcccgaatccatccagcaaacgtaacgagcagagaattgaactgttccaaatacttagacccgacgagcatatagctaagcagaggtacattgggggaaaaaatctgcctacccgtggaaccgcagagtggctctctttcgacgtgacagatactgttcgagagtggttgctccggagggagtccaatctagggctggagatctccatacactgcccctgtcataccttccagcccaacggcgatatcctggaaaacatccacgaggttatggaaatcaagtttaaaggggtcgataatgaggacgatcacggcagaggagatcttggccgattaaaaaagcagaaagaccaccacaatcctcatcttattctcatgatgattcccccacacaggctcgacaatcccggacaagggggtcagcgaaaaaaaagagccttagacacaaactattgtttccgtaatctggaggagaactgttgtgtgcggccattatatatcgactttaggcaggacctgggctggaagtgggtccacgaaccaaaaggttactacgccaacttttgttctggcccttgcccctacctgagatcagctgataccacacattctaccgttttgggcttatacaacaccctgaaccctgaggcttcagccagcccctgctgcgtccctcaagatctcgagcccctgacaattctatactacgttgggcgtactccaaaagtagagcaactctcaaatatggtggtgaaatcctgtaaatgttcttag

SEQ ID NO: 4711 - DNA, 930 bp, Artificial Sequence
  Description of Artificial Sequence: Synthetic coding sequence
atgaagatgcacctgcaaagagcattggttgtgcttgccctgctaaatttcgctacagtgagtctctcgctgagtacttgcactactttggactttgggcacattaaaaagaaacgcgtggaggctattaggggtcagatcctgtctaaactgaggcttacctcgcctccagaacctacagtaatgacccacgtgccgtatcaggtgctggctttatataactctacacgggagctgctggaggaaatgcacggagagagagaggaaggatgcacccaggagaataccgagtctgaatattacgccaaggaaatccacaagtttgacatgatccagggtctggccgagcacaacgagcttgccgtttgcccgaaaggcattaccagtaaggtgttccggttcaatgtctccagcgtggaaaagaaccgcacaaatctgtttcgggcagaatttcgagtgttgcgggtgcccaatccttcatcgaaacgaaatgagcagagaattgagcttttccagatcctgcgcccagacgaacacattgccaaacagcgatacatcggtgggaaaaacctacctacacgtggaacagctgagtggctgagcttcgatgtcactgacaccgtaagggaatggcttcttagacgtgaatctaaccttggactggagatttccatccactgtccgtgtcatacattccagcccaacggggacattctcgagaatatccatgaggttatggaaatcaagttcaaaggagtggacaatgaagacgaccacggcaggggtgatttgggccgtttgaagaagcagaaggaccaccataatccccatctgatattgatgatgatcccaccgcaccgcctcgacaatcctggacaaggaggtcagcgtaagaagcgagctttggacacgaactattgtttcaggtag

SEQ ID NO: 4712 - DNA, 444 bp, Artificial Sequence
  Description of Artificial Sequence: Synthetic coding sequence
atggcttctcaccgcttgttactcctctgcctggccggtctcgtgttcgttagtgaagcaggtccaactggtaccggagagtcaaagtgcccactaatggtcaaggtgctggacgcagtacggggatcacccgcaatcaatgtggccgtgcacgtttttcggaaggctgccgatgacacctgggagccttttgctagcggcaaaacatcagagagcggtgagctgcacggactaaccaccgaagaggagttcgtcgagggcatctacaaggtcgaaattgataccaagagttactggaaggccctgggaatttctccatttcatgaacacgctgaagtggtatttaccgctaatgactccggcccacggaggtataccatcgccgctctactgagcccctattcctatagcaccactgctgtcgtcactaatccgaaagagtag

SEQ ID NO: 4713 - DNA, 555 bp, Artificial Sequence
  Description of Artificial Sequence: Synthetic coding sequence
atggcgtcgcatcgactgcttctgttatgcctagccggtctggtcttcgtgtcggaggctggtcccaccggcaccggggaatccaagtgccctttgatggtgaaggtcttggacgccgtgcggggatcccctgcaatcaacgtggccgtgcatgtctttcgtaaggcagctgacgacacttgggagccatttgctagcgggaaaacatccgagagtggggagcttcacgggctgacgacggaggaagagtttgtagaggggatatacaaagtcgagatagacacgaaaagctattggaaagcactgggaatatcgccttttcacgagcacgccgaagttagcatccagacttttgaagcctttcaggagatcctgtataaaaaaaagttcaccactctttggcattggacctccggcggacagtccttttttcgggctctggtggaggtagtgtttaccgctaacgattcaggcccacggaggtacacaatcgccgctctcctctcgccctactcatacagcaccaccgccgtcgttactaacccaaaggagtag

SEQ ID NO: 4714 - DNA, 420 bp, Artificial Sequence
  Description of Artificial Sequence: Synthetic coding sequence
atggcaagccataggttactgctgctgtgcctggccggattagtgtttgtctccgaagccggacctaccggaacaggagagagcaagtgcccactgatggtgaaggtcctggacgccgtgagaggcagccccgctatcaacgtggcagtacacgtgttccggaaggccgcagacgacacgtgggagccatttgctagcgggaaaacaagtgaatccggggagctgcatggccttacaacagaggaagagttcgtggagggcatttataaggtggagatcgatacaaagtcctactggaaggccttgggcatctcacccttccacgagcatgcggaggtagtattcaccgcgaacgattccggccctagacggtactattcatattctaccaccgccgtcgtgaccaaccccaaggagtag

SEQ ID NO: 4715 - DNA, 996 bp, Artificial Sequence
  Description of Artificial Sequence: Synthetic coding sequence
atgaatggcacccgcaactggtgtactctggtagacgtgcaccccgaggaccaagccgctgtgtacttgaagggacgctcaggagataaaatgatacatgagaaaaatatcaaccagcttaaaagtgaggtgcaatacattcaggaagctaggaattgcctccagaaactgagagaagatatttccagcaagctagatcgtaacttaggcgactctctgcatcgccaagaaatccaagtggttctggagaaacctaatgggttcagtcagagccccaccgcactctattccagtccccctgaagtggacacttgtataaacgaagatgttgagtctcttcggaagacagtgcaagacttgctggcaaaactgcaggaagccaaaaggcaacaccaaagcgactgcgtagcttttgaggtcactctctcccgatatcaacgagaagctgagcagagtaacgttgctctgcagcgcgaggaggaccgagtggagcagaaggaagccgaagtcggtgaactccaacgccgactgttgggcatggagacggaacaccaggcactgctcgcaaaggtaagggaaggggaggttgctctagaggagctgcgatccaataacgctgattgccaagctgagagggaaaaagcggcaaccctggaaaaggaggttgctggcttacgagagaagatccaccatctggatgatatgctgaagtcacagcagcgcaaggtcaggcaaatgatcgagcagctacagaattcgaaggctgtcatccaatctaaagacgccaccatccaagagttgaaagagaaaatcgcatatctggaggccgaaaatctagagatgcacgacaggatggaacacctgatcgagaagcagatttctcatggaaatttttctacccaggccagggcgaagaccgagaaccctggatcaatacggatctctaagccccctagtcctaagcccatgcctgtcatcagagtcgtggagacatag

SEQ ID NO: 4716 - DNA, 1098 bp, Artificial Sequence
  Description of Artificial Sequence: Synthetic coding sequence
atgaacgggacccggaactggtgcaccttggttgacgtgcatcctgaggaccaggcggcagcaggcaggaaaacttacgcgatggtgtcgtcacattcggctggacactccctggcatccgagctggtagagtcacatgacggacacgaggagataataaaggtgtacctcaagggcagatcaggcgacaagatgattcatgaaaaaaatatcaatcagttgaaatccgaggtgcagtacatacaggaagccagaaactgcctccagaagctgagagaggatatcagcagcaagttggataggaacctcggcgacagtctccacagacaggaaatccaagtggtcctcgagaagccaaatggattttcacagagcccaactgccttatactcttctcctcctgaggtagacacttgtatcaacgaagacgtggagtccctcaggaagacggtccaggacctgttagctaaactgcaagaggctaaaagacagcaccaatcagactgtgttgccttcgaggtgactttgtctcggtaccaacgggaggctgagcaatctaacgtagcattgcagcgggaagaagatcgcgtggaacagaaggaagctgaggtcggcgagttgcagcggagactccttggcatggagactgaacaccaggccctcttggccaaagttcgcgagggggaggtcgccctggaagaactgagatccaataatgcagactgccaggccgagcgggagaaggccgcaaccctggaaaaagaggttgccggtctgagagagaaaatccatcacctggacgacatgctgaagagccagcaacggaaggttcggcagatgatcgagcagctacaaaatagcaaagctgtgatacaaagcaaagatgcaaccatccaggaattaaaggagaagattgcctatctggaggcagaaaacctcgaaatgcatgaccgaatggagcacctgattgagaagcaaattagccatggtaacttctccacacaagctcgtgctaagaccgaaaacccagggtcaatccggattagcaaacccccttcgccaaaaccaatgccggtgatccgggtggtggagacatag

SEQ ID NO: 4717 - DNA, 1173 bp, Artificial Sequence
  Description of Artificial Sequence: Synthetic coding sequence
atgaacggaacaagaaactggtgtacactggttgatgtgcatccggaggaccaggctgctgggtcagtggacattttgcgccttactctgcagggagagttgacaggcgatgagctggaacacatcgctcaaaaagcgggacggaaaacctacgctatggtgagttctcattccgccggacactcacttgcctcggagctcgtggaaagtcacgacggccacgaggagatcatcaaggtgtacttaaaaggacgctcaggtgacaagatgatccatgagaagaacatcaatcagctgaagagtgaggtgcaatacattcaagaggcaagaaactgcctgcagaagcttagagaggacatcagttcaaagcttgacaggaacctgggtgactcgttgcaccggcaggaaattcaggtggtcttggaaaaaccaaatgggttttcacagtctcccaccgctctgtactctagcccccctgaggttgacacgtgcataaatgaagacgtcgagtccctccggaaaaccgtgcaggatctactggcgaagctgcaggaagctaaacgccagcaccagtccgattgtgtggccttcgaagtcactctgtcaaggtaccagagggaagcggagcagagtaatgtggctctccagcgggaggaggaccgggttgaacagaaagaagcggaagtgggggagctccagagacggctgcttggcatggagactgaacatcaagcgctcttggcaaaggtgcgcgaaggagaggttgccctagaggagttgcggtctaacaacgcagattgtcaggcagagagagagaaggccgcaaccctggaaaaggaagtggccggtttgcgggaaaagatccatcatctagacgatatgctcaagagccaacaacgaaaagtccggcagatgattgagcagctccagaattctaaagctgtgatccagtctaaagatgctacaatccaggagctcaaagagaagattgcttatctggaagcagagaaccttgaaatgcacgatcgaatggaacatctaatcgagaaacaaatcagccacggtaatttctccacgcaggctcgggcaaagaccgaaaatcctggctcaataagaatttccaagcctcccagccctaaacctatgcccgttattagggtggtcgaaacctag

SEQ ID NO: 4718 - DNA, 600 bp, Artificial Sequence
  Description of Artificial Sequence: Synthetic coding sequence
atgaacgggacacggaattggtgcacactggtagacgtccaccccgaggatcaggccgctgccggaagaaaaacgtacgccatggtcagttcgcactcggctggacacagtctggcatccgaactagttgagtctcatgatggacatgaggagatcataaaagtgtatctaaagggacgctctggagacaagatgatacatgaaaaaaatattaaccagttaaagtccgaagtccagtacattcaggaagcgagaaattgcttgcagaagcttcgggaagacattagcagtaagctcgaccggaacctcggcgacagtttgcacaggcaggagatccaggtcgtgctagagaaacctaacggtttctctcaaagccctacagccctgtatagtagtcctccagaagttgatacttgtatcaacgaagacgtggaatctctaagaaagacagttcaagatctacttgcaaaactgcaagaagccaagcgtcagcatcaaagcgactgtgtagcattcgaggtgacactgtcccgataccagagggaagctgagcagtctaatgtggccctacagagggaggaggataggtgcccagaatag

SEQ ID NO: 4719 - DNA, 1230 bp, Artificial Sequence
  Description of Artificial Sequence: Synthetic coding sequence
atgtcttcacccggaatgactagcctgcagcttgaaaaggaggaatgtatgcagtgcgtgccctgctccccaaggaccagagtcgctctgctggaactgtatcgggctatgtgtcaaggaagcgtggacatcctacggctaaccctgcagggggaactcactggagatgaactggagcacatcgcacagaaggctggacgcaagacttacgcgatggtatcctcccactctgctggacattctctggcaagcgagctggtcgaaagtcatgacggccatgaagagattataaaagtttatctcaaaggtagatctggggacaagatgatccatgaaaaaaacattaaccagctaaagtcagaagtgcaatatattcaggaggccaggaactgtttgcagaagcttcgcgaggacataagcagtaagcttgatcggaatctaggggatagcctccacagacaggaaatccaggtggtcctcgagaaacccaatgggttctcacagtctcccaccgcgctctattctagcccacctgaggtggacacttgtatcaacgaagacgttgaatccctgcggaagactgtgcaggacctcctggcaaaactgcaagaagcaaagagacaacaccagagtgactgcgtggcgttcgaggttactctgtcaagataccaacgtgaggcggaacaaagcaatgtggccctccagcgagaggaagatcgtgtggagcagaaagaagcagaagtgggcgagctgcagcgacgactgctggggatggagactgagcatcaagcacttttagcaaaggtccgagagggagaggtcgctctggaggagctgcggagtaataatgccgattgtcaggccgaacgcgagaaagccgcaactctggagaaagaagtggccggattgcgcgaaaagatccaccatcttgatgacatgctgaaatctcagcagcgaaaagtgcggcagatgattgagcagctccagaacagcaaagccgtgattcagtccaaagatgcgactatccaggagctgaaggaaaagatcgcatacctggaggcagaaaatctcgaaatgcacgataggatggaacacttgattgaaaagcagatttctcacggcaactttagtactcaggcgcgtgctaaaaccgagaatccaggaagtatacgaatatccaaacccccatcccctaagccaatgcccgtcatcagggtggttgagacctag

SEQ ID NO: 4720 - DNA, 543 bp, Artificial Sequence
  Description of Artificial Sequence: Synthetic coding sequence
atgaatggcactagaaactggtgtacgctggtggacgtgcacccagaagatcaggcagcagcgggaagaaaaacctacgccatggttagcagccattctgccggacactcattggcctccgaacttgtagaatcccacgatggccatgaagaaatcatcaaggtctatcttaaagggcgttcaggcgacaaaatgatccatgaaaagaatattaaccaattaaaaagcgaggttcagtatatccaagaggccaggaactgtctgcagaaactaagagaagatatttcttcgaaactagacagaaatctgggcgattccctccatagacaggagatccaagtggtcctggaaaaacctaatgggttctcccagtctcccacggcactaaaggctggtgacacagatgtccaatcagattggaggatgtcttggggtaacgaagtcccatctaccaacacagcacagtttctcgcaaccaattgcctgtttttctacctgctgcacctgcagccaactctgccttggcctcctgccgaccggtag

SEQ ID NO: 4721 - DNA, 1182 bp, Artificial Sequence
  Description of Artificial Sequence: Synthetic coding sequence
atggaagagccccagagcgaccccagtgtcgagccacccctgtcccaggagacatttagcgatctttggaagctcctgcctgagaacaacgtgttgtcccccctgccttcacaggcaatggacgatctcatgctctctccagacgacatcgagcagtggttcaccgaggacccaggaccagacgaagcccctcgtatgccagaagcagcccctccggtcgcccctgcaccagccgcaccaaccccagctgctcccgctcctgcaccgtcttggcccctgtctagcagtgtgccctcgcagaagacctatcaagggagctatggattcaggcttggtttcctgcatagcggtaccgcaaagtccgtcacctgcacatattcacctgctttgaacaaaatgttttgtcagctggcaaaaacctgccccgtccagctatgggttgactcaacacccccaccgggaacccgcgttagggccatggcaatctacaagcaatcccagcatatgacagaagtcgtccgtcgttgtccgcaccacgagcgatgtagtgattctgatggactggctccgccacagcacctcataagagtggagggcaaccttcgggtagaatacctggatgatcgcaacaccttccgacacagtgttgtagttccctacgagcctccggaagtaggctctgactgtaccaccatccattacaattacatgtgcaatagttcatgtatgggtggaatgaacagaaggccaattctaacgatcattactctcgaagacagcagtgggaatctgttaggcagaaattctttcgaggtgcgagtctgtgcatgtcctggcagggacagacggaccgaagaagaaaatttaaggaaaaaaggggaaccccaccatgagcttcctccaggaagcacgaaaagagctcttcccaataacacctcctcaagtccacagccgaagaagaaaccacttgacggcgaatacttcacgctgcagataagggggcgagagagattcgagatgtttagggagctgaacgaggctttggagcttaaagacgcccaggcagggaaagaaccaggaggaagtcgggcacatagttcccacctcaagagcaaaaagggacagtccacaagccgccacaaaaaattaatgttcaagaccgagggaccggactcagattag

SEQ ID NO: 4722 - DNA, 1032 bp, Artificial Sequence
  Description of Artificial Sequence: Synthetic coding sequence
atggaagagccacaaagcgacccctccgttgaaccacctttatcccaggaaactttttccgatctgtggaaactgttaccggaaaacaatgtcttgtccccattgccctcgcaggcaatggatgatttaatgctgagccctgacgacatagagcagtggttcaccgaggatcctggacctgacgaggcacccaggatgcccgaggcagcccctcctgtggcacctgcccctgccgcacccacccctgccgctcctgcacccgcaccttcgtggcccctttcgtcctctgttccgtcccagaaaacctaccagggtagctatggtttccggctggggttccttcacagcggtacagccaagtccgtgacctgcacttatagccccgcactcaataagatgttttgccagctggctaagacttgccctgttcagttgtgggtcgactccacgcctccccctggtacccgtgtccgcgcaatggcaatttataaacagtcccagcacatgactgaggtcgtgcgcaggtgcccgcatcacgagcgatgctccgatagcgacgggctcgccccacctcagcacctcatccgtgttgaagggaatctccgggttgagtacctagacgacaggaacacattccgccatagcgtggtagtgccttatgaacctccggaggtgggctctgattgtacaaccatccactataattatatgtgcaactcctcctgcatgggagggatgaatcgaagacccatcctgaccattatcaccctggaggatagttctggcaacctactgggacggaactcgtttgaagtccgcgtttgtgcgtgtcccggacgggacagacgcacagaggaggagaacctgcgcaagaagggggagccacaccatgagcttccccctggaagcacaaagcgggctttgcctaataacacctcttcatcaccccagcccaagaaaaaacccctggatggagagtatttcaccctgcagaagacctttcccgcaaggcatggcggatcccatctatag

SEQ ID NO: 4723 - DNA, 1149 bp, Artificial Sequence
  Description of Artificial Sequence: Synthetic coding sequence
atggaggaaccccagtctgacccttccgtagagcctcctctatcccaagaaactttctcagacttgtggaagctcctgcccgaaaataacgttctgagccccctgcccagtcaggccatggatgatctcatgttgtcccccgatgatatagaacagtggtttacagaagaccccggacccgacgaggccccacgaatgcctgaagccgctccacctgtagctcccgctcctgcagcccctacacctgcagccccagctcccgctccatcatggcccctgagcagcagtgtgcctagccagaaaacgtaccaaggctcctacggcttcaggttaacctgcacttattccccagcacttaataagatgttctgccagctggcaaaaacatgtcccgttcagctctgggttgactctactccgccaccaggtactagagtgcgtgcaatggcaatctataagcagagccagcatatgactgaagtggtccgtagatgtcctcaccacgaaagatgctccgatagtgacgggctcgcccctccccagcatctgattagggtggaaggaaatttgcgtgtcgagtatctggacgacaggaatacattccggcatagcgtcgtggtcccgtacgagcccccagaggtcggctccgattgcactacaatccactataattatatgtgtaattccagctgcatgggtggaatgaatcgccgacccatacttacgatcattaccctggaagattcgtccgggaatctgctcggcaggaactctttcgaggtgcgggtctgcgcctgtccaggtagagacagacgaacagaggaggaaaaccttcgcaaaaaaggcgagccccaccacgaactgccaccaggaagtactaaacgcgcacttcctaataacacctctagcagccctcagccaaaaaaaaaaccccttgacggggaatattttacacttcagattcggggtagggagcgctttgaaatgtttcgggagctcaacgaagctctggaactgaaagacgctcaagcaggaaaagagccagggggatcccgtgcccactcgtcccacctaaaaagcaagaaaggacaaagtacttcaagacacaagaaactaatgtttaagaccgagggccctgattccgattag

SEQ ID NO: 4724 - DNA, 858 bp, Artificial Sequence
  Description of Artificial Sequence: Synthetic coding sequence
atggaagaacctcaatcagacccatcagtcgaaccacctcttagtcaagagactttcagtgatctctggaagcttttacccgaaaataacgtgctgagccccctgccttcccaggcaatggacgacctaatgctcagcccagacgatatcgagcaatggtttacagaggacccgggacccgatgaggcacctagaatgcccgaggcagcacctccagtcgcccctgcgccagctgcaccaacccctgctgctcccgctcctgcccctagctggcccctttctagttcagtgccttcccagaagacttatcagggaagttacggttttcgccttggatttttacactctggaactgctaagtccgtaacttgtacatattctcctgctctgaacaagatgttctgccagctggcaaagacctgtccggttcagctgtgggtcgacagtactccgcctcctggaacccgcgtgcgggcaatggctatctacaagcagtcgcaacacatgacagaagtcgtccgtcgatgcccccatcatgaacggtgtagcgactccgacgggttagcaccaccccagcatctgattcgggtggaaggaaacttaagagtggagtatctggatgacagaaacacattccggcattctgtcgttgtaccatatgagcctccggaggtcggttccgactgcactaccattcactataattacatgtgtaactcgtcctgtatgggtggcatgaatagaaggccaatccttaccattatcacgctcgaagacagtcgaccgcgacaagttgatcacctgcggtccggagtgcaggactccctggccaatattgctaagtctcacctgtattag

SEQ ID NO: 4725 - DNA, 273 bp, Artificial Sequence
  Description of Artificial Sequence: Synthetic coding sequence
atgttctgccagctggctaaaacatgccccgtccagctctgggttgacagcaccccgcctcccggaacacgggtgcgagcaatggcaatctataaacagtcacagcacatgaccgaggttgtgcggcgttgccctcatcacgaacgatgcagcgacagcgacggactggctccgcctcagcacctaattcgcgtcgaagggaatctcagggttgaatacctcgatgacagaaatacgtttcggcattccgtcgtgagcggcaggcgaggttag

SEQ ID NO: 4726 - DNA, 135 bp, Artificial Sequence
  Description of Artificial Sequence: Synthetic coding sequence
ccactgcctagccaaaggcgcaaccattggatggaaaatataagtccgttttcccaccttaagtcaaaaaagggccaatctacaagcaggcacaagaagctgatgttcaagaccgagggtccagacagcgactag

SEQ ID NO: 4727 - DNA, 1026 bp, Artificial Sequence
  Description of Artificial Sequence: Synthetic coding sequence
atggaagagcctcagtcggacccctcggttgagccgccactgagccaagaaaccttcagcgatttatggaaactactgcctgagaacaacgttctgtcacccctcccgagccaggctatggatgacctgatgctgtcccccgacgatatagagcagtggttcacagaggatccgggaccagacgaagcgcctaggatgcctgaggctgcacccccagtcgcccctgcaccagccgcacccactcctgcagccccagcaccagcaccatcatggccgttaagctcatccgtgccttctcagaaaacttaccaggggagttacggattccggctgggctttttgcatagcgggaccgccaagagtgttacttgcacgtacagccctgctcttaataaaatgttttgtcaactggctaagacgtgccccgtccagctgtgggtagactctacccctccacctggaaccagagtcagagccatggcaatttacaaacagtctcagcacatgaccgaggtggtcaggcgctgccctcaccacgagcgctgcagcgattcggacggactggctccccctcaacatttgattcgcgtggaaggtaaccttcgggtggaatacctggatgatagaaacacattcagacatagtgttgtagtcccctacgagcctcccgaagtggggagcgactgtactaccatacactacaattatatgtgcaattcatcctgcatgggtggtatgaatcggagaccaatccttacaattatcaccctcgaagacagctccggtaatctgctgggacggaatagctttgaggtgcgcgtgtgcgcgtgccctggtcgcgatcgaagaacagaggaagagaacctgaggaagaaaggcgaaccacatcacgagctccctcccggatctaccaagcgagcacttcctaacaatacgtcttccagtccccagcctaaaaaaaagccactggatggagaatacttcacattgcaggatcagactagtttccagaaagaaaactgctag

SEQ ID NO: 4728 - DNA, 1182 bp, Artificial Sequence
  Description of Artificial Sequence: Synthetic coding sequence
atggaggagcctcagagcgatccaagtgtcgagccacccctctcccaggagaccttttctgatctctggaaactcctgcccgagaataatgtgctctctcctctgcccagccaagcaatggatgacctgatgctctcccccgacgacatcgaacagtggttcacagaggatccaggccctgatgaggccccaaggatgccagaagcggcacccccagtggccccagccccagcggcaccaacccccgcagctcctgcaccagcacctagctggccattgtctagttctgttccttcccagaaaacatatcaggggtcgtacggctttagacttgggttcctgcacagcgggaccgccaagtccgtgacatgcacctattcccctgctttgaacaaaatgttttgtcagttagccaaaacctgccctgtgcaactgtgggttgacagtacacccccacccggaacccgcgtccgcgctatggccatatacaagcagagccagcacatgaccgaggtggtgcggagatgtccacatcatgagcgctgctctgactctgacggcctcgcgcctcctcagcatttgataagggttgaggggaatctcagagtagagtacttggatgaccgcaatacgtttagacattctgtagtcgttccttacgagccacccgaagtgggaagcgattgtacgactattcactataactacatgtgtaattcctcatgtatggggggaatgaacagaaggccaatcctgacaatcattacactggaagactccagtggaaatctgttgggtcgcaatagtttcgaggtgagggtgtgtgcctgcccaggtcgcgatcgacggactgaagaggaaaatttgaggaaaaagggcgagccacaccacgagcttcccccagggtcaaccaaacgggctctccctaataataccagttcctcacctcagcccaaaaagaagcctcttgacggggagtatttcacgctgcagattcgcggtagagagcgcttcgagatgtttagagaactgaacgaagctcttgagctcaaagacgcacaggcaggcaaagaaccgggaggctcgcgagcacactcctcacacttaaaaagcaaaaaagggcagtcgacatctaggcataagaaattaatgtttaagacagaggggccagatagtgattag

SEQ ID NO: 4729 - DNA, 1041 bp, Artificial Sequence
  Description of Artificial Sequence: Synthetic coding sequence
atggaggagcctcaatccgacccaagtgtggagcccccactgagtcaggaaacattctctgatctctggaaactcttgcctgagaacaacgtgctgagtcctctcccctcccaggctatggacgatctgatgctctcaccggacgacattgaacagtggttcacggaagatcccggaccggatgaggcacccaggatgcccgaagctgcccctcccgtggcaccagcccctgcagccccaactcctgctgcccctgccccagccccttcttggccgctgtcaagttctgtccccagccaaaaaacctaccaaggctcttatgggtttagactgggatttctgcattcaggcacagctaagtccgtcacgtgtacatatagccccgcactgaacaaaatgttctgtcagctcgccaagacctgtcctgtgcagctgtgggtggattctaccccacctccagggacccgagtacgcgcaatggccatctacaaacagtctcagcatatgacagaggtggtaagaagatgccctcatcacgagaggtgctccgacagtgatggcctggcacctcctcagcacctgatcagggtggagggcaacctaagagtggagtatttggacgaccgcaacaccttccgtcattccgttgtggtgccatatgaaccccctgaagtcggctcagactgtacaactatccattacaactacatgtgtaattcttcttgcatgggtgggatgaacagaagacccatcctgactatcattaccctggaggacagcagtggtaacctcctggggagaaatagtttcgaggtgcgcgtgtgcgcctgtccaggtcgtgaccggaggacagaggaagagaatctgcggaaaaaaggcgaaccacatcacgaacttcccccaggctctaccaagcgtgccttgccaaataatacctcctcttcccctcagccaaagaagaaaccactggatggggagtatttcactctccagatgctgctggatctgaggtggtgctattttttaatcaatagctcttag

SEQ ID NO: 4730 - DNA, 387 bp, Artificial Sequence
  Description of Artificial Sequence: Synthetic coding sequence
atggaggagccccagagcgatccctcggtggagcctcccttaagtcaagagacctttagcgacctttggaaactgttgccagagaataatgtgctgagcccactaccaagtcaggcaatggacgatctcatgctgtcgcctgatgacatagagcagtggtttacagaagaccccggtcccgacgaggccccaagaatgcccgaagctgcccctccagtcgccccagctcccgcagctcctactcccgctgctcccgctcccgcaccctcatggcccctgtctagctcagtgccatcacagaagacctatcaaggttcttatggcttccgactgggcttcctccatagcggtacagctaagtctgtgacttgcacatacagcccatag

SEQ ID NO: 4731 - DNA, 498 bp, Artificial Sequence
  Description of Artificial Sequence: Synthetic coding sequence
atggaggaaccccaatcagatcctagcgtcgagccccctctgtctcaggaaaccttcagtgacctgtggaagctgctccccgagaacaatgtcttgtcacctctgcctagccaggccatggatgatctcatgttatcaccggacgacatcgaacagtggtttaccgaggacccaggcccagacgaagcgccacggatgcccgaagcggctccacccgtggctccggcacccgctgcccctacacctgctgcgcctgctccagccccaagttggcctctgtcctcatcggtaccttcacagaagacgtatcaggggagttacggatttaggctagggttcctgcacagcggcacagccaagtccgtgacttgcacctactctccagccctgaataagatgttctgtcagttggccaagacctgtcccgtgcaactctgggtggatagtaccccgcctccgggtactagggtgcgagcgatggctatatacaagcagtag

SEQ ID NO: 4732 - DNA, 600 bp, Artificial Sequence
  Description of Artificial Sequence: Synthetic coding sequence
atgttctgccaacttgccaagacttgccccgtccagctgtgggttgattcgactcccccaccaggcactagggtgcgggctatggccatctacaagcagtctcaacacatgactgaggtggtgcggcgttgtccccatcacgagcgctgttcagattccgacggcttagcacctcctcaacacttgattagagtggaggggaatctaagggttgagtaccttgatgaccgaaatacttttaggcacagcgtggtggtcccatacgaacccccagaggtgggatcagattgtaccaccatccactacaactacatgtgtaactcctcttgcatgggaggcatgaatcggagaccaatcctgactatcatcacattagaagattcctcaggcaacttattaggcagaaattcatttgaggtgcgcgtctgcgcatgtcccggtcgggatcgaagaacagaggaggaaaacctgcgaaaaaagggcgaaccccaccacgagctgccaccgggttctactaagagggctctgcccaacaatacttctagttcaccccaacccaagaaaaaacccctcgacggggaatattttacactgcagtag

SEQ ID NO: 4733 - DNA, 468 bp, Artificial Sequence
  Description of Artificial Sequence: Synthetic coding sequence
atggaggagccacagagtgatccgagcgtggaacctccactgtctcaggagacctttagcgatctatggaagctgctgccagagaacaatgttttatatagcccagctctgaacaaaatgttctgtcaactggccaaaacctgtcccgtgcagctgtgggtggactcgacaccaccgccagggactcgggtaagagctatggctatttacaagcagtcacagcatatgaccgaagtggtccgacgatgcccccatcacgaacgatgctcggactctgacggactcgcccctccacagcacttgattagagtagaagggaacctgagggtcgagtacttggatgataggaatactttccgccactccgtggtggtgccatatgaaccacctgaagtgggatccgattgcaccactattcactataattatatgtgcaatagcagttgcatggggggtatgaacagatag

SEQ ID NO: 4734 - DNA, 468 bp, Artificial Sequence
  Description of Artificial Sequence: Synthetic coding sequence
atggaggagccacagtcggacccatctgtggaaccacccctcagccaggagacattcagtgacctctggaaactcctgccggagaataacgttttatattctcccgcactgaataagatgttttgtcagctggcaaagacttgtccagtgcagctttgggttgactccaccccccctcccggaacaagggtcagggcaatggccatatataaacaatcacagcacatgacggaggtagtgcgcaggtgtccccaccatgaaaggtgtagtgacagtgatgggctagctcctcctcagcatcttattagggtggaaggcaacctacgagtggagtatttagatgatagaaataccttcagacactccgttgtggtgccatatgagcctcctgaggttggctcagactgcacaaccattcattataattacatgtgtaacagctcatgtatgggcggaatgaataggtag

SEQ ID NO: 4735 - DNA, 1590 bp, Artificial Sequence
  Description of Artificial Sequence: Synthetic coding sequence
atgctgttagctgtcctgtattgtctcctttggagcttccagacgtcggccggtcacttcccccgagcctgcgtgtccagcaagaacctgatggaaaaggagtgttgccccccttggtcaggagatcggtcgccgtgcgggcagctatccgggcgaggatcatgccagaatattttgcttagcaatgcaccgctggggcctcaattccccttcacgggcgtggatgatcgtgagtcatggccctcggtgttttataaccgaacttgccaatgtagcggcaatttcatggggttcaattgtggcaattgcaaatttggattttggggcccaaattgtacggaacgacgcctgctggtgagaagaaacattttcgatttatccgcccctgagaaggacaagttcttcgcatacttgactcttgcgaaacacactatcagtagcgactacgtcatcccgattggcacttacggacagatgaagaatggatctaccccgatgtttaatgatatcaacatatacgacctgtttgtttggatgcactactacgtgtccatggacgccctgctcggagggtcagagatctggcgtgatatagactttgctcacgaagcacccgcttttctgccctggcaccggctgttcctgttgcggtgggaacaagaaattcagaagctcaccggcgatgaaaattttaccattccctactgggattggagagatgcagagaaatgcgatatctgcacagatgagtatatgggtggccagcaccccaccaatccaaacctcctctctccagcctcattcttctcatcctggcagatcgtgtgctcgcgactggaggagtacaattctcatcagtctctgtgcaatggcaccccagagggccctttgcggaggaaccctggaaatcacgataagtcacgcacccctcggctgccatcctccgctgacgtggaattctgcctgagcttgacacagtacgagtctggctcaatggataaagccgctaactttagctttaggaacacactagagggatttgccagtcctttgaccggaatcgccgatgctagccaatccagcatgcacaatgccctgcacatctacatgaacgggaccatgtcccaggtccagggatctgccaatgatcctatcttcttgttacatcacgccttcgtcgatagtatttttgaacaatggctcaggagacaccgtcctctccaagaggtctacccagaggccaacgctcctattgggcacaatcgtgagagttatatggtaccctttatccctttgtacagaaatggggattttttcattagcagtaaagacctgggctatgactacagttacttacaggactccgatcctgacagctttcaggattacattaaatcttacttggaacaggccagtcgcatctggagctggttgctcggagcggctatggtaggagccgtcctgaccgcattgctggccggtctcgtctctttgctctgtcgccacaaacgcaagcagcttcctgaggaaaagcagccgctcctgatggaaaaagaagactaccactcattgtatcaaagccacttgtag

SEQ ID NO: 4736 - DNA, 1365 bp, Artificial Sequence
  Description of Artificial Sequence: Synthetic coding sequence
atggacccttatatgattcaaatgtcttccaagggcaatctccccagcatcctcgacgtccatgtgaatgtggggggtcggtccagcgtgcccggaaaaatgaaggggcgaaaagcacgctggtcagtccgacctagcgacatggccaagaagaccttcaatcccatacgggcaatcgtagacaacatgaaagttaagcccaatccaaacaaaaccatgatatcgttgtctatcggcgatccaacagtgttcggtaatctaccaaccgaccctgaagttactcaggccatgaaggacgcgctcgacagcggtaaatacaatgggtacgcaccatcaattggatttctgagttctcgtgaagagatagccagctattatcactgcccggaggcccctctggaagcaaaggacgtaatcctcacatccggctgtagtcaagccatcgacctatgcctggcagtgttggcaaatccaggacaaaacatcttggttccacgcccaggcttctccctctacaagacacttgcagagtccatggggatagaggtgaaactgtacaacctgcttcccgaaaagtcatgggagatcgatctgaaacagctggagtacctgatcgatgagaagacggcctgtctgatcgtaaataatccttcgaatccatgtggaagtgtgtttagcaagaggcacctgcagaaaattctggccgtggcagcaaggcagtgcgtaccaattctggccgatgagatctacggagacatggtcttttccgattgcaagtacgaaccccttgccactctatctacagatgtgcctatcttgagctgtggaggccttgccaaaaggtggctggtgccgggttggcggctgggctggatcctcatacacgatcgaagagatatcttcggcaatgaaatacgcgacggattagtcaaactctcccagcgcatcctcggcccttgtactatagtccagggcgctctcaagagcattctttgccgtacccccggtgagttctatcacaacactctcagcttcttgaagagtaatgcagacctgtgctatggggcactcgccgcaattcccggactgaggcccgtcaggccgagcggggctatgtatttaatggtgggtattgagatggaacattttccagagttcgaaaacgacgtcgagtttacggaacgtctagtcgccgagcagtccgttcactgcctgcccgcaacgtgctttgaatatcccaacttcatcagagtcgtgatcaccgtgcctgaagttatgatgctggaggcttgttcccgaatacaggagttctgtgaacagcattatcactgcgccgaaggctcacaggaagaatgcgacaagtag

SEQ ID NO: 4737 - DNA, 1602 bp, Artificial Sequence
  Description of Artificial Sequence: Synthetic coding sequence
atggctgttgagagccagggcggaaggccactcgttctaggtctcctgctttgcgtgttaggacccgtggtaagtcacgccggaaagattttgctgattccggtggacggatcccactggctcagcatgttgggagccattcaacaattacagcagagaggccatgagattgtggtcctggcaccggacgccagtttgtatatacgagatggcgctttttatacgctgaagacgtatcctgtgccctttcaaagagaagacgtgaaagaatcttttgtcagcctgggccacaatgttttcgagaatgactcttttctacagagagtcataaagacgtacaaaaagattaagaaagacagtgcgatgctcctgtccggctgcagccacctacttcacaataaagagttaatggcctccctggcggaatcttccttcgatgttatgttaacagatccatttctgccatgcagcccgatcgtggctcaatatctgagcctgccaacagttttcttcctccatgctctaccctgtagcttggagtttgaagcaacacagtgcccaaacccgttctcttacgtgccccgtcccctatcttcccatagcgaccacatgacctttctgcagcgtgtcaaaaacatgctaatcgcattcagccagaattttctgtgtgacgtcgtgtactccccctacgccactctagcttctgagtttctccagcgtgaagtgactgtgcaggacttgctatcaagtgccagcgtttggctgttcagatccgactttgtgaaagactatcctaggcctattatgcccaacatggttttcgtgggcggaatcaactgcctccaccaaaatcccttatcccaggagttcgaggcatacattaatgcttcgggtgagcacgggatcgtggtgttctcgctgggtagcatggtctctgaaattccggaaaaaaaggcgatggctatcgccgatgctttgggaaaaatcccccaaacagtgctgtggaggtatacgggcacaagaccctctaaccttgccaataacaccattctggtgaagtggcttccccagaacgatctcctgggccatccgatgactagagcttttatcacgcacgccggatcacatggagtttacgaatcaatctgtaacggggtgcctatggtgatgatgccactgtttggcgaccagatggacaatgcaaagcgtatggagaccaagggcgctggcgtgaccctgaacgtgctcgagatgactagcgaggacctggagaatgctctaaaggccgtaattaacgataagagctacaaggagaatataatgcgcctctcctcattacacaaagatcggccagtcgagcctctggatctcgccgtgttctgggtggagttcgttatgcgacacaagggggctcctcacctgcggcctgccgctcacgacctgacttggtaccaataccacagtctggacgtcattggttttctacttgctgtggtcctgactgtagcctttatcaccttcaagtgttgtgcatacgggtaccggaagtgtctgggtaaaaagggacgggtgaagaaagcccataagagcaagactcactag

SEQ ID NO: 4738 - DNA, 1335 bp, Artificial Sequence
  Description of Artificial Sequence: Synthetic coding sequence
atggccgttgagtctcagggaggcaggcccctagttctcggactccttctgtgcgtcctgggccctgtcgtgagccacgccggtaagatcctcttgatccccgtagatggttcccattggctgagtatgcttggcgctattcaacagctccaacagcgcggacatgagattgtcgttctcgcaccagacgctagtttatacattcgcgatggcgcattttacaccctgaaaacttaccccgtccccttccagcgggaggacgtgaaagaaagctttgtcagtctcgggcataacgttttcgagaacgatagctttctccaacgggttatcaagacctataagaaaattaaaaaggattcagccatgctgttatcggggtgcagccatctgctgcacaacaaggaactgatggcatctctcgctgaaagctctttcgacgtgatgctgaccgatcctttcctcccctgttcccccatagtggcccagtacctttccctccccactgtgttttttttgcacgccttaccttgttcgctagaatttgaagccacccagtgcccaaaccccttctcatacgtacccaggcccctaagttcccactccgaccacatgacctttctgcagcgtgtgaaaaatatgctcattgcattttcccagaacttcctgtgcgatgttgtatattcaccatacgctacactcgcatccgagtttttgcaaagagaggtgacagtacaagatctgttatcctccgcttcggtgtggctgttcagaagtgacttcgtgaaagactatcctcgtcccatcatgcccaacatggtgttcgtagggggaataaattgtttgcaccagaatcccctttcccaagagttcgaagcttatatcaatgcctccggagaacacgggatcgtggtgttttctttgggatccatggtgagcgaaatcccagagaagaaggctatggccatagccgacgccttggggaagatcccacagactgtcctttggcggtacaccggtacgcgaccgagtaatctggccaacaacacaatactagttaagtggctgccacagaatgatctgcttggtcacccaatgacaagggctttcatcacgcacgcaggctctcatggcgtctatgaatctatctgcaatggtgtaccaatggtgatgatgcctctgttcggcgatcagatggacaacgccaaaagaatggaaactaagggagctggggtaaccctgaacgtcctggaaatgacctccgaggatttggagaacgctctcaaagcggtaataaacgacaagaggaagaaacagcagtccggtcgacagatgtag

SEQ ID NO: 4739 - DNA, 1593 bp, Artificial Sequence
  Description of Artificial Sequence: Synthetic coding sequence
atggcaagggctggctggaccagccccgtcccattgtgcgtgtgtctcctgttaacatgcggatttgccgaggcaggcaagctgttggtggtgcctatggatgggtcacattggtttaccatgcagtcagtggtggagaaactgattctgcgcggtcatgaggtggtcgtcgtcatgcctgaggtaagctggcaattggagcgtagtctaaattgtacagttaagacgtactcaacctcctatacactagaagaccagaacagagagttcatggtgttcgctcatgcacagtggaaggcacaggctcagtccatattctccttgttaatgtcatcatcctctgggttcttggacctcttttttagtcactgccgcagcctcttcaacgaccgtaagctggtcgaatatctgaaggagtccagtttcgatgctgtgttcctggaccctttcgacacttgtggtctgatcgtggcgaaatatttttcactaccatctgtcgtgttcaccagagggattttttgccaccacctcgaggaaggagcacagtgtcctgctcctctgtcttatgtgccgaatgatctgctgggcttcagcgacgctatgacattcaaagaaagggtttggaaccatatcgtacatttggaggatcatttgttctgccagtacctgtttaggaacgctctggaaatcgcaagcgaaattcttcagactccagttaccgcttatgatctctacagccacactagcatctggctactgcgtacggacttcgtgcttgactaccctaaaccagtcatgcccaatatgatctttatcgggggaattaactgccaccaggggaaaccactcccaatggagtttgaagcttacattaatgctagcggcgaacatggcatcgtggtcttttcgctgggctccatggtctcagagattccagagaagaaagccatggccatcgctgacgccctggggaagatcccccaaactgtcctctggcgatacactggcacacgacccagtaatttggctaataatactatactggtgaaatggctgccgcagaacgatctgctgggacaccccatgaccagggcctttatcactcacgcaggttctcacggtgtctacgaaagtatctgcaacggagtgcctatggtcatgatgcctctgtttggcgaccagatggacaatgctaagcgaatggagacaaaaggggcaggagtgacactgaatgtgctggagatgactagcgaagaccttgagaatgctctcaaagctgtcatcaatgataaatcctacaaggagaacataatgagacttagcagtctgcacaaggatcgccctgtggagcccctggatctcgccgtcttttgggtcgagtttgtgatgaggcataagggagctccacacctacgtcctgctgcacacgaccttacttggtaccaataccattctctggatgtgatcggcttcctcttggccgtggtcctgaccgtcgcttttattacattcaagtgttgtgcttatggatatcgcaaatgtcttggaaaaaagggcagagtaaaaaaagcccacaagtccaaaacacactag

SEQ ID NO: 4740 - DNA, 1605 bp, Artificial Sequence
  Description of Artificial Sequence: Synthetic coding sequence
atggctaccggccttcaggtaccgctcccttggcttgcgactggtttactcctgctcttgagcgtgcagccttgggcggaatctggcaaagttttggtcgttcctattgatggaagccattggctctccatgcgtgaggtgcttcgagaactgcatgccaggggccatcaggccgtggtcttgacccccgaggtgaacatgcatataaaagaagagaacttcttcactctaactacttacgccatctcctggacccaggatgaatttgatcgccatgtcttgggccacacccaactatactttgaaactgagcacttcctgaaaaagttctttagaagtatggctatgctgaataacatgagccttgtttaccacaggagttgtgtggagcttctgcacaatgaggcacttatccggcacctgaatgccaccagtttcgacgtggtgctgaccgacccggtgaatctgtgtgccgcagtgcttgcaaagtatctgtcaatcccgaccgtcttcttcctgcgcaacattccctgcgacttagattttaaggggacacagtgtcctaacccttctagctatatacccagacttttaactacaaacagcgaccatatgacgttcatgcagcgtgtgaaaaacatgctttaccctttggcgttatcttatatctgtcatgcattctcagcaccgtatgcgtccctggcttccgaactgtttcaacgggaggtgagtgtcgttgacattctgagccatgccagcgtgtggctgtttagaggggattttgttatggattaccccaggcccatcatgcccaacatggtcttcattggtggtatcaactgtgctaataggaaacccctgagccaggagttcgaggcctatatcaacgcttcaggggaacacgggatcgtggtattttccctggggagtatggttagcgagattccagaaaaaaaagctatggctatcgctgacgcactgggcaaaattcctcagaccgtgctgtggagatacacaggaaccaggccttctaacttagcaaacaatacgattctcgtcaagtggctgcctcagaatgacctgctgggccacccaatgacccgcgcattcatcactcatgcagggtcccatggagtgtatgagtctatctgtaatggtgtccccatggttatgatgccactatttggtgatcagatggataacgccaagcgaatggaaaccaagggggctggggtgaccctcaacgtactggagatgacctccgaagatctagagaacgcgctaaaagcggtgattaatgacaagagttataaagaaaacattatgcgcctgtcgtcgctgcataaggatagacctgtggagccccttgatcttgctgttttttgggtggagttcgtaatgagacacaaaggggctccccatttgagacccgcagcccatgacctcacatggtatcagtaccactcgctggatgtgataggattcctgctggccgtcgtgctcaccgtggcctttatcacatttaaatgctgtgcgtacggctatcgaaagtgtctgggcaagaagggccgagtgaagaaggctcacaaatccaagacccattag

SEQ ID NO: 4741 - DNA, 1470 bp, Artificial Sequence
  Description of Artificial Sequence: Synthetic coding sequence
atggctgggcagcgggtgctgttgctcgtaggctttctgttgccgggtgtgctgctgtctgaagccgctaagatactgacaatcagcacggtggatttcaaaaaagaggagaagtcatatcaggttatcagctggttagcaccagaggaccaccagagggagttcaagaagagtttcgacttttttttggaggaaacccttggaggcagaggcaagtttgagaacctgctcaatgtgttggagtatttggctttgcaatgctcacattttcttaataggaaagacattatggattctctgaagaacgaaaatttcgacatggtgattgtagaaacctttgattactgcccctttctcatcgccgagaagctaggcaagccatttgtggcaattttgtcaacgtctttcgggagcttggagtttggcctccctatacctcttagctacgttcccgtttttagatctctgctcactgaccacatggacttctggggccgagtcaagaactttctgatgttcttctctttctgccggagacaacagcatatgcagtctacattcgacaataccattaaggagcattttacagaaggcagccgccctgtcctgtcacatcttttgctcaaagctgaactgtggtttatcaatagcgatttcgccttcgatttcgcacggcctttattaccaaacacggtgtatgttggtggactcatggagaaacctattaaaccagtccctcaggacttagagaattttattgccaagttcggggactcaggtttcgtactggtgactttaggttccatggtgaatacttgtcaaaatcccgagatctttaaagaaatgaataatgccttcgcacatctgccccagggggtcatttggaagtgtcagtgtagtcactggccaaaggatgttcatcttgccgcaaacgttaaaattgtagactggctcccccagtccgatctcctcgcccatccctcaatccgcctatttgttacccatggtgggcagaatagcatcatggaagcaatccagcatggagtgccaatggtcgggatcccactattcggagaccagcctgagaacatggttagagtcgaagcaaagaaattcggcgtttcaatacagcttaagaaattaaaggcagagactctggccctaaagatgaaacaaattatggaggacaagcgatataaatccgcagctgtggcagcttcagtgatcctgaggtcacaccctctcagtccaactcagcggctggtggggtggatcgatcacgtgctacagacagggggtgcgacgcacctgaagccctatgtcttccagcagccgtggcatgaacaataccttctggacgtctttgtgttcctgctcgggcttactttgggtactttgtggctctgtggcaagcttttaggtatggctgtctggtggttgcggggagccagaaaggttaaggaaacttag

SEQ ID NO: 4742 - DNA, 1572 bp, Artificial Sequence
  Description of Artificial Sequence: Synthetic coding sequence
atggcgggtcagagggtgctgctcttggtgggtttcctgttgcccggagtgttactgagcgaggccgcaaagatcttaacaatctccacagtgggtggctcacactatttactgatggatcgggtgtcccagatactgcaggatcacggccacaacgtgactatgttgaatcataaacgaggaccgtttatgccagattttaagaaggaggaaaaatcatatcaggtaatctcttggctggctcctgaggaccaccagcgggaatttaagaagtcattcgatttcttcctcgaggagacactcgggggaagggggaagttcgagaacttgcttaacgtgctggaatacttagctctgcaatgttctcacttcctgaaccgcaaggacatcatggacagtctcaaaaacgagaatttcgatatggtgatagtggagaccttcgactattgcccattcctcatagccgaaaagcttgggaaacctttcgtggccatactcagcactagtttcgggagtctcgagtttggattaccaatccctcttagctatgttccagtgttcagatccctcctgactgatcacatggatttttgggggagagtcaagaactttctgatgttctttagtttctgtaggagacaacagcacatgcagtctacctttgacaacacgataaaagaacattttaccgaaggtagccggcctgtgcttagtcatctgctgttgaaagctgaactctggttcattaacagcgacttcgcctttgactttgctagacctctgctcccaaacaccgtgtatgtaggaggcctcatggaaaagccgatcaagccagtgccacaggatcttgagaacttcatcgccaaattcggtgattccggctttgtgctcgttacccttggaagcatggttaatacatgccagaaccctgagatcttcaaagagatgaataatgcgtttgcacacctcccacagggcgtcatttggaagtgccaatgctctcactggccaaaagatgtgcacctcgccgcaaacgttaagattgtggactggttacctcaatccgacttgttagcacaccccagtatcagattgttcgttactcatggaggccagaacagcatcatggaagcgatccaacatggcgtgcctatggttggcattcccctattcggcgatcaacccgagaacatggtgcgcgtcgaggcaaagaaattcggtgtgagtatccagctcaaaaagctgaaagcagaaacactcgcactgaaaatgaagcagatcatggaagataaaaggtataaatccgccgcagttgccgcaagcgtcatcctccgctcgcacccactgtcccccacacagaggcttgtcgggtggattgaccacgtgcttcagacagggggtgctacgcacctaaaaccttatgtgtttcagcaaccatggcacgaacagtacttgttggacgtttttgtgttcttactggggcttaccttagggacactttggctttgtggcaagctcttgggcatggccgtgtggtggttgcggggagccaggaaagtgaaggaaacttag

SEQ ID NO: 4743 - DNA, 417 bp, Artificial Sequence
  Description of Artificial Sequence: Synthetic coding sequence
atggccggtcaacgcgtcctgcttctggtgggctttttactgcctggggtgctcttgtccgaagccgctaagatacttacgatatcgacagtcggaggtagccactacctcctgatggatagggtgtcccaaatccttcaggatcatgggcacaacgtgacaatgctcaatcataagcgaggaccgttcatgcccgacttcaaaaaggaggaaaagtcttaccaggtgatttcttggttggcaccagaggaccatcaaagagagttcaagaagagctttgacttctttctcgaagaaaccttgggcggacgcggaaaattcgaaaaccttctcaacgtccttgaatatctagccttgcagtgtagccattttctcaaccgcaaggacattatggatagccttaagaacgagaattag

SEQ ID NO: 4744 - DNA, 666 bp, Artificial Sequence
  Description of Artificial Sequence: Synthetic coding sequence
atggttaacacctgccagaatccggaaatcttcaaagaaatgaataacgcattcgctcacctaccccagggcgtgatttggaaatgccagtgttcccactggcctaaagacgtgcacctggctgctaatgtgaaaatcgtcgattggctcccccagtctgaccttctggcacatcccagtattagactgttcgtcacacatggcggacagaacagcattatggaagctattcagcacggggttccgatggtcggcatcccgcttttcggagaccagccagagaatatggtccgcgtcgaggctaagaagtttggcgtatccattcagctgaaaaagctcaaggctgagacactggctttgaagatgaaacagataatggaggataagcggtataagtccgctgcagtcgccgcttctgtcatcctccgctcccatccgctgtcgccaacacagagactggtgggctggatcgatcatgtcttgcagactgggggagctactcacttgaagccatacgtatttcagcagccatggcatgagcaatatctgctggatgtatttgtgttccttctggggctgactcttggaacgctgtggctgtgtggtaaactcctgggcatggccgtatggtggcttaggggagccagaaaagtcaaggaaacttag

SEQ ID NO: 4745 - DNA, 1086 bp, Artificial Sequence
  Description of Artificial Sequence: Synthetic coding sequence
atggccatgaactataacgcaaaagacgaagtggatggcggacccccttgcgctccaggaggaactgcgaaaaccagacgcccagataacaccgcttttaagcagcagaggctacctgcgtggcagcctatcctgacagccggaactgttttaccgatcttttttataattggcctgatcttcatccccatcggcattggaatattcgtgacttccaacaacattcgagaaatcgagatcgattacacaggtactgagccatcttcaccttgcaacaagtgcttgagtccggatgtaaccccttgcttttgcacaatcaacttcactttggagaaaagcttcgaggggaacgtcttcatgtactatggcctgtccaatttctatcaaaaccaccgcagatacgtgaaatctagggatgactcacagttgaatggggactcatctgccttgctgaatcctagcaaagaatgcgagccataccggaggaacgaggacaagcctattgctccttgcggggcaattgcgaatagtatgtttaatgacactcttgaactgtttctgattggtaatgattcctaccctatcccaatcgccttaaaaaagaaaggaatcgcctggtggactgataaaaatgtgaaattccgtaaccctcccggaggcgataatctggaggagcgttttaaaggcacgacgaagccagtgaattggttgaaacccgtctatatgctggacagtgatcccgataataatgggttcattaacgaagatttcatcgtgtggatgaggactgccgcactccccacatttcgaaaactgtaccgtttgatcgagagaaagtcagacctgcaccccacactgcccgcaggtagatatagcttgaacgtcacctataattacccggtccactacttcgacggacggaagcggatgattttgtcgaccatttcgtggatggggggaaaaaatcccttcctcgggattgcatatattgccgtgggttcgatcagtttcctgctgggggttgtccttctggtgattaatcacaagtacaggaactcctccaacacagctgatataactatttag

SEQ ID NO: 4746 - DNA, 954 bp, Artificial Sequence
  Description of Artificial Sequence: Synthetic coding sequence
ttgactgatagacaaacggataccgccccaagcccttcttaccacctgctgccagggagaagaaggactgtagacgccgctgcctcccggggtcagggccctgagccagccccaggaggcggagttgaaggcgtgggagctaggggcgtggcactcaaactgttcgttcagctgctgggctgttcccggttcggcggtgccgtggtgcgggcaggagaggcagaacctagcggcgcagcccgaagcgcgagttcaggccgtgaagagccacagccagaggagggggaggaagaggaggagaaggaggaggaacggggtcctcagtggcgactgggagctcgcaaacccggatcatggacaggggaggcagccgtctgtgccgactccgcacccgctgccagagcgccacaggccttagctcgtgcttccggcagaggtggtagagtggcccgacgcggtgccgaagagtccggccctcctcactccccttccagacgcggatcggcatcgcgagctggaccagggagggcctctgagacaatgaattttctcctgagctgggtccactggtctctggcgcttctcttgtatctgcaccacgcaaagtggtcacaggccgctcccatggcagaaggcggtggacagaatcatcacgaggtcgtcaaatttatggatgtttaccaacggagctactgtcatcctattgaaaccctggtcgacatatttcaggaatatcctgatgaaatcgagtacatattcaaaccctcatgtgtgccccttatgcggtgtggagggtgttgtaacgatgagggcctggagtgcgtgcctacggaggagagcaatattaccatgcaaatcatgcgcatcaagccccatcagggccaacacatcggggaaatgagcttcctccagcataataaatgtgagtgcaggtgtgacaaacctcgccgatag

SEQ ID NO: 4747 - DNA, 1239 bp, Artificial Sequence
  Description of Artificial Sequence: Synthetic coding sequence
cttaccgacaggcagactgacaccgccccaagcccttcctatcatctgttgcctggcaggcggagaacggttgacgccgcagccagccggggtcaaggtccagaacccgctcctggtgggggagtggagggagtgggcgctaggggcgttgccctcaaacttttcgtccagctactcggctgcagcaggttcggcggagcggtcgtgcgagcaggggaagccgagccctctggcgctgcgaggagcgcttcttcagggagggaggagcctcagcccgaggaaggggaggaagaggaagagaaggaggaagaaagaggccctcagtggcgcctcggtgctcgcaagcccggttcatggaccggcgaagctgccgtttgcgccgattccgctccggcagccagggctccacaggccctcgccagagctagtggtagagggggtcgggtggcacggcgaggagccgaagagtctggacctcctcatagcccttctcggagagggtctgcctctagagccggacccggtcgagccagtgaaacaatgaacttcctgttatcttgggtacattggagcctggctctgctgttgtacctgcaccacgcgaagtggtctcaagccgcacccatggcagagggtggcggtcagaatcatcatgaggtcgtgaaatttatggacgtgtaccagcggtcttattgtcatccaatcgaaacgctggtcgatatctttcaggaatacccagacgagatcgagtatatatttaaaccgtcttgtgtccctcttatgcgttgcggagggtgctgcaatgatgagggtttggaatgcgtgcctacagaggaatctaatataaccatgcagatcatgcgaattaagccacaccagggacagcatattggcgaaatgtccttcctgcaacataacaaatgtgagtgtagaccgaaaaaggatcgggcacgacaagagaagaaatccgtcagaggcaagggcaagggccagaagcgaaaacggaagaaatcgaggtataagagctggtccgtctacgttggcgcacgctgttgtttgatgccatggtcactacctggaccacacccctgcggcccttgtagtgagcggcgtaagcatctgtttgtgcaggatccccaaacttgtaaatgcagctgcaaaaacaccgactctaggtgcaaagccaggcagcttgagttgaacgagagaacctgtcgctgtgacaagccacggcgatag

SEQ ID NO: 4748 - DNA, 984 bp, Artificial Sequence
  Description of Artificial Sequence: Synthetic coding sequence
ctgaccgacagacaaaccgatacagccccaagtccttcctatcacctgctgcccggaagaaggcgaaccgtggacgccgctgcgtccaggggacagggacccgagcccgcacccggaggaggggtagagggcgtcggcgctagaggcgtggccttgaaattgtttgtgcagctcctcggatgcagtaggttcggcggtgccgtggtacgcgctggagaggccgaaccgagcggtgctgcccgaagcgccagcagcgggagagaggaaccacagcctgaggagggtgaagaggaagaagagaaagaggaggaaaggggcccacaatggaggctgggggcacggaaacctgggtcatggacaggcgaagccgctgtgtgcgccgactcggccccagctgcccgtgctccccaagccctagcacgagctagtgggcgaggtggcagagttgccaggaggggagccgaggagtctgggcctccccactcaccatctcgacggggaagcgcatctagagccggtcccggacgggcatcagaaacaatgaacttcctcctctcttgggtgcactggagcctggcacttctgttatatctgcaccacgcaaaatggtcccaggctgccccaatggctgaggggggaggtcagaatcatcatgaagtagtcaaattcatggacgtgtaccagcggtcctattgtcatccgatcgagaccctggtcgacatttttcaggaatacccagatgaaattgaatacattttcaaaccaagctgcgttcctctgatgcgctgcgggggttgctgcaacgatgagggtctggaatgtgtgccaacggaagagtcaaacatcactatgcaaatcatgcgcattaagccacatcagggacagcacatcggagagatgtcttttttgcagcacaacaaatgcgaatgccgccctaaaaaggacagggcccgacaggaaaagtgcgacaaaccccgacgttag

SEQ ID NO: 4749 - DNA, 1116 bp, Artificial Sequence
  Description of Artificial Sequence: Synthetic coding sequence
ctgaccgataggcagaccgataccgctccgtcgcctagttatcacttgttgccgggtagacgcaggactgtcgacgccgctgccagtagagggcagggccctgagccagctcctggaggtggcgtggagggcgtaggcgcacgaggtgtggccctgaaactgttcgtgcaactcctgggctgtagccgcttcggcggagcggtggttagggctggcgaagccgagcccagtggggctgcaagatcggccagcagcggaagggaggagccccagcccgaggaaggtgaagaggaagaggagaaagaggaggagcgaggccctcaatggcgactcggtgcaagaaaacctgggtcatggacaggagaggctgccgtctgcgcggactcagcgccagcggctcgcgcaccacaagcattggcccgagcctccgggagggggggtcgagttgctcgacggggagccgaggagtctggccctccacattcgccatcacgcagaggatctgcgtctcgggctggcccagggagagcctctgagactatgaacttcttactttcctgggtgcactggagcctcgcattactgctgtaccttcaccatgccaagtggagtcaggccgctccaatggcagaagggggtggccagaaccaccacgaagtagtcaagtttatggacgtttaccagagaagctactgccatcctattgaaacccttgtcgacatctttcaggaatatcctgatgaaattgaatacattttcaaacccagctgcgttcctcttatgcgatgtggcggatgctgtaacgatgaagggctggagtgtgtgccaacggaagagtcgaacatcaccatgcaaatcatgcggattaagccacaccagggccaacatataggagaaatgtcattcctccagcacaataagtgtgagtgtagaccaaagaaagatcgcgcaagacaagagaacccttgcggtccttgtagcgagcggcgaaagcatctttttgttcaggacccacagacctgcaaatgcagttgcaagaacactgatagcagatgtaaggccagacagctagaactgaatgagcggacatgtaggtgtgacaaaccaagacgatag

SEQ ID NO: 4750 - DNA, 444 bp, Artificial Sequence
  Description of Artificial Sequence: Synthetic coding sequence
atgaattttttgctgtcctgggttcattggagcttggcgttactgctttatctccaccatgctaagtggtcgcaagcagctccaatggctgaggggggaggtcagaatcaccacgaggttgttaagtttatggacgtgtatcagcgttcatactgccaccccatcgagacattggtggacatatttcaggaatacccggatgaaatcgaatatatttttaaacctagctgtgtgccactcatgcgctgtggcggatgctgcaatgatgaagggcttgaatgtgtgcccactgaggagtcgaacatcactatgcagatcatgaggatcaagccccatcagggccagcatattggggaaatgtccttccttcagcataacaaatgtgagtgtcgtccaaagaaagatcgagcccgtcaggagaagtgcgacaagcccaggcggtag

SEQ ID NO: 4751 - DNA, 1170 bp, Artificial Sequence
  Description of Artificial Sequence: Synthetic coding sequence
ctgacagaccgccagaccgacacggcaccatcacctagttaccatctgctgcccggaagacggagaactgtagacgcagccgcttcaagggggcaaggccctgaacccgctccagggggtggggttgaaggtgtgggcgctaggggcgttgcgctgaagctttttgtgcagctcctgggctgcagccggttcggcggagccgttgtgagggccggtgaagctgagcctagcggtgctgctcgttccgcaagctcaggcagggaggaaccccagcccgaggagggtgaggaagaggaggagaaagaggaggaacgcggtcctcagtggagactgggagcaaggaagcctgggagctggacgggtgaagccgcagtgtgcgccgattctgcaccggcagcgagagcacctcaggcacttgctcgggctagcggcagaggcggacgggtggctcggaggggcgctgaagagtccgggccacctcactccccttcacggaggggcagcgcatctcgcgcaggccctggtagagcctccgaaacaatgaactttctgctgagttgggtgcactggtcgctcgcccttctactctacttacaccacgccaagtggtcccaggctgccccaatggccgaaggtggagggcagaatcaccacgaagtggtgaagttcatggacgtttaccaacgctcttattgtcatcccatagagaccctcgttgacatctttcaggaatatccagatgagattgagtatatcttcaagccaagttgcgtgccacttatgcgctgcgggggatgctgtaatgatgaaggtctggaatgcgtgcctaccgaagagagcaacattacaatgcagataatgaggatcaaacctcatcaggggcagcatattggagagatgagtttccttcaacacaataagtgtgaatgccggcctaaaaaggatagggccagacaggagaagaagagtgtgcgtgggaagggtaaaggccagaagagaaaaaggaaaaagtctcgtccgtgcggcccatgttctgaaaggcgaaaacacctatttgttcaagacccacaaacatgcaagtgcagttgtaaaaacacagattcgagatgtaaggccaggcaactggagctgaacgagcgaacgtgtcgctgtgacaagcctaggagatag

SEQ ID NO: 4752 - DNA, 1065 bp, Artificial Sequence
  Description of Artificial Sequence: Synthetic coding sequence
ctgacggatcgtcaaacagacaccgccccttccccctcctatcatcttctccctggcaggcgtagaacggttgatgccgctgcgagtcgcggacagggtccagaacccgctccaggaggcggagtggaaggcgtgggggcaaggggagtcgcccttaagctgtttgtccagctgctgggatgttcacgattcggaggcgcagtcgtgcgcgctggcgaggctgaaccctccggggctgccagaagcgcaagctctggtcgagaagaaccgcaacctgaagaaggcgaggaagaggaagagaaagaagaagagaggggcccacagtggaggttgggggctaggaagcctggttcatggacaggggaagctgctgtgtgcgcggactctgctccggcagctcgggcaccacaggctctggcaagagctagcggccgtggcggacgggtggcccgtcggggtgcagaggagagtggcccaccacattctccctccaggcgcggatccgcctctcgtgcaggaccaggaagagcgtccgagaccatgaactttctcctttcttgggtgcactggtctctcgccctgcttctctatctgcaccacgcgaaatggagtcaggccgctcccatggctgaagggggaggccagaatcaccatgaggtggtcaagttcatggatgtctaccaacggtcttactgccatccaatcgaaactctggtcgacattttccaggagtacccagatgaaattgaatatatttttaagccctcttgcgtgccgctgatgaggtgtgggggatgctgtaatgacgaggggttggaatgtgtcccaaccgaagaaagcaatatcacaatgcagataatgcggatcaaacctcaccaaggtcaacacatcggagagatgagcttcctccagcacaacaaatgcgagtgccgcccaaagaaagaccgcgcacggcaggagaacccgtgtggaccttgcagcgagcgcagaaaacatctgtttgtgcaggatccccagacatgcaaatgcagttgcaagaacacagattctcggtgtaagatgtag

SEQ ID NO: 4753 - DNA, 1188 bp, Artificial Sequence
  Description of Artificial Sequence: Synthetic coding sequence
ctcaccgacaggcagacggatactgccccttctccctcataccaccttctgcctgggagacggaggacagtggacgcagctgcctcccgtggacagggtcccgagccagccccagggggaggggttgagggagttggcgctaggggagtggccctgaagttattcgtccagttgcttggatgctcccgcttcggcggtgctgtggtgagggccggagaagctgagccctcaggggctgccagaagcgcttcttctggtcgagaggagccgcaacccgaagaaggcgaagaggaagaggagaaggaggaagagagaggccctcaatggcgtctaggcgctagaaagccaggctcttggacaggcgaggcggcagtgtgtgcagactccgcacccgctgctcgcgctccacaggccctggccagggcctcgggtcgtggcggtcgagtggctagacgaggcgctgaagaatcaggccctcctcacagccccagtcggaggggttcagcatccagagccggtcccggtagggcctccgagaccatgaactttttgttatcgtgggtgcattggagtcttgcactgcttctgtatctccaccatgcaaagtggtcccaggccgctcccatggccgagggaggaggccaaaatcaccacgaggtggttaagttcatggatgtctaccagcgtagttactgtcatcccattgaaacgcttgttgacatttttcaggagtacccggacgagatcgagtacatttttaagccatcatgtgttccgctgatgcgttgtgggggatgctgcaatgacgagggcctggaatgtgtgccgaccgaagaaagcaacataactatgcagatcatgcggattaaaccccaccaagggcagcacataggcgagatgtcatttctgcagcacaacaaatgtgagtgtaggcccaagaaggaccgtgccaggcaggaaaagaagtccgtgaggggaaagggtaaggggcaaaaaagaaaacgcaagaagtctcgttacaagagctggtcagtcccgtgcggcccatgctctgagagaaggaaacacttatttgttcaagatccccagacctgtaaatgcagttgtaaaaatacagatagcagatgcaaagcccgacaactggagctgaatgagcgcacttgcagatgcgataagccgcgacggtag

SEQ ID NO: 4754 - DNA, 414 bp, Artificial Sequence
  Description of Artificial Sequence: Synthetic coding sequence
atgaacttccttttgagctgggttcactggagcctagcattacttttgtacctccaccacgcaaagtggtcacaagccgctccaatggcggagggcggtggacaaaaccaccacgaagtagtgaagtttatggacgtctatcaaagaagttattgccacccaatagagactctcgtagacattttccaagagtacccagacgagatagaatacatatttaagcctagttgtgtgcccctgatgcgatgcggaggatgctgtaacgatgaggggctggaatgcgtgcccaccgaagaatcaaatatcactatgcagatcatgaggatcaagcctcaccagggccagcatatcggggagatgagtttcctccaacacaacaagtgtgaatgccggtgtgacaaaccacgccgttag

SEQ ID NO: 4755 - DNA, 1116 bp, Artificial Sequence
  Description of Artificial Sequence: Synthetic coding sequence
cttacggaccggcagacggacaccgcaccgtccccaagttatcatctattaccaggaagaagacggaccgtcgatgctgccgcttctcgcggacaggggcctgagcccgcaccgggtggtggggtcgagggagtaggggcaagaggagtggctctgaagctatttgtccaattgctgggttgtagccggttcggtggcgctgtggtccgggcaggtgaggccgagccttctggcgcagccaggtcggcttcttccggaagagaagagccacagcctgaagagggagaggaggaggaggagaaggaagaggaacgtggcccacagtggcgtcttggcgcaaggaagccgggatcgtggactggcgaagcagctgtgtgcgccgattcagccccagctgccagggccccacaagccttggctagggccagtggaagaggtggaagagtggcacggcgaggcgcagaagagtccggacctccccatagcccaagtaggcgagggtcagcctcacgagccggacctgggcgagcgagtgagaccatgaattttctgttgagttgggtgcactggagtttggccttactcctatacctacaccacgcaaagtggagccaagctgccccaatggcagagggaggaggacagaatcatcatgaagtggtcaagtttatggatgtctaccagcgtagctattgtcatcctatagagacactggtggatatcttccaggagtacccagatgaaattgagtatatttttaaacctagttgtgtgcctctcatgagatgtggtggctgttgtaacgacgaggggctcgaatgcgtgcccacagaagagagcaacattacaatgcagattatgaggattaagccccaccagggccagcatatcggggagatgtccttcctccagcacaacaagtgtgaatgcagacccaagaaagatcgggctcggcaggagaatccatgtggcccttgcagtgagcggcgtaagcaccttttcgtccaggatcctcaaacttgtaaatgcagttgtaagaatacggatagccggtgtaaggctaggcaacttgaactcaacgagcgaacctgcagatcactgactcgcaaggattag

SEQ ID NO: 4756 - DNA, 630 bp, Artificial Sequence
  Description of Artificial Sequence: Synthetic coding sequence
atgaatttcctcttgagttgggttcactggtccctcgccctgctgctctacctgcatcatgcgaagtggagccaggccgcacccatggcggaaggtggaggtcaaaatcatcatgaagttgtgaagttcatggacgtttaccagcggtcatattgccacccgatcgagactttagtcgacatcttccaggaataccctgacgagatagagtacattttcaagccgagttgtgtgcctttgatgaggtgcggaggctgctgcaacgatgaggggttagagtgcgtgcctactgaggagagcaatattacaatgcaaatcatgcgcattaaacctcatcagggccagcacattggcgagatgtccttcctgcagcataacaagtgtgaatgtaggccaaagaaagatcgggcaagacaggagaagaagtccgttcgtggtaaagggaagggccagaagaggaagcgcaaaaagtcccgtccatgtggcccttgctctgagagacgcaaacatctgttcgttcaggacccccagacctgtaagtgctcgtgtaagaatacagattcaagatgtaaggctagacagttagaactcaacgaacgcacctgtagatgcgacaaacccagacggtag

SEQ ID NO: 4757 - DNA, 576 bp, Artificial Sequence
  Description of Artificial Sequence: Synthetic coding sequence
atgaatttcttgttgtcgtgggtgcactggtctctggccttactgctctatcttcaccacgccaagtggtcccaggctgcccctatggctgaaggcggtgggcaaaaccatcacgaagttgtgaaattcatggatgtgtaccagaggtcttactgccaccccattgaaacccttgtggacatattccaagaatatccagacgaaatagaatacattttcaaacccagctgcgtgccactgatgcgctgcggagggtgttgtaacgatgagggactcgagtgcgttccaacagaggagagtaatatcactatgcagatcatgagaatcaagccacatcagggccaacatatcggtgagatgagcttcttgcaacacaataagtgtgagtgtaggcccaaaaaagatagagccaggcaggagaacccatgcggaccttgctccgaaagacggaagcaccttttcgtccaggacccgcagacatgcaaatgtagttgtaagaatactgacagcagatgcaaggcaagacagctggagttgaatgagcgtacatgtagaagccttacccggaaggattag

SEQ ID NO: 4758 - DNA, 972 bp, Artificial Sequence
  Description of Artificial Sequence: Synthetic coding sequence
tgaagagggcaaggcccagagcctgcacctggcggaggagtagaaggggtgggagctagaggcgtggcactgaagctgtttgtccagcttctcggctgctctcgcttcggaggagccgtcgtgagggcgggtgaagcggagcccagtggtgccgctcggtccgcatcatccggcagagaggagccccagcctgaagagggggaggaggaggaggagaaagaggaggagcgcggacctcaatggcggctgggcgctagaaaacctggaagctggactggcgaggctgccgtctgcgccgattcagctcccgctgcacgcgctccccaggctctggcaagagcatctggtaggggcggacgggttgccagacggggagctgaagagtcaggtccaccacattccccgagcagacgcggatcggcatctcgtgctgggccaggaagggcctctgaaacgatgaacttcctgttatcttgggttcattggagtctggctctccttctctatctgcaccatgctaagtggagtcaggcggcacccatggcagaggggggaggccagaaccatcatgaggtggtgaagtttatggatgtgtatcagcgcagttattgtcaccccattgaaacgctcgtggacatttttcaggaatacccagacgaaatcgagtatatttttaagccctcttgcgtaccactgatgagatgcgggggatgttgcaacgacgagggcttagaatgtgtccccacggaggagagcaacatcaccatgcagatcatgcggatcaagccccaccagggacagcacattggggagatgtcattccttcaacacaacaaatgcgagtgcagaccgaagaaagaccgggctaggcaggagaaaaagagcgtaagaggcaaggggaaagggcagaagagaaagcggaagaagagcagatacaaatcctggtctgtctgcgataagcccagacggtag

SEQ ID NO: 4759 - DNA, 648 bp, Artificial Sequence
  Description of Artificial Sequence: Synthetic coding sequence
atgaactttctgttatcctgggtgcactggagcctcgcactgctcttatatctgcaccacgcaaaatggtctcaggccgctcctatggcggaagggggaggccaaaaccatcatgaagtcgtgaagttcatggatgtgtatcagcgcagctactgccacccaatcgagaccttggtagatatctttcaggagtatcctgacgaaattgagtacatattcaagcccagttgtgtgcctctgatgcgatgtggaggctgctgcaacgatgaaggactcgaatgtgtacctactgaagagtccaacatcacaatgcagatcatgaggattaaacctcaccagggacaacacattggtgagatgtcatttttgcagcataacaagtgtgaatgccgtccaaagaaggatagagccaggcaggaaaaaaagtctgtgagaggcaaaggaaaggggcagaaacgcaaacgcaaaaaaagccggtataaaagctggtccgttccctgtgggccttgctccgaacggaggaaacatctgttcgttcaggaccctcaaacctgtaaatgctcatgcaagaataccgacagtaggtgcaaggcaagacaactcgagttgaacgagagaacgtgtcgatgcgataagcccagacgttag

SEQ ID NO: 4760 - DNA, 525 bp, Artificial Sequence
  Description of Artificial Sequence: Synthetic coding sequence
atgaattttctcctctcctgggtgcactggtccctcgccctattgctgtacctccaccatgccaagtggtctcaagcagcccctatggccgaaggcggaggccagaatcaccatgaagtggtgaaattcatggatgtgtaccagcgaagttattgtcatcctatagaaactcttgtggatattttccaggagtaccctgatgaaattgaatatatctttaaaccgagttgcgtgccgcttatgaggtgcggcggatgttgtaatgatgagggattagagtgcgttcccactgaggaaagtaatatcactatgcagatcatgaggattaagccccatcaggggcagcacatcggagagatgagcttcctgcagcacaacaaatgcgagtgtcggccaaagaaagatcgggctcggcaggagaacccttgcggcccatgctccgagcggagaaaacacttatttgtgcaagaccctcagacctgcaaatgttcttgcaagaacaccgactcgcgttgcaagatgtag

SEQ ID NO: 4761 - DNA, 699 bp, Artificial Sequence
  Description of Artificial Sequence: Synthetic coding sequence
atgaatttcttactgtcctgggtacactggtctcttgcactgctcctatatctgcaccacgctaaatggtcccaggccgcacccatggctgaagggggaggtcagaatcatcacgaggtggtgaaattcatggacgtttatcaacggtcttattgccaccccatcgaaacactggtggatatattccaggagtatccagacgaaatagaatacatttttaagccgagctgcgttccacttatgcgatgcggaggctgctgcaatgacgagggtctggaatgcgtgcctacagaggaaagcaacatcacaatgcagatcatgcgcataaaacctcaccaagggcagcatattggagagatgagtttcctgcagcacaacaagtgcgaatgccgccctaaaaaagaccgcgcacgccaggagaagaagagcgtgaggggaaaggggaagggacagaaaaggaaacggaagaaaagtagatataaatcctggagtgtgtacgtgggcgcacgctgttgtttgatgccttggtctttacccggtccacacccatgcggcccatgcagtgagcggcgtaagcacctgtttgttcaagaccctcagacctgtaaatgtagctgtaagaacacggactcaagatgtaaagccagacagctggagctcaacgagcgaacatgccgttgcgataagcccaggcgctag

SEQ ID NO: 4762 - DNA, 576 bp, Artificial Sequence
  Description of Artificial Sequence: Synthetic coding sequence
atgaatttcctgctgtcttgggtgcattggtctttggcattgctgctgtacttgcatcatgcaaagtggagtcaggcagctccgatggccgaagggggagggcagaaccaccacgaagttgtcaaatttatggacgtgtatcagcgttcctattgccacccgatcgagacacttgtcgatatttttcaggagtacccagacgagatagaatacatcttcaaacccagctgtgtccctctgatgcgatgtgggggttgctgtaacgacgaagggttggagtgcgtaccaaccgaggagtcaaatatcacaatgcagatcatgcgtataaagccccatcagggacaacacattggtgagatgtcttttctgcaacataataagtgtgagtgtaggcctaagaaggatagggccagacaagaaaacccttgtgggccttgtagcgaacgcagaaaacacctgttcgtgcaggacccacaaacttgtaagtgctcctgtaagaacaccgactccaggtgtaaagccaggcagttggagttaaacgaaagaacatgccgctgtgacaagcccagacgctag

SEQ ID NO: 4763 - DNA, 1263 bp, Artificial Sequence
  Description of Artificial Sequence: Synthetic coding sequence
atgcacttactgggatttttctctgtggcctgtagtttgctggccgcagccctacttcctggccctagagaggctcccgctgccgctgccgctttcgagtccggccttgacctgtcagacgctgaaccggacgctggggaggcgacagcctacgcaagtaaagatctggaagaacagctacgctccgtgtcaagtgtcgatgaactgatgacagtgctctatcctgagtactggaagatgtataagtgtcagctgagaaaaggcggttggcagcataaccgcgaacaggccaacctgaacagtcgcactgaggaaacgattaagttcgccgcagcccactacaacaccgaaatcctgaaatcgatcgataatgagtggcggaaaacgcaatgtatgccgagggaagtttgtatcgatgtaggcaaggaattcggtgtggctaccaacacattttttaagcctccctgtgttagcgtctatcgctgcggtggatgctgcaattctgagggccttcagtgcatgaatacatcaaccagctacctcagtaagaccctctttgaaattaccgtgccgctgagccagggcccaaagcccgttacaattagcttcgctaaccataccagctgcaggtgcatgtcaaagttggacgtgtaccgccaggtccactccatcatacgcaggtctctgcccgctacactcccccaatgtcaagccgcaaacaagacctgtcccaccaactacatgtggaacaaccatatctgtaggtgcctcgcccaggaggattttatgttctcatcagatgcaggggacgattccaccgatggatttcatgacatatgcggcccaaataaagagcttgacgaggagacatgccaatgcgtatgcagagcgggtttacgcccagctagttgtgggcctcataaagagctggataggaatagttgccaatgtgtctgcaagaataaactgtttccttcccagtgtggggctaacagagaattcgatgaaaatacttgccagtgtgtatgcaaacggacctgtcccaggaatcagcccctgaatcctgggaaatgcgcttgtgagtgtacagagagcccccaaaagtgcctactcaaaggcaaaaaattccaccatcaaacctgctcctgttataggagaccctgcaccaaccgtcaaaaggcgtgcgaaccaggcttctcctactcagaggaggtgtgccgttgcgttccctcgtactggaagcgcccacagatgatgtcttag

SEQ ID NO: 4764 - DNA, 510 bp, Artificial Sequence
  Description of Artificial Sequence: Synthetic coding sequence
atggatacaaggaataaggctcagctactggtacttttaactctgctttccgtgttatttagtcaaacttcagcttggccgctgtacagagctccatcggccctgagactgggcgatagaattccatttgaaggcgcaaacgagcccgatcaggtgagtcttaaggaggacatcgatatgctacaaaacgccctggccgaaaatgacactccttattatgatgtgtcgcggaacgccagacatgcggacggggtctttacaagcgattttagcaagctcctgggacagctgtctgccaagaagtacctcgagtccctgatgggtaaacgtgtgtcaaacatcagcgaggatcctgtccccgtaaaacgccacagtgatgctgtcttcacagacaattacacaaggttgagaaaacagatggcagtgaaaaagtacctcaactccatcttgaacggtaaaagatcatccgagggtgagtcacctgactttccggaagaacttgagaaatag

SEQ ID NO: 4765 - DNA, 513 bp, Artificial Sequence
  Description of Artificial Sequence: Synthetic coding sequence
atggatacaaggaataaggcccagctactggtgcttctcacactgctgagtgttctttttagccagactagcgcgtggcctctgtacagggcacctagcgcactcagattgggtgaccggattccgttcgagggggcaaacgagccggaccaggtgtccctgaaggaagatattgatatgctgcaaaacgcgctggcagaaaacgacaccccatactacgatgtgagccgcaacgcacggcatgcagacggggtgttcacatctgatttcagcaaactcctcggacagttgtctgcaaaaaagtatctggagagtctgatgggcaagcgtgtttcgtccaacataagcgaggatcctgttcctgtgaaacggcactccgatgcggtatttaccgacaattacacgaggttgcgcaagcagatggcagtcaagaagtatctgaatagcatactgaacggaaagcgctcgtccgaaggagagtctccagatttcccagaggagctggagaaatag

SEQ ID NO: 4766 - DNA, 360 bp, Artificial Sequence
  Description of Artificial Sequence: Synthetic coding sequence
taggtgtccctgaaggaagatatcgatatgttgcagaatgctcttgccgagaacgataccccatattatgatgtatcacggaacgcccgacacgccgatggagtcttcacaagcgatttttcaaagctactcggccagttgagcgcaaagaagtatctggagtctttgatgggcaaacgggtctcttccaatattagtgaggatccagtacccgtgaagagacattcagacgctgtgttcacagacaattacactcgccttaggaaacaaatggcggtcaagaagtacctgaacagcatactcaacgggaaacggtctgaaggggaaagccctgatttcccagaagagttagaaaagtag

SEQ ID NO: 4767 - DNA, 774 bp, Artificial Sequence
  Description of Artificial Sequence: Synthetic coding sequence
atgcctctgaatgtcagctttaccaaccgcaattacgacttggattacgatagtgttcagccctatttctattgcgacgaagaagaaaacttttatcagcagcagcagcaatcagagttacagccccctgccccatcagaggatatatggaaaaaattcgagctgcttccgacgcctcccctgtccccatcccggagatccggcctgtgctctcccagctatgtagccgtaacgcctttttcgctgaggggggataacgatgggggtggcggttccttttctaccgcggatcagttggagatggtcactgaattgcttggcggagacatggttaatcagagctttatttgcgacccagatgatgaaacatttatcaagaatatcattatccaggattgcatgtggagcggattttccgctgccgctaagcttgtctcagaaaagctggccagttatcaggctgccagaaaggactcaggtagcccaaatcctgctcgtggacactccgtctgttcaacttcttctctgtacctgcaggacctgtcagcagccgctagcgaatgcattgacccaagtgtggtctttccttaccccctgaacgacagctcttccccaaagagctgtgcatctcaggatagctctgctttcagtccatcgagcgacagcctgctgtcatctaccgaaagctccccacaagggtcgcccgagccgctggtactgcatgaggaaacccccccaacaacaagctctgactccgggggaacacgtcgatag

SEQ ID NO: 4768 - DNA, 1365 bp, Artificial Sequence
  Description of Artificial Sequence: Synthetic coding sequence
cttgattttttcagggtggtcgaaaatcagcagcctcctgctactatgccactgaacgtgtccttcactaaccgtaattacgatttggactatgattcagtccagccttacttctactgtgatgaagaggagaacttttatcaacagcagcagcagtcagagctgcaacccccagcgccttccgaagacatttggaaaaaattcgagttactgcccaccccacccttatccccatctaggcgtagcgggctctgttctccatcctacgttgcggtgacccctttctccctacgtggagacaacgatgggggtgggggaagcttctcaactgctgaccagcttgaaatggttacagagctgcttgggggagatatggtgaaccaatcctttatttgcgaccccgatgacgagaccttcattaagaatatcattattcaggactgcatgtggtcagggttcagtgcggctgcaaagcttgtgagcgagaaactggcttcctaccaagcagctcgtaaggattcaggctcacccaacccggctcgcggacattctgtgtgctccacatcttccctctatttacaggacctgtctgctgcagcgtccgaatgtattgatccatccgtcgtattcccctaccctttaaacgacagctcttcacccaagagctgcgcgagtcaagatagttctgcttttagccctagctccgattctctgttgtcctccaccgagtcctcccctcaggggagcccggaaccgttagttctgcacgaggaaaccccgccaacaacctcttccgactctgaggaggagcaagaagatgaagaggaaatcgatgtggtgtccgtagaaaaaagacaggcccctggtaagagatctgagtccggttcgccttcagcagggggtcactctaaaccaccacacagtcctctggttctgaaacgttgtcatgtgtccactcaccagcacaactacgctgcacctccatcaacccgaaaggactaccctgctgctaaacgtgtcaagttggactcagtgagagttctccgtcagatctccaacaacaggaagtgcacttcacctagatccagcgacacagaagagaacgtcaaaagacggactcataacgtcctcgagcgccagagacgaaatgaattgaaaaggtcctttttcgcactccgtgaccagattccagaacttgaaaataatgagaaagcacccaaggtcgttatcctgaaaaaagctacggcttacattctgtcagttcaggctgaggagcaaaaattgattagtgaggaagacttactgagaaagcggagagagcaactcaaacacaaactcgaacagctcagaaactcctgtgcctag

SEQ ID NO: 4769 - DNA, 1263 bp, Artificial Sequence
  Description of Artificial Sequence: Synthetic coding sequence
atgcctctgaacgtgtctttcacaaaccgcaattacgacctggactacgacagtgtccagccgtacttctattgcgatgaggaagacatctggaagaagttcgagctcctgcccactcccccacttagcccctcccgccgatcgggcctgtgcagtcctagttacgtggctgtcactccgttttcactcaggggggacaacgacggaggcggaggttctttctcaaccgccgatcagctcgaaatggtcacagagctgctggggggagacatggtgaatcaaagtttcatttgcgatccggacgacgaaacattcataaaaaatatcatcattcaagactgcatgtggtctggatttagcgccgcagccaaattggtcagcgaaaaactcgcgtcataccaggcggctcggaaagactccgggtcccctaatcctgcaaggggacactctgtttgctctacctcaagcctgtacctgcaggatttatcagccgctgctagtgaatgcatcgatccctctgtcgtgttcccttaccccctgaacgactcaagctcccctaaatcttgtgcttctcaggattcctctgcttttagcccaagttccgacagcctgctgagctccactgaatcatcaccccagggctcccctgagccgttggtgctgcatgaggagacccctccgactacctcatcagattcagaagaagagcaagaagacgaggaagagatcgatgtggtctccgtggagaagcggcaagcacctggtaagaggagcgaaagcggctcgcccagtgccggtggccacagtaagccacctcacagtcccctggtgctaaagcggtgccatgtgtcaacacatcaacataactacgccgcaccgccttctacaaggaaagactaccccgcagcgaagagagtgaagttggattctgtcagagtgctgcgccagatctccaataaccgaaagtgcactagccccaggtcctccgatacggaggaaaacgtaaagaggagaacacataatgtactagagcgacagagaaggaacgagctaaaacgcagctttttcgcactgagagatcagattcccgagcttgagaacaatgaaaaggcacccaaagttgttatcttgaaaaaggccaccgcttacatcctgtcagttcaggcggaagaacagaagctgatttccgaagaagacctattgcgtaaacggagggagcagcttaaacacaaattggagcagttgcggaatagctgtgcatag

SEQ ID NO: 4770 - DNA, 1362 bp, Artificial Sequence
  Description of Artificial Sequence: Synthetic coding sequence
ctggacttcttccgagtagtggaaaaccagccacccgctaccatgcccctgaatgtctcattcacaaacaggaactacgacctggattacgactccgtgcagccatatttttactgcgacgaagaggaaaacttctatcagcaacaacagcagtctgaattgcaaccaccagccccaagcgaggatatttggaaaaagttcgagctgttgcctaccccgcctttgtccccatctcgtaggagcggtctttgctccccctcatacgtggcagtcacacctttctcattgagaggggataatgacggcggaggtggatctttttcgaccgccgatcagctggagatggtgactgaactattggggggagacatggtcaaccagtcattcatttgcgaccccgatgatgaaaccttcatcaagaacatcatcattcaagattgtatgtggagcgggttctcagcagccgcaaagctcgtcagtgaaaaactcgcctcctaccaggctgcgcgtaaggactctggttcccccaacccagccagaggacatagcgtgtgtagtaccagctccctataccttcaggacctttccgcagccgcatccgaatgcatagatccatctgtcgtattcccctacccgctgaatgattcctcttctcctaaatcttgcgcgagccaggacagtagcgcctttagcccttcctccgacagcttactgagtagcaccgaatcttcgccacagggctctcctgaaccattggtcctgcacgaagagacccctccaacaacctcatcagattcggaggaagagcaggaggacgaggaagaaattgacgtggtgagcgtcgaaaagaggcaagctcctggaaagagatctgagtcaggcagcccctctgcaggcggacacagcaagccacctcactcaccgctggtcctcaagagatgtcacgtatcaacccaccaacataactacgccgcacctcctagcactcggaaggactatccagccgctaagagggtgaaactcgacagtgtaagggtgctacggcaaatctccaacaaccgcaagtgcacgagcccacggagctctgacacggaggaaaacgttaaaagacggacacataacgtgttggaaagacagcgaaggaatgagctgaaacggtccttctttgctctccgtgatcagattccagagctcgaaaataatgaaaaggctcctaaggttgtgattttgaaaaaggccactgcgtatatcctctcagtccaagctgaggagcagaaactgatctccgaagaggatcttttgagaaagcgcagggaacagctgaaacataaactcgagcagcttcgcaatagttgtgcctag

SEQ ID NO: 4771 - DNA, 8441 bp, Artificial Sequence
  Description of Artificial Sequence: Synthetic coding sequence
atgataccggcacgctttgccggtgttctgcttgcgctagcactgattctccccggtaccctttgtgctgaagggacacgcggacgcagctccactgctcggtgctccctgttcggttctgacttcgtgaacactttcgatgggagcatgtattcttttgcaggatattgctcctatctgctggccggtggatgtcagaaacgaagctttagtatcattggagacttccaaaacggtaagagagtgtcattgtctgtgtatcttggagagttctttgacattcacctctttgtcaatgggactgtcacgcaaggtgatcagcgcgtcagtatgccatatgcgtcaaaggggctataccttgaaactgaagccggttactacaagttaagcggcgaagcctatggttttgtggcccgtatcgatggaagcggaaatttccaagtgttactgtcagaccggtactttaacaagacgtgcggtctctgcggcaatttcaacatatttgctgaagatgattttatgacccaggaaggaaccctgacatccgacccctatgatttcgccaactcttgggctctgagttctggcgagcagtggtgtgagagggcgtctccaccttcaagctcctgtaatatttcttctggagagatgcagaaaggtctatgggaacagtgccagctgctcaagagcacatccgtcttcgcgaggtgccatcctttggtggatccagagcctttcgtagccctgtgcgagaagaccctgtgcgagtgtgccggtggcctcgagtgcgcatgtcctgcacttctcgaatatgccaggacatgtgctcaagagggcatggtactgtacggctggactgaccacagcgcgtgctcacccgtctgcccagctggtatggagtatcggcagtgcgtgtctccatgcgcacggacttgtcagtccctacacattaatgagatgtgtcaagagcggtgtgtggacgggtgttcctgccccgaaggccagctcttagacgagggtctgtgcgtcgagagtaccgagtgtccatgcgtccattcaggaaagaggtaccctccaggaactagcctttccagagattgcaacacttgcatttgccgcaatagtcagtggatttgctctaatgaagaatgcccgggagagtgcttggttacgggccagtctcacttcaagagctttgataacagatacttcacattcagtggtatctgtcagtacctgctcgcgagagattgtcaggaccattccttctccatcgttattgagacagtgcagtgtgcagatgaccgtgatgctgtgtgcacgagaagcgtgactgttcgcctgcctggcctacacaactcgctcgtgaagctcaaacacggggctggtgtggccatggatgggcaggacgttcagctgcctttgctgaaaggcgacctacgcatacagcataccgttaccgcctccgtgcggttaagctacggcgaggacttgcagatggattgggacggcagagggagacttctggtgaaactgtcacctgtgtacgcaggcaaaacctgtggcctgtgcggcaattataacggtaaccagggtgatgatttcttgaccccgagcgggctcgcggagcccagggttgaagattttggtaatgcatggaaacttcatggtgactgccaagacctgcaaaaacaacattctgacccctgcgccctgaatccacgcatgaccagattctcagaagaggcttgcgccgtgctgacctcacctacatttgaagcatgccatagggccgtctccccacttccatacttgcgcaactgtcggtacgacgtatgttcttgctctgacggacgcgaatgtctgtgcggggcactggcctcctatgctgccgcttgcgccggacgaggcgttagagtagcttggcgggagccaggcaggtgcgagcttaactgccctaaggggcaggtgtatcttcaatgcggcactccttgtaatttaacgtgccgaagcttgagctaccccgatgaagagtgtaacgaagcctgtctggaaggctgcttctgccccccaggtctgtacatggacgaaagaggcgattgcgttcctaaagcccagtgcccttgttattatgacggcgagatatttcagcctgaagatattttctcggatcaccacaccatgtgctattgcgaagacgggttcatgcattgtacaatgagcggggttcctggaagcctgcttccagatgctgttctaagttcccctctgtcccacagatccaagcggtctttgtcttgtaggccaccaatggtgaaactagtctgccctgccgacaacctgcgcgctgaggggcttgaatgtaccaagacatgccagaattacgatctcgaatgtatgagcatgggctgcgtcagcggatgtctttgcccgccaggcatggtccgtcatgagaaccggtgtgtcgccttggagagatgtccctgcttccaccagggcaaagagtatgctcccggtgagacagttaagattggctgcaacacctgtgtttgtcaggatcgaaaatggaactgtacggaccacgtgtgtgatgccacctgttcaaccatagggatggctcactacctcacattcgacgggttgaaatacttatttccaggcgaatgtcaatatgtcctagttcaggactactgcgggtccaatcctggcacttttaggatcctggtaggtaataagggatgttcccatccttccgttaagtgtaagaagcgcgtgaccatactggtagaggggggagaaatcgaactgttcgacggtgaggtgaatgttaaacgccctatgaaggatgaaacacatttcgaggtggtcgagagcggcagatatattattcttctgctcggcaaagccctgagtgtggtttgggatcgtcatctctcaatcagtgttgtgctgaagcagacatatcaggagaaggtgtgcgggttgtgcggcaattttgatggcatccagaataatgacctaacctcctcaaatctgcaggtcgaggaggacccagtcgattttggaaactcatggaaagtttcgtcacagtgcgccgacacccggaaagtgcctttggactctagccccgctacctgccacaacaacatcatgaagcagaccatggtagatagttcttgtagaattttaaccagcgacgtttttcaggactgcaacaaactggtggaccctgagccttacctggatgtgtgcatatacgacacatgcagctgcgagtctataggcgattgcgcatgtttctgtgacaccattgcagcctacgctcatgtgtgtgcccagcacggaaaggtcgtcacctggagaacggcgaccctctgcccgcaatcatgcgaggagcgtaatttgcgtgaaaatggatacgaatgcgagtggaggtacaacagttgcgcccctgcttgtcaagtgacttgtcaacaccctgaacctctggcctgccccgtccagtgtgttgaggggtgccacgcgcactgtccgcctggcaaaatcctagacgaattgctgcagacttgtgtggaccccgaggattgtccagtgtgcgaggtggccggacggaggtttgcatctgggaagaaggtgaccttgaacccctctgatcccgaacattgtcaaatctgtcattgcgacgttgtgaacctaacatgtgaggcctgccaggagcccggaggcttagttgtgccacctactgatgcccctgtctcccctactactctttatgtggaggatatctcagagccccctctccatgatttctattgttccaggctcttggacctggtgtttctcctcgatggtagcagcagactctctgaagcagaatttgaggtgttgaaggcctttgttgttgatatgatggaaaggttgaggatctcccagaagtgggtgcgagtcgccgttgtggagtatcacgacggaagccatgcatacatcggcctgaaggacagaaagaggcccagcgaactaaggcgcatcgcatcacaggtgaagtacgctggttctcaggtggctagcacaagtgaggtgctaaagtacactctctttcagatattttcaaagatcgatcgaccagaggcatcccggattacccttttgctgatggcctcgcaggagccacagagaatgtccaggaacttcgtgcggtatgtgcaggggctaaaaaagaaaaaggtaatcgtcatacccgttggcattggccctcacgctaatctgaaacagatccgtttgattgaaaagcaggctcctgagaacaaggcctttgtcctatcctccgtggatgaactggaacaacagcgcgacgaaattgtgtcttatttatgtgacttagcaccagaagcccctccaccaacgctgcccccagatatggcccaggtaactgttggcccaggactcctaggcgtcagcacgttaggccctaagaggaactctatggtcctggacgtcgccttcgtacttgagggatcagacaagatcggggaagctgactttaatagaagtaaagaattcatggaagaggtgattcagcgaatggatgttgggcaggacagtatccacgtcacagtgctgcagtactcgtatatggtcacagtggagtacccgttctccgaggcccagtcgaagggcgatatcctgcagagggtgcgggaaattcgttatcaggggggtaaccggactaataccggcttggcgctacgctacctgagcgatcactcctttctggtgtcacagggcgatagggaacaggcgccaaaccttgtttatatggttaccgggaatccagcatctgatgagatcaagcgactgccaggcgatattcaggtcgtgcctattggcgtcggtcctaatgcgaatgtccaagaattggaaaggattggctggccaaatgcaccaattttgatccaggactttgaaacactacctcgcgaagcgcctgatcttgtgcttcagcgctgttgctcaggagaaggacttcagattcccaccctgtctccagcacctgactgtagtcagccgctagatgtgatcctgctgctggacggtagctcaagtttccccgctagctactttgacgaaatgaagagcttcgcaaaagcattcatctccaaggcaaacatcggccctcgcctgacacaggtctctgtgctacagtatggctccatcaccacaatcgatgtgccgtggaacgtcgtgccagagaaggcccacctcctctccttggtcgatgtgatgcagagagaaggtggtccgagccagatcggcgatgccctgggattcgcggtgcgatacttgactagcgagatgcatggtgcgagacccggagctagtaaagccgttgtgattctcgtgaccgacgtgtcggttgactcagtagacgcagcagccgatgccgcaagatctaatcgagtgactgtttttccaattgggataggtgataggtatgacgccgcacagttgagaatcctggctgggcctgctggcgactcaaacgttgtcaaactgcagagaatcgaagacctgcccaccatggtgacccttggtaactcctttttacataaattatgttccgggttcgtgcggatttgcatggatgaggatgggaacgagaaaaggcctggcgacgtctggaccctccccgatcagtgtcacactgtcacctgtcagccagatggtcagacgctcctgaaatcccatcgcgttaactgtgaccgcggattacgaccttcttgcccgaactcccagagccctgttaaggtggaagaaacctgcggatgcaggtggacatgtccctgcgtatgtaccgggagctccaccagacatattgtcaccttcgacggacagaatttcaaacttacggggtcgtgttcatatgtgctgtttcagaataaagagcaggacctagaggtcatcttacataatggagcttgtagcccgggtgcacggcagggttgcatgaagtcgattgaagtgaagcattcagctctctcagtggagttgcatagcgatatggaagtgacagtcaacggtcgactcgtgtctgtgccctacgtcggtggcaacatggaggtgaacgtctatggcgctataatgcacgaagttcggttcaatcatctggggcacatctttaccttcactccgcaaaataatgagtttcaattgcaactgagccctaagacctttgctagtaaaacttacggcctctgtgggatctgtgacgaaaatggtgcaaatgacttcatgctcagggatggaaccgtgactaccgactggaagaccctggtgcaggagtggaccgtgcagcgcccaggacagacatgccagcctatcctagaagaacaatgcctggtgcctgattcttctcattgccaggtgctcctcctgcctctatttgccgagtgtcacaaagttttagccccagcgacattctacgccatttgccaacaggattcttgccaccaggaacaggtttgcgaggtgatcgcctcttacgcacacctgtgtcggacgaacggagtgtgcgtagactggcggacgcccgacttctgtgccatgagctgtccgccaagtttggtgtacaaccactgcgagcacggatgtccgagacactgcgatggaaacgtgtcatcatgtggtgaccatcctagtgagggttgcttctgccccccagataaggtgatgctcgagggatcttgcgttcccgaagaggcttgcacccaatgtatcggagaggacggcgtacagcaccagtttcttgaagcctgggttcctgaccaccaaccttgccagatttgtacctgcctaagtggcagaaaggtgaactgtaccacccagccctgcccaaccgccaaggcgcctacttgtggcctatgtgaagtcgcgaggctgcgccagaacgccgaccagtgttgtcccgaatatgagtgcgtatgtgatcctgtgagctgcgacctcccgcctgtccctcactgcgaacgtggattgcaacccaccctaacaaatcccggtgaatgccggccaaacttcacctgtgcatgcaggaaggaagagtgcaaaagagtgagccctccatcatgccctcctcaccggctccctaccctgaggaagacgcagtgttgcgacgagtacgagtgtgcctgtaattgtgtgaatagtaccgtgagctgccccctcgggtatctcgcttctactgctaccaacgactgcgggtgcacgacgactacatgtctgcctgacaaagtgtgtgtgcaccgctctaccatttaccccgtgggtcagttttgggaggaggggtgcgacgtttgcacctgtaccgatatggaagatgcagtcatgggcctgcgggtggcacagtgcagtcagaaaccctgtgaggacagttgccggagtggttttacttatgtgctccatgagggagaatgctgtgggagatgccttccttctgcttgtgaggtggtcaccgggtctccacgcggagactcccagtcttcttggaagtcagtcggaagccagtgggcaagccccgagaatccctgtctgatcaacgaatgtgtgcgggtgaaggaggaagttttcatccagcagaggaacgtaagctgtccacaattagaagtgcccgtgtgcccatccgggttccagttatcttgcaagacttcagcgtgttgccccagctgtcggtgcgagcgcatggaggcttgtatgttgaacggaactgttatcggtcccggtaaaacagtcatgatcgatgtgtgcactacatgcaggtgtatggtgcaagttggcgttatctctgggttcaagctggagtgtaggaaaaccacgtgcaatccatgcccgctgggttataaggaggaaaataataccggagaatgttgcggccgttgtcttccgaccgcttgcacgatccagttaaggggtggccagattatgacattaaaacgggacgagacactgcaagatggctgtgatacccacttctgcaaggtgaacgaacgcggagagtatttttgggaaaagcgggtcaccggttgtccacccttcgacgaacacaaatgtctggccgagggtggaaaaatcatgaaaattcctggcacatgctgcgatacatgcgaggagcctgagtgcaatgatataaccgcgaggctacagtacgtgaaagtgggctcctgtaagtccgaagtagaagtggacattcactactgccaggggaaatgcgcttctaaagcgatgtactctatagatatcaacgatgtccaggatcagtgctcatgctgctcacccacccgcacagagccaatgcaggtagccctgcactgcactaatggcagcgtggtgtatcacgaggtgctgaacgcaatggaatgcaagtgcagcccccgaaaatgctccaagta

SEQ ID NO: 4772 - DNA, 816 bp, Artificial Sequence
  Description of Artificial Sequence: Synthetic coding sequence
atgaccgaaccgcaggtgggctgcgtggcctgtcctcgggtccacaaagagcctgcccaagtaggcaccccatggcccgctaaaccacggtcacatcctaggaagagagaccccacagcgctgctgccaaggtcgctttggcctgcctgccaggagagtgttactgctctgtgtttcttgcaagaaaccgtggaacgattgggacaaagccctgcacaagacacacccgttctggggccttgctgggaccctatggctctgggcacacagggtcgcctgcttcttgacagggacagcaaagacactcagactagaattagccagaaaggaaggagattacaaccgccagggacaccgtctgcacctcctcagagacgccctcggaagcagttgaacccttgtcgcggaaccgagagagtcgatccgggattcgagggtgtaacacttaagtttcagattaaaccagattcatctctgcagattatcccaacatattcactcccttgttcaagccggtctcaggaatctcctgcggacgccgttggcggtccggctgcccacccaggtggaacggaagctcactcagccggaagcgaagccttagaaccccgtagatgtgcaagttgtaggacccagcgtacacccttgtggcgtgacgctgaggacggcacccctttgtgcaacgcctgcgggattagatacaagaagtacggcactcggtgcagcagttgttggctcgtccctagaaagaacgtgcaacctaagagactgtgcggacgttgtggcgtaagtctcgatccaatccaggaagggtag

SEQ ID NO: 4773 - RNA, 438 nt, Artificial Sequence
  Description of Artificial Sequence: Synthetic coding sequence
augaguacagagggcggcggacgccgaugccaggcacaaguaucccggcgaaucucauuuucagcuucgcauaggcuguauagcaaguuucugagcgacgaggagaaccugaaacuguuuggcaaguguaauaaucccaauggacacggccauaacuauaaaguagucguaacugugcacggcgaaauagacccagcuaccggaaugguuaugaaccuggcggaucuuaagaaauauauggaggaggcaaucaugcagccauuagaccacaagaaucuugacauggacguucccuacuucgcagauguugucagcacuacagagaacguggcaguguacauaugggacaauuugcagaaaguacugccaguuggagugcucuacaaaguaaaaguguaugagaccgacaacaacauuguuguguacaaaggcgaguag

SEQ ID NO: 4774 - RNA, 4284 nt, Artificial Sequence
  Description of Artificial Sequence: Synthetic coding sequence
augcaucaacgccacccccgggcccgauguccgccucugugugucgcugggauccucgcuuguggcuuccugcugggaugcuggggucccucacacuuucaacagucuugccugcaggccuuggagccacaggcugugucuuccuaccucuccccgggagcgccccugaagggaagaccaccaucacccgguuuccaaagacagcgucaacgccaacguagggcagccgguggcauccuacaucucgaguugcugguugcugugggccccgacguuuuccaggcccaccaagaggacaccgagcgcuacguccuuacuaaccucaauaucggggcggaauuauuaagagaccccucacuuggagcgcaauuuagagugcaccuugugaagaugguuauccugacggaaccagaaggcgccccgaacaucacugcaaaucuuaccagcucucuuuuauccgugugcggcuggucucagacaauuaacccugaggaugauaccgacccagggcaugcagaucucgugcuauauauuacccgguucgaucucgaguugccugacggcaacagacaggucagaggcgugacucagcucggcggggcaugcucacccaccuggagcugucugaucacugaagauaccggcuuugauuugggcguaaccauugcucacgaaaucggacacuccuuugggcuugagcacgauggggcuccaggaagcggcuguggaccaagcggccacgugauggcguccgauggggccgcuccccgggccggguuagcuugguccccuugcucucggagacagcugcucucucuuuuaagcgcuggaagagcuagaugcguaugggaucccccacgaccacagccuggcucugccggucacccuccugaugcccagccaggccucuauuauagcgcuaaugagcagugucgagucgccuuugggccuaaggcagucgcguguaccuuugccagagagcaucuugauaugugucaggcucuaucuugucacacugauccccuugaccagagcuccuguucccgccuccuuguuccccuucuggacggcacugaaugugguguagaaaaauggugcaguaaagggcggugucgaagucucguggagcugacaccaauugcugccguccacggccgcuggucaaguuggggcccgaggagcccuugcucccgauccuguggaggugguguggugaccagaagacgacaaugcaauaauccucggccagcuuuugguggccgagcaugcgugggggccgaccugcaggcugagaugugcaauacucaggccugcgaaaagacccagcucgaguuuaugagccagcaaugugcucgcacugauggccagccauuaagauccucaccaggaggagcaagcuucuaucacuggggagcggcaguuccccauucccagggugaugcucugugcaggcauaugugccgagcuaucggcgagucguuuaucaugaaacggggagauaguuuccuugacggcacaagguguaugcccucugguccacgggaagauggcacccugucccuaugugugagcggaaguuguaggacuuuuggcugcgacggaagaauggauagccagcaaguuugggaucgaugucaggugugcgggggagacaauuccacauguucaccccgcaaggggucauuuacugcagggcgcgcccgggaauauguaaccuuccucacugucacaccuaaccugacauccgucuauaucgcaaaucauagaccccucuuuacucaucuggccguccggauaggcggcagguacguuguugcaggcaagaugagcauuaguccaaacacaacauaccccagccuccuggaagacggaaggguggaguaucgcguggcucucacggaagacagacuaccucgacuugaagagauaagaauuugggguccucugcaggaagacgcggauauccagguguaccggagauacggcgaagaguacggcaacuugaccaggccugauaucacguuuaccuacuuccaaccaaagccccgccaggcgugggugugggcagccgugcggggccccugcucuguuagcuguggggccgggcugaggugggugaauuauucgugccuagaucaggcuaggaaagaacuggucgaaaccguccagugucaggguagccagcagccaccugcauggcccgaagcaugcgugcuugagccgugcccgccauacugggccguuggugacuuuggacccugcucugcuucuugcgguggcggucugcgagaaaggccagugaggugcguggaagcccaagguucgcugcuuaaaacacuucccccugcucgguguagagcuggcgcucagcagccagcgguugcccucgagaccuguaacccccagccauguccggcccguugggaagucagcgagccauccuccuguacgucagccggaggggccggcuuggcacuugagaaugagaccugcgugcccggagcugacggcuuggaagcucccgugacagaaggcccugguuccguggacgagaaacucccggcaccugaacccugcgucggaaugaguugcccuccugguugggggcaccuggaugcaaccuccgcuggagaaaaagccccaucucccuggggcucaauuagaaccggggcacaggcugcacacguauggacaccugcagcagguagcuguucugucuccugcggccgcggccuuauggagcugcgcuuccugugcauggauucagcccugcgggucccugugcaagaggaguugugcggucuugcuaguaagccaggauccaggcgugagguuugucaagcugugccuugcccugcccgguggcaguacaagcucgcggcuugcagcgucucuugcggcagaggcguggugaggaggauccuuuacugugcaagggcacacggggaggacgauggggaagaaauacuucuugauacacagugucaagggcugccuagaccggagccucaggaagcuugcucacuagagcccugcccaccgcgguggaaagugaugucucucggaccguguucugcuucuuguggucuggggaccgcaaggcgaaguguggcuugcguucaacucgaccagggccaggaugucgagguugaugaggccgcaugcgcugcuuugguucggcccgaggccagugucccuugccugauugcugacuguacuuaucgcuggcacgugggcacuuggauggagugcagcgugucauguggggacggaauacagcguagacgugauaccugccuggguccucaggcacaagccccagucccagcggacuucugucagcaucugccaaaacccgugacaguccggggaugcugggcuggucccugcgucggacaggggaccccuagccucguaccacacgaggaagccgcugcucccggucggacuacggccacgccagcuggagcaucuuuagaguggucacaggcacgaggccuccucuucagcccugcgccccagccaaggcgccuguuaccuggaccucaagaaaacagugugcagagcagcgccuguggcagacagcaucucgaacccacagggaccauagacaugcgcggccccggacaggcagacugcgccgucgccauaggcagaccgcuuggcgagguggugacacugagagugcuugagucuuccuuaaacuguagugcaggcgauauguuacugcuguggggacgucugaccuggcggaagaugugucgcaaauugcucgacaugacauuuagcagcaaaacgaacacacuggucgugaggcagagaugcggucgucccgggggcggggugcuacugcgauacgggucccagcuagcuccggagaccuuuuaucgagaaugugacaugcagcuguuuggccccuggggagagauuguuucuccuagccucagccccgccacaucuaacgcagguggauguagguuauucauuaacgucgccccccaugcccggaucgcuauccaugcucuugccacgaauaugggugccggaaccgaaggugcaaacgcuaguuacauccucauucgggauacacacucccuucgcacaacggcauuccacggucagcaggugcuguacugggagucugaauccucccaggccgaaauggaguucucugagggauuucucaaggcccaggcuagccucagaggacaguauuggacuuugcagucuuggguccccgaaaugcaggacccacaaagcuggaaggggaaggagggcacauag

SEQ ID NO: 4775 - RNA, 3309 nt, Artificial Sequence
  Description of Artificial Sequence: Synthetic coding sequence
auguuccagcuuccugucaauaacuugggcagcuuacgaaaggcccggaaaacuguaaagaaaauucucucagauauuggucuagaauacuguaaggagcacauugaggacuuuaagcaguuugaaccaaaugauuuuuacuugaagaacacaacuugggaggacgucgguuugugggacccaagucugacaaagaaucaagauuacagaaccaaaccauuuugcuguucagccugccccuuuucuucaaaguuuuucagcgccuauaagagucacuuccggaacguccacagugaggauuucgagaaccgcaucuuacuuaauugccccuauuguacuuuuaacgcagauaagaaaacauuagagacgcacaucaagauauuucaugcuccgaacgccucagccccuucaagcagcuuaucaacauucaaggauaagaacaagaaugacggccuuaaacccaagcaagcagacaguguggagcaagcaguguauuauugcaaaaaguguacauaucgggacccucuuuaugagaucgugcgaaaacacaucuacagagaacacuuccaacacguggccgcucccuacaucgcaaaagcuggcgaaaaaucacugaauggggcugugccucugggguccaacgcgcgcgaagaaagcaguauucauuguaaaaggugccuguuuaugccuaaaucuuacgaagcccuggugcagcacguaauugaagaccaugaaaggaucggcuaccaggugacugccaugauaggucauacuaaugucguggucccuaggagcaaaccauuaaugcugaucgccccuaagccacaggacaagaaaucgauggggcugcccccucguaucgggagccuggccucaggaaauguuagaucccugcccucacaacagauggugaacaggcuuuccaucccuaaaccgaacuuaaacuccacaggggugaacaugaugaguuccguucacuugcaacagaacaauuauggagucaaauccgugggccagggguauucagugggacagucgaugaggcugggacugggugggaacgcuccugucucaauaccccaacagucucaauccgucaagcaauuguugccauccgguaacggcaggagcuauggccucgggagugagcaaagaagucaagcgccugcccguuacucccugcaaucugccaaugcaucaucccuuucuagcggacagcugaaaucgcccucccuuagccagucccaggcaagccgaguguuaggacagagcuccaguaagcccgccgcugccgcuaccgguccaccaccaggaaacacuaguuccacgcagaaauggaagaucugcacaaucugcaacgagcuauuuccagagaacguguacagugugcacuuugaaaaagagcacaaagccgagaaagucccagccguggcuaacuacauuaugaaaauucacaauuuuacuaguaaguguuuguacuguaauagguauuugcccacugacacucuacuaaaucauaugcuaauacacggacuguccugcccuuauugccgcuccaccuucaacgacgucgaaaagauggcugcccacaugcguaugguccacauugacgaggagauggggccaaaaacagacagcacucuuucauuugaccuuacgcugcagcagggcucccacacaaauauacaccuguuagucacaacauacaaccugcgggacgcaccugccgaauccguagcuuaccacgcucaaaauaaucccccggucccccccaagccacaaccuaaagugcaggagaaggcagacaucccagugaagucuagcccccaggcugcaguacccuacaagaaggaugugggaaagacguugugcccucugugcuucucgauccuaaaggguccaauuuccgaugcuuuggcucaccaccugcgcgaacgccaucaagugauccaaaccguccauccaguugagaaaaaguugacuuauaaauguauucacugucugggcgucuacaccuccaauaugaccgcuagcaccaucacccuccaucuggugcacugcagaggagugggcaaaacucagaacggacaggacaaaaccaacgcaccaagccgccucaaucaguccccaucucuggcacccguaaaacgaaccuaugagcaaauggaauuuccccuucuuaaaaaacgcaagcucgacgacgauagugauucccccagcuucuuugaggaaaagccagaggagccggucguguuggcccuggacccuaaaggccacgaggacgauucuuacgaagccagaaagucguuccuuacuaaguacuuuaauaaacagcccuauccuacccggagggaaauagaaaagcucgcugccucucucugguuguggaaaucagacauugcuucucauuucagcaauaaaaggaaaaaaugcguccgugauugugagaaauacaagccaggggugcugcugggauucaauaugaaagaacuuaacaaagugaaacacgaaauggacuucgacgccgaauggcuguuugagaaccacgaugaaaaggauagccgcgucaaugcaucaaaaacugcagacaaaaagcucaaucuggguaaagaggaugauagcagcagcgauaguuucgagaaucuggaggaagaauccaacgaaagcgguagcccuuucgaccccguuuucgaaguggaaccgaagaucagcaacgauaauccugaagaacacgugcugaaggugauuccagaagacgcuucugaguccgaggaaaagcucgaccagaaggaagaugggucuaaauaugaaacuauacaccugacggaggaacccacuaagcucaugcacaaugcgucagauucagagguggaccaggacgaugugguugaguggaaggacggcgccucccccucugagagcgguccaggcucccaacaggugagcgauuucgaggacaauacgugugagaugaaaccaggcacguggagugaugaauccagccagagcgaggaugccagaagcaguaagccugcagccaaaaaaaaagccaccaugcagggcgauagagagcaguuaaaauggaagaacagcucuuauggaaaagucgaaggcuucuggucuaaagaccagagccaauggaagaacgccagugaaaacgaugaaagacuguccaacccacaaaucgaguggcagaauagcaccauagacagugaagacggggaacaguuugacaauaugacagacggcguggcugagccaaugcauggcucccuggcaggcgugaaacugaguagucaacaggccuag
